United States Patent 10,570,408 (TRANSGENIC PLANTS WITH ENHANCED AGRONOMIC TRAITS) - sequence listing, part 4

SEQ ID NO: 12997 - protein, 516 aa, Zea mays
MANPLAGLQDHLKLARDYALEGLYDTSIIFFDGAIAQINKHLTTLDDALIRTKWMNCKKAISEEVEIVKQLDAQLKSLKEAPGSRRSSSPPIRSNKSFVFQPLDEYPTSSPAPFDDPDVWAPPRDTPTRRPTRGQSSARKSSQDGAWARGSSRTGTPSRSAKPNGIKGGAVKSTASNSSVRKGKQSSSKADSTSSDAEEGKSKKGQYEGPDMDLAAMLERDVLDSTPGVRWDDVAGLSEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCTSRGASGEHESSRRVKSELLVQIDGVNNSSTTEDGQPKIVMVLAATNFPWDIDEALRRRLEKRIYIPLPDFESRKALININLRTVQIAADVNIDEVARRTEGYSGDDLTNVCRDASMNGMRRKIAGKTRDEIKNMSKDDIAKDPVAMCDFVEALVKVQKSVSPADIEKHEKWMAEFGSA

SEQ ID NO: 12998 - protein, 388 aa, Rhodospirillum rubrum
MPVAESSAPAMTKRDFYEVLGVSKGASNDEIKKSYRTLAMRYHPDRNPNDAEAEANFREVNTAYEVLKDEQKRAAYDRFGHAAFEQAGAGRGAGDFGFGAGFADIFDEMFGEFMGGGRRGGSTAMRGADLRYNMEISLEEAFAGKKTTVHVPTSVSCESCRGSGSKGGAAPDGCPTCHGSGRVRAQQGFFTIERTCPTCHGQGKVIRDPCPDCAGSGRQRREKTLEVTIPAGVEEGTRIRLAGEGEAGLRGAPSGDLYIFLTIAPHRIFLRDGANIACKVPIPMTTAALGGTIEVPTIDGGRAAVTIPQGTQTGNQFRLRSKGMSVLRSASRGDMFVHAVVETPVNLTKRQEELLREFEEAGDKDTAHSPESSSFFKKVKEFWEDIAG

SEQ ID NO: 12999 - protein, 56 aa, Glycine max
KRFGMKLKIKKLVGKNSHNIIEAPFKVFAGAFGKATEYDPGPGGIIPSSKGVLSGS

SEQ ID NO: 13000 - protein, 448 aa, Methanocaldococcus jannaschii
MRAIIIGSGAAGLTTASTIRKYNKDMEIVVITKEKEIAYSPCAIPYVIEGAIKSFDDIIMHTPEDYKRERNIDILTETTVIDVDSKNNKIKCVDKDGNEFEMNYDYLVLATGAEPFIPPIEGKDLDGVFKVRTIEDGRAILKYIEENGCKKVAVVGAGAIGLEMAYGLKCRGLDVLVVEMAPQVLPRFLDPDMAEIVQKYLEKEGIKVMLSKPLEKIVGKEKVEAVYVDGKLYDVDMVIMATGVRPNIELAKKAGCKIGKFAIEVNEKMQTSIPNIYAVGDCVEVIDFITGEKTLSPFGTAAVRQGKVAGKNIAGVEAKFYPVLNSAVSKIGDLEIGGTGLTAFSANLKRIPIVIGRAKALTRARYYPGGKEIEIKMIFNEDGKVVGCQIVGGERVAERIDAMSIAIFKKVSAEELANMEFCYAPPVSMVHEPLSLAAEDALKKLSNK

SEQ ID NO: 13001 - protein, 915 aa, Hordeum vulgare
MAASVEPRQPFGRLDAPATAPTARAPGSNGIRRRADSPVRGCGFPSLISPPRKGPVAEEEEDDDDEDDEGHEDWREAYGSHLQLEVEPSTRDPRDEGTADAWIERNPSLIRLTGKHPLNCEPPLARLMHHGFITPAPLHYVRNHGAVPRGDWATWTVEVTGLVRRPARLTMDELANGFPAAEVPATLVCAGNRRKEQNMVQQTVGFNWGAAGVSTSVWRGARLRDVLLRCGVMSKKGQALNVCFEGAEDLPGGGGSKYGTSVSREWAMDPSRDIILPYAQNGEPLLPDHGYPVRVLIPGCIGGRMVKWVRRIVVTTAESDNYYHFKDNRVLPSHVDAELANAEAWWYRPEYIINELNTNCVITTPGHDEILPINAFTTQRAYTIKGYAYSGGGKKITRVEVTLDGGESWMLCTLDIPEKPNKYGRYWCWCFWSVEIEVLDLLGAKEVAVRTWDQTHNTQPEKLIWNLMGMMNNCWFKIKVNVCRPHKGEIGLVFEHPTQPGNQTGGWMARQKHLETAEAAAPGLKRSTSTPFMNTAGDKQFTMSEVRKHGSKESAWIVVHGHVYDCTAFLKDHPGGADSILINAGSDCTEEFDAIHSDKAKALLDTYRIGELITTGTGYNSDNSVHGGSSLSHLAPIREATKVAGAPIALSSPREKVPCRLVDKKELSHDVRLFRFALPSSDQVLGLPVGKHIFVCATIDGKLCMRAYTPTSMVDEIGQFELLVKVYFRDEHPKFPNGGLMTQYLESLQVGSSYIDVKGPLGHVEYTGRGNFVINGKQRRARRLAMICGGSGITPMYQVIQAVLRDQPEDETEMHLVYANRSEDDILLRDELDRWAAEYPDRLKVWYVIDQVKRPEDGWKFSVGFVTEDILRAHVPEGGDDTLALACGPPPMIKFAISPNLEKMKYDMANSFISF

SEQ ID NO: 13002 - protein, 201 aa, Candida glabrata
MEKMEKTYGQEPGQEPGQEPGQEQEQALEQSREQEQGRGAGMKGEELDVQFDNGAHEDGLEFEEDEDVFRNVGLGLEGHYKEIMIEYWQQLINEIESTNEPGSEYQDDFKSHSLPFARIRRVMKTDEEVKMISAEAPIIFAKACEVFITELTMRAWCVAEKHKRRTLQKADIAEALQMSDMFDFLIDIVPRSTIGAQNNSS

SEQ ID NO: 13003 - protein, 352 aa, Hevea brasiliensis
MAISSSTSGTSSSLPSRTTVMLLLFFFAASVGITDAQVGVCYGMQGNNLPPVSEVIALYKKSNITRMRIYDPNRAVLEALRGSNIELILGVPNSDLQSLTNPSNAKSWVQKNVRGFWSSVLFRYIAVGNEISPVNRGTAWLAQFVLPAMRNIHDAIRSAGLQDQIKVSTAIDLTLVGNSYPPSAGAFRDDVRSYLNPIIRFLSSIRSPLLANIYPYFTYAGNPRDISLPYALFTSPSVVVWDGQRGYKNLFDATLDVLYSALERASGGSLEVVVSESGWPSAGAFAATFDNGRTYLSNLIQHVKRGTPKRPNRAIETYLFAMFDENKKQPEVEKQFGLFFPDKWQKYNLNFG

SEQ ID NO: 13004 - protein, 904 aa, Nicotiana tabacum
MAASVENRQFSHIEAGLSRSFKPRSDSPVRGCNFPPPNSTNFQKKPNSTIFLDYSSSEDDDDDDEKNEYLQMIKKGNSELEPSVHDSRDEGTADNWIERNFSLIRLTGKHPFNSEPPLNRLMHHGFITPVPLHYVRNHGPVPKGTWDDWTVEVTGLVKRPMKFTMDQLVNEFPSRELPVTLVCAGNRRKEQNMVKQTIGFNWGAAAVSTTVWRGVPLRALLKRYGVFSKNKGALNVCFEGADVLPGGGGSKYGTSIKKEFAMDPARDIIIAYMQNGEKLAPDHGFPVRMIIPGFIGGRMVKWIKRIIVTTQESDSYYHFKDNRVLPPHVDAELANTEAWWYKPEYIINELNINSVITTPCHEEILPINAWTTQRPYTLRGYSYSGGGKKVTRVEVTLDGGETWQVCTLDHPEKPTKYGKYWCWCFWSLEVEVLDLLSAKEIAVRAWDETLNTQPEKLIWNVMGMMNNCWFRVKMNVCKPHKGEIGIVFEHPTQPGNQSGGWMAKERHLEISAEAPPTLKKSISTPFMNTASKMYSMSEVRKHSSADSAWIIVHGHIYDATRFLKDHPGGSDSILINAGTDCTEEFDAIHSDKAKKLLEEFRIGELLTTGYTSDSPGNSVHGSSSFSSFLAPIKELVPAQRSVALIPREKIPCKLIDKQSISPDVRKFRFALPSEDQVLGLPVGKHIFLCAVIDDKLCMRAYTPTSTIDEVGYFELVVKIYFKGIHPKFPNGGQMSQYLDSLQLGSFLDVKGPLGHIEYQGKGNFLVHGKQKFAKKLAMIAGGTGITPVYQVMQAILKDPEDDTEMYVVYANRTEDDILLKEELDSWAEKIPERVKVWYVVQDSIKEGWKYSLGFISEAILREHIPEPSHTTLALACGPPPMIQFAVNPNLEKMGYDIKDSLLVF

SEQ ID NO: 13005 - protein, 73 aa, Unknown
  Nocardioides sp. JS614
MPKKEGVIEIEGTVVEALPNAMFRVELSNGHKVLAHISGKMRQHYIRILPEDRVVVELSPYDLTRGRIVYRYK

SEQ ID NO: 13006 - protein, 73 aa, Tropheryma whipplei
MAKKDGVIELEGSVLEALPNATFRVELSNGHKVLAHISGRMRQHYIRILPEDRVVVELSPYDLARGRIVYRYK

SEQ ID NO: 13007 - protein, 912 aa, Hordeum vulgare
SVEPRQPFGRLDAPATAPTARAPGSNGIRRRADSPVRGCGFPSLISPPRKGPVAEEDEEDDDEDDEGHEDWREAYGSHLQLEVEPSTRDPRDEGTADAWIERNPSLIRLTGKHPLNCEPPLARLMHHGFITPAPLHYVRNHGAVPRGDWATWTVEVTGLVRRPARLTMDELANGFPAAEVPATLVCAGNRRKEQNMVQQTVGFNWGAAGVSTSVWRGARLRDVLLRCGVMSKKGQALNVCFEGAEDLPGGGGSKYGTSMSREWAMDPSRDIILPYAQNGEPLLPDHGYPVRVLIPGCIGGRMVKWVRRIVVTTAESDNYYHFKDNRVLPSHVDAELANAEAWWYRPEYIINELNTNSVITTPGHDEILPINAFTTQRAYTIKGYAYSGGGKKITRVEVTLDGGESWMLCTLDIPEKPNKYGRYWCWCFWSVEIEVLDLLGAKEVAVRAWDQTHNTQPEKLIWNLMGMMNNCWFKIKVNVCRPHKGEIGLVFEHPTQPGNQTGGWMARQKHLETAEAAAPGLKRSTSTPFMNTAGDKQFTMSEVRKHGSKESAWIVVHGHVYDCTAFLKDHPGGADSILINAGSDCTEEFDAIHSDKAKALLDTYRIGELITTGTGYNSDNSVHGGSSLSHLAPIREATKVAGAPIALSSPREKVPCRLVDKKELSHDVRLFRFALPSSDQVLGLPVGKHIFVCATIDGKLCMRAYTPTSMVDEIGQFELLVKVYFRDEHPKFPNGGLMTQYLESLQVGSSSIDVKGPLGHVEYTGRGNFVINGKQRRARRLAMICGSSGITPMYQVIQAVLRDQPEDETEMHLVYANRSEDDILLRDELDRWATEYPDRLKVWYVIDQVKRPEDGWKFSVGFVTEDILRAHVPEGGDDTLALACGPPPMIKFAISPNLEKMKYDMANSFISF

SEQ ID NO: 13008 - protein, 249 aa, Listeria monocytogenes
MAEVHFVGAGPGDKELITLKGYQLLKKADVVIYAGSLVNPELLEYCKASCEIHNSASMNLIEIIDCMEAGVTAGKEVVRLQTGDFSIYGSIREQVEEMKKRSIPFTCTPGVSSFLGAASSFGVEYTVPEVSQSVIITRMAGRTPVPSRESLRSYAAHQTSMVIFLSVQGIRKVVSELIKGGYKPETPAAVIYKATWAEEKKVTGTLEDIAEKVTEAGITKTALIMVGDFLGEEFYYSKLYDKDFKHEYR

SEQ ID NO: 13009 - protein, 421 aa, Methanosarcina acetivorans
MRSHLVKPGSVYDGIEPGELGESTESVQDRVRQLESRNSFLEEQCSQIESEKRYLENQKIKYEREIRKLQSELDRMKTSPLIIGTVIDVIKNDRIIVRSSNGPQFLVNVSQYIDEKKLLPGAKVALNQHTLAIAEVIPSTEEPFVAAMEVIESIEVDYDQIGGLDEQIQELQEAVELPLIEPERFARIGIEPPKGVLLYGLPGTGKTLLAKAVAHRTNATFIRVVGSELVQKYIGDGSKLVREIFEMARKKAPSIIFIDELDSIAARRLNETTGADREVQRTLMQLLAEMDGFDKRKNIRIIAATNRPDVLDPAILRPGRFDRLVHVPMPGIEARGKILKIHCGKMTLAGDIDFKKLAKVTEGMSGADLKAIATEAGMFAVRKDKALVEMEDFLEAVEKVSMAADTQKMMPGNLPETTMFV

SEQ ID NO: 13010 - protein, 711 aa, Brassica napus
GGVGGSGSGGGDGGGGSGSQHHDGSETDKKKKRYHRHTAQQIQRLESSFKECPHPDDKQRNQLSRELGLAPRQIKFWFQNRRTQLKAQHERADNNALKAENDKIRCENIAIREAIKHAICPNCGSPPVNEDPYFDEHKLRIENAHLRDDLERMSTVASKYMGRPISSHLSTLHPLHISPLDLSMTGPSLDFDLLPGSSMHSQPNNLATISDMDKPLMNDIALTAMEELLRLFNTNEPLWTRGDGGREILDLGSYENLFPRSGNRGKNHNVRTEASRSSGIVFMNAMTLVDMFMDGVKWGELFPCIVASSKTLAVVSSGMGGTHEGALHLMYEEMAVLSPLVATREFCELRYCQMIEQGSWIVVNVSYHLPQFVSQSSHSYKFPSGCLIQDMPSGYSKVTWVEHVETEEKEQTHELYREVIHKGIAFGAERWVTTLQRMCERFASLLAPSTSSRDLGGVIPSPEGKRSMMRLAHRMVSNYCLSVSRSNNTHSTVVAELNEVGVRVTAHKSPEPNGTILCAATTFWLPNSPQSVFNFLKDERTRPQWDVLSNRNAVQEVAHIANGSHPGCCISVLRASNASQSQSNNMLILQETSIDSSGALVVYSPVDLPALNIAMSGDDTSYIPLLSSGFAISPDGNHSSSTTEQGGGASTSSGFGGGGSLITVGFQIMVSNLPSAKLNMESVETVNNLIGTTVHQIKTGLNNCPSGSTTA

SEQ ID NO: 13011 - protein, 1006 aa, Unknown
  marine gamma proteobacterium HTCC2143
MRRDWETPESTSFNRLPSHTPLASWQTETGALNDEPSSSMISLDGDWQFTLYANPEAVPADWPQVDNLAQDTIPVPSNWQLQGYDRPVYTNVKYPFASNPPRVPLDNPTACYQRFFEMPSAWGDGQTRVRFDGVNSAFYLWCNNNWVGYSQDSRLAAEFDLSEFLKPGINSIAVMVIRWSDGSYLEDQDMWWLSGIYRSVSLLNKPICHISDVRITPDLDSDYLHGSLKVVVQGVHIENLGVRANLYLDGTLVASQSQGMGMPPVDERGGYRDRCQMTLHVEQPKKWSAETPSLYRLTVSLIDMVTDTIYEIEGYDVGFRKVELLNGQLCLNGQPLLIRGVNKHEHDPQTGHAESLAGVEHDLRLMKQNNFNAVRCSHYPHQPGFYKLCDRLGLYVVDEANIETHGMQPMRYLADDPAWSHAFLERITRMVARDFNHSCIIIWSLGNESGYGAAHDAMYQWTKRYDPSRPVQYEGGGSDTAATDIICPMYPRTHQDLDQIFGDRPKWSLVNWVERTDETRPIICCEYAHAMGNSLGNFNDYWTVFRDYPRLQGGFIWDWVDQGLEQKTDSGEKYWAYGGDFGDTINDRQFCINGLMFPDRTAHPSLYEAKRSQQPFRFSFDASASLTLKVCSEFLFRSTDNEVIHWSILCGDKQLISGSCDLVLDAGCSAEIVLCEDANSVEMSGDTWLNVWITMPRATSWSETEHEVARTQFSLSVNTLELPVCVPIAIIDPMTISAGISEWVFDPQSGFITSWQKNGVEMLRLPLTDNFFRAPLDNDIGVSEANHPDPNSWVERWQAAGLNDLEHRCNAREMDSERGMVVVYHSYYVDDQEVISSRWSHRFDAAGRMTVKIDVTLKAELPPLPRIGATCCLATAIEEVSWLGRGPHENYPDRKHSADFGLWTEAVDNMHTPYVFPSDNGLRCDTSELTLGNINVKGAFHFSVSRYGQQQLAAAKHNHELIAEPGLYVYLDALHMGVGGDDSWSPSVKPAYLLSDSQYCWEFILG

SEQ ID NO: 13012 - protein, 406 aa, Mycoplasma pneumoniae
MEPKIRRILNKELQRQRDCICLIASENYVSRDILEVTGSILTNKYAEGYPTRRFYEGCEVVDESESLAINTCKELFGAKWANVQPHSGSSANYAVYLALLKPGDAILGLDLNCGGHLTHGNKFNFSGKQYQPYSYTINPETEMLDYDEVLRVAREVKPKLIICGFSNYSRTVDFERFSAIAKEVGAYLLADIAHIAGLVAAGLHPNPLPYTDVVTSTTHKTLRGPRGGLIMSNNEAIIRKLDSGVFPGCQGGPLQHVIAAKYVCFKEALQPKYKQYIQNVKTNAASMASWFKQQGYRVISNGTDTHLFSLDVGKGKDVSQWLQQANIVLNMNTVPFDKNPAINPSGIRIGTPAMTTRGFKEKHFLYVAALIDKIIKSDGNKKVIKEVKKAVLKLLERFPLYKGLEY

SEQ ID NO: 13013 - protein, 521 aa, Unknown
  Candidatus Desulfococcus oleovorans Hxd3
MPVMKCGPLRPIQRVMLIFPPFFDVKHVFDPMVCPPLGIASLAAYIRDRVDVAILDCVAEAPGQREPEGDLYERVGLSWDQILDCIRAFAPDMVGISCLFSNQFACVRVLSEKIKREIDPDMVVVAGGTHPSFLAEQTLLKTAVDYVVLGEGELGLAGILDAHNRGERVEEIDGIAFRGENGAIRVNQRTTWIENLDDLPLPARDLLPMEAYFKAGKPMAYHWRKRRNTPIVSSRGCPFGCPFCSSYLHWGKRFRTRSAENVLAEIAHLKSRYDIQELKWQDDNLTADRKRAMAIFRGMVDRGLTMPWNTPNGIALWTIDDELMGLMKQSGCYQITLAVESGDPDTFAAYVKKPFSLDRAREVARLAKKHGISTVAYFIIGFPGETLEQVQRSMRFGLDLGVDYLVPFVFNPLPGSDLWRTCVESGRITEDYAYEKGNHYHQARLNVAAFDARELELIQRRTYLRNLLRMPLRNPKEFAAWYGRQLFFQPDFLALFAANIMDTGKLLFQKAMGRPAGTSSS

SEQ ID NO: 13014 - protein, 588 aa, Cryptococcus neoformans
MAATLRQRTAMSETPDQLATRVQNLSTAPTTTQRTGSGSAVLENGTNIGSAAGRKASIPAQVDPERIISTSGSGRTSRRGSGLVMTPGGVQTVYHTRTNEDIEFPHAGKTDVPPPRLDCKPEILAVTPQRMRMIVHAIEETLDNGLQKNGQVVPMITFPVPTYVFGWPTGNEVGDFLALDLGGTNLRVCLVTLLGSGKFEVTQTKYRLTEEQKQGEGQALCVPCHFIHCIPNTKNSLDFCAECLNSFIRDTLGRTEKDGILPLGFTFSYPCSQDRIDHGVLIRWTKGFGAPNIEGYDVAAMFKDSLKRMDVPAELTALINDTTGTLIASNYVDPHTKIAVIFGTGCNAAYMETAGSIPKIDYVGLPEEQGMAINCEWGAFDSFDHQHLPRTKYDIIIDESSNKPGEQSFEKMIAGLYLGEIFRLVLCELIDSGDLFLGQNTYKLEKAYAFDTAFLSLMEADVTEELLTIIGVFAHFFGLETTLEERQFFKKLAVLVGTRSARLSACGIAAIVSKKGYLEEGCAVGADGSLYNKYPNFADRVHEALTDIFGESGKKIVTHHAEDGSGVGSAIIAAMTKARKDSGFFVEY

SEQ ID NO: 13015 - protein, 491 aa, Oryza sativa
METSYREEEARRKASLLHCIFFFLLGALAMAAAIAVLHESSYWEWRCNRLTDIVVDGDDGDGPSSSEVVDGGGEWGMVRTRGAQFVVGGGRPFYVNGFNTYWLMVLAVDPSTRGKVTEVFRQAAAVGLTVCRTWAFNDGGWRALQKSPGVYDEEVFKALDFVVSEARKHKIRLILPLINNWDDYGGKAQYVRWAQAAAAGAGADAFFSDETVRGYFKSHVTAVLTRVNAYTGVAYRDDPTIMAWELMNEPRCASDPTGDTLQAWIAEMAFHVKSVDPAHLLGVGAEGFYGPSSPPARLRVNPNADVALAGADFVRNHRVLGVDFASVHVYPDTWLPAGATKEAQLRFATSWVEAHIADAEGALGGMPVLFAEFGVSTRGARAAFNATSRDAFIEAVYGAMLRSTRRGGGGAGALLWQVFPEGTDYMDDGYAVVLPRAAATAGIVAAHSRRLQSFNSRCAWSCRWGCNKRDNDTAETTTAEADVDVSFHHEL

SEQ ID NO: 13016 - protein, 167 aa, Streptococcus pyogenes
MPNLYDFTVKAQNGNDLSLAAYKEKVVLIVNTATKCGLTPQYQALQALYDTYHDKGFEVLDFPCNQFLNQAPGDAEEINHFCSLTYHTTFPRFAKIKVNGKDADPLFTWLKEEKSGPLGKRIEWNFTKFLIDQNGQVIKRYSSKTDPKLIEEDLKALLDKIQCYHHL

SEQ ID NO: 13017 - protein, 328 aa, Unknown
  Synechococcus sp. CC9605
MCSSSMTTAKKRRVLITGASSGIGLEAAKILLARGDAITVVCRNAERAERTRKALSDSVETCIADLADLASVARAIEELCCDGTPFDALVLNAGLQYAGHDSPRWSAQGIELTFAVNHLAHQLLAEELKEQTRALVITASEVHNPTTGGGRVGKPAGLGMLKGLRQGPGAPMVDGESPFNADKAYKDSKLCNLLMALQIHRQRPELPVVAWSPGLVIPRMTGGFFRNSRQANPLGQALFGLIARDLLRLTENVERAGELLVQLIDEQLHQPGFSYWSNALLGPGRHQFKPTEPSEEATDSDKSTMLWMLSNDLINASLGPSNHRQQGQ

SEQ ID NO: 13018 - protein, 72 aa, Bordetella pertussis
MSKDDVIQMQGEVLENLPNATFRVKLENGHVVLGHISGKMRMHYIRILPGDKVTVELTPYDLTRARIVFRSK

SEQ ID NO: 13019 - protein, 904 aa, Nicotiana tabacum
MAASVENRQFSHLEAGLSRSFKPRSDSPVRGCNFPSPNSTNFQKKPNSTIYLDYSSSEDDDDDDEKNEYLQMIKKGNSELEPSVHDTRDEGTADNWIERNFSMIRLTGKHPFNSEPPLNRLMHHGFITPVPLHYVRNHGPVPKGTWDDWTVEVTGLVKRPMKFTMDQLVNEFPCRELPVTLVCAGNRRKEQNMVKQTIGFNWGAAAVSTTIWRGVPLRALLKRCGVFSKNKGALNVCFEGADVLPGGGGSKYGTSIKKEFAMDPARDIIVAYMQNGEKLAPDHGFPVRMIIPGFIGGRMVKWIKRIIVTTQESDSYYHFKDNRVLPPHVDAELANTEAWWYKPEYIINELNINSVITTPCHEEILPINAWTTQRPYTLRGYSYSGGGKKVTRVEVTLDGGETWQVSTLDHPEKPTKYGKYWCWCFWSLEVEVLDLLSAKEIAVRAWDETLNTQPEKLIWNVMGMMNNCWFRVKMNVCKPHKGEIGIVFEHPTQPGNQSGGWMAKERHLEISAEAPQTLKKSISTPFMNTASKMYSMSEVRKHSSADSAWIIVHGHIYDATRFLKDHPGGTDSILINAGTDCTEEFDAIHSDKAKKLLEDFRIGELITTGYTSDSPGNSVHGSSSFSSFLAPIKELVPAQRSVALIPREKIPCKLIDKQSISHDVRKFRFALPSEDQVLGLPVGKHIFLCAVIDDKLCMRAYTPTSTIDEVGYFELVVKIYFKGIHPKFPNGGQMSQYLDSMPLGSFLDVKGPLGHIEYQGKGNFLVHGKQKFAKKLAMIAGGTGITPVYQVMQAILKDPEDDTEMYVVYANRTEDDILLKEELDSWAEKIPERVKVWYVVQDSIKEGWKYSIGFITEAILREHIPEPSHTTLALACGPPPMIQFAVNPNLEKMGYDIKDSLLVF

SEQ ID NO: 13020 - protein, 891 aa, Hordeum vulgare
MAASVEYNRQVSAHPWPTNAQPKAAFDLFSSSGGGRRRSGADSDSDDEDSVPPDWRSLYSPRLDVEPSVKDPRDEATSDAWVKRHPALVRLTGKHPFNSEPPLPRLMSHGFITPVPLHYVRNHGAVPKADWSTWTVEVTGLVKRPVKFTMEELVTGFQAVEFPVTLVCAGNRRKEQNMVRQSSGFNWGPGAISTTVWRGVRLRDVLRRCGVMGAGAASNVCFEGAEDLPGGGGCKYGTSLRRSVAMDPARDVILAYMQNGEPLAPDHGFPVRVIVPGFIGGRMVKWLKRIVVACNESESYYHYRDNRVLPSHVDAELANAEAWWYKPECMINELNINSVITTPGHDEVLPINALTTQKPYTMKGYAYSGGGRKVTRVEVTLDGGETWQVCDLEHPERPTKYGKYWCWCFWSVEVEVLELLGAKEMAVRAWDEALNTQPERLIWNLMGMMNNCWFRVKINVCRPHKGEIGLVFDHPTQPGNQSGGWMARQKHIETSETTQGTLKRSTSTPFMSTASAQFTMSEVRRHASKDSAWIVVHGHVYDCTAFLKDHPGGADSILINAGSDCTEEFDAIHSAKARGLLEMYRVGELIVTGNDYSPQSSNADLAAIVEAPAVVVPRLPASAVALANPREKVRCRLVDKKSMSHNVRLFRFALPSPDQKLGLPVGKHVYVCASTGGKLCMRAYTPTSSVEEVGHVELLIKIYFKDEDPKFPAGGLMSQYLDALPLGAPVDIKGPVGHIEYAGRGAFTVGGERRFARRLAMVAGGTGITPVYQVIQAVLRDQPDDTTEMHLVYANRTEDDMLLREEIDRWAAANPARLKVWYVVSKVGRPEDAWEYGVGRVDEQVLREHLPLGGDGETLALVCGPPAMLECTVRPGLEKMGYDLDKDCLVF

SEQ ID NO: 13021 - protein, 231 aa, Lemna paucicostata
VSMRKTAAKPKPAASGSPWYGPDRVKYLGPFSGEAPSYLTGEFAGDYGWDTAGLSADPETFAKNRELEVIHARWAMLGALGCVFPELLARNGVKFGEAVWFKAGSQIFSEGGLDYLGNPSLVHAQSILAIWATQVILMGAVEGYRVAGGPLGEVVDPLYPGGSFDPLGLADDPEAFAELKVKEIKNGRLAMFSMFGFFVQAIVTGKGPLENLADHLADPVNNNAWAFATNF

SEQ ID NO: 13022 - protein, 898 aa, Betula pendula
MAASVENRRFTHHEPAVNGLVRTFKPVPNSHRSDSPDLGRQIPSSPKKQVATGEDSSSEDENENDYKELIQKGNGELEPSILDPRDEATADNWVERNATMVRLTGKHPFNSEAPLTRLMHHGFITPAPLHYVRNHGPVPKARWEDWSVEVCGLVKRPARFTMDRLVTEFRSREFPVTLVCAGNRRKEQNMVKKTIGFNWGAAGVSTSVWRGVPLRDVLKRCGIFSRGRGAFNVCFEGAEDLPGGGGSKYGTSVKYEMAMDPARDIILGYMQNGERLSPDHGFPVRMIIPGFIGGRMVKWLKRIIVTTKESDNYYHYNDNRVLPSHVDADVAKAEAWWYKPEHIINELNINSVITTPCHEEILPINSWTTQRPYTLRGYAYSGGGRKVTRVEITMNGGEKWRVCALDHPEKPNKYGKYWCWCFWSLEVEVLDLLGAKEIAVRAWDEAHNTQPEKLIWNVMGMMNNCWFRVKTNVCKAHMGEIGIAFEHPTVPGNESGGWMAREKNLETSSDANQSLKKSVSSPFMNTSSKMFSMSEVKKHNSAESAWIIVHGHIYDCTHFLKDHPGGADSILINAGTDCTEEFDAIHSDKAKKMLEDYRIGELITTGYVSDSPNSTVHGASNTSHLAPIKEIAPLRNVALIPGAKIPTKLVYKKSLSHDVRLFRLALPSDDQVLGLPVGKHVFLCATIDDKLCMRAYTPTSTIDEVGYLDLVVKIYFKNSNPRFPNGGLMSQHLDSLPIGSVLHVKGPLGHVEYTGRGNFLVHGEPKFAKRLAMVAGGTGITPIYQVIQAILKDPEDETEMFVVYANRTEDDILLREELDDWAKKHEKLKVWYVVKESKREGWEYSVGYIRESILREHIPEGSDDVLALACGAPSMIEEAVRLNLEKMNYDTKNSLIIF

SEQ ID NO: 13023 - protein, 918 aa, Cucurbita maxima
MAASVDNRQYGPLQPPLSGVVRSFKNGPNHRADSPVRGCNFPNSNVDYNNNRPLKSSVKIQEAAAEEMEDSCSEDENENEFRDLIVKGNRELEPSILDHRDEGTADNWIERNASMVRLTGKHPFNSEPPLNRLMHHGFITPVPLHYVRNHGVVPKAKWADWTVEVCGLVKRPAKFTMDQLLNEFRFREFPATLVCAGNRRKEQNMVKQSIGFNWGAAGVSTSVWRRVPLCDLLKRCGILSRKKGALNVCFEGAEDLPGGGGSKYGTSIKKELAMDPARDIILAYMQNGEQLAPDHGFPVRMIIPGFIGGRMVKWLKRIIVTTKESENYYHFKDNRVLPSHVDADVANAEAWWYKPEHIINELNINSVITTPCHEEILPINAWTTQRPYTLRGYSYSGGGKKVTRVEVTMDSGETWQVCTLDHPEKANKYGKYWCWCFWSLEVEVLDLLSAKEIAVRAWDETHNTQPEKLIWNLMGMMNNCWFRVKTNMCKPHKGEIGIVFEHPTQPGNQSGGWMDRERHLEISTESNQTLKKSVSTPFMNTASNTYTLSEVKKHNSPQSAWIIVHGHVYDCTRFLKDHPGGSDSILINAGTDCTEEFDAIHSDKAKKMLEDYRIGELITTGYASDSSSNSPNNSTHGASNFSHLAPIREAPVSRRVALAPNEKIPCKLISKTSISHDVRVFRFALPGGQDQALGLPVGKHIFICATVDGKLCMRAYTPTSSIDEMGFFELVVKVYFKGVHPKFPNGGIMSQYLDSMEVGSTLDVKGPLGHIEYTGRGNFMVHGKPRFARRLAMLAGGTGITPIYQVVQAILKDPEDETEMYVVYANRTEDDILLRDELDTWAKKNQRLKVWYVVQESIREGWEYSVGFITENILREHIPAAAEDTLALACGPPAMIQFAVQPNLEKMNYDTKNSLLVF

SEQ ID NO: 13024 - protein, 911 aa, Solanum lycopersicum
MAASVENRQYTHLEPGLSGVGRTFKPRPDSPVRGCNFPPSSNHELPFQKKQNPPIYLDYSSSEDEDDDDEKNEYVQMIKKGKTELEPSIHDTRDEGTADNWIERNFSLIRLTGKHPFNSEPPLSRLMHHGFITPVPLHYVRNHGPVPKASWSDWTVEVTGLVKRPMKFTMDQLVNEFPSREFPVTLVCAGNRRKEQNMVKQTIGFNWGAAAVSTTVWRGVPLRALLKRCGVQSKKKGALNVCFEGSDVLPGGGGSKYGTSIKKEFAMDPSRDIIVAYMQNGEMLSPDHGFPVRMIIPGFIGGRMVKWLKRIVVTTQESESYYHYKDNRVLPPHVDAELANAEAWWYKPEYIINELNINSVITTPCHEEILPINAWTTQRPYTLRGYAYSGGGKKVTRVEVTLDGGETWSVCTLDHPEKPTKYGKYWCWCFWSLEVEVLDLLSAKEIAVRATDETLNTQPEKLIWNVMGMMNNCWFRVKMNVCKPHKGEIGIVFEHPTQPGNQSGGWMAKERHLEISAVAPPTLKKSISTPFMNTASKMYSMSEVRKHNSSDSAWIIVHGHIYDASRFLKDHPGGVDSILINAGTDCTEEFDAIHSDKAKKLLEDFRIGELITTGYTSDSSPNSSVHGSSSISSFLAPIKELVQTPTRSVALIPREKIPCKLVDKQSISHDVRKFKFALPSEDQVLGLPVGKHIFLCATVDDKLCMRAYTPTSTVDEVGFFELVVKIYFKGVHPKFPNGGQMSQHLDSLPIGAFLDVKGPLGHIEYQGKGNFLVHGKQKFAKKLAMIAGGTGITPVYQVMQSILKDPEDDTEMYVVYANRTEDDILLKDELDAWAEQVPNRVKVWYVVQESITQGWKYSTGFVTESILREHIPEPSHTTLALACGPPPMIQFAINPNLEKMGYDIKEELLVF

SEQ ID NO: 13025 - protein, 394 aa, Unknown
  delta proteobacterium MLMS-1
MKACEIKPDIFWVGAVDWNNRDFHGYSINRGTTYNAYLLRDDKTVLFDTVRSGFKSDLLHHLHQVSKPEEIDYLVVNHVEMDHSGCLPEIIELIKPEKIFCSPMGQKALLEHFHRPDWPLEVVKSGDEISLGKRSIQFIETRMLHWPDSMFSYIPQEKLLISSDAFGQHWATSERFADEVDQGELLAHAAKYYANILLPYSPLVQKLLAQVQAEGPEIEMIAPDHGLIWRGNPATIINAYDRWSRQQSRHKAVIIYDTMWQSTEKMARALMSCLQQEGINEIRLLHARKNHRSDIMTEVLDARALLIGSPTLNNHLMPAMADVLTYMKGLRPKEKVGAAFGSYGWSGEAVKQLTAYLEEMGVAPVAEGVRIKNVPNHDSLQACVELGKAVARAM

SEQ ID NO: 13026 - protein, 1116 aa, Schizosaccharomyces pombe
MAADIGSQSSGSLEERFEQSLHLQNVDKQDWSLNSVLQFLKLYKFNKEWEDVFIKSRIEMDLFINLADQSKAEEFAFKNKLSKESAIQLSSCIRKTLLAPSSTRVPSKNSSYETLTYSAKDSSDDVFTETNSGFRSSNQNSSLKSFQSVPDSNVNVFGGFGGSVVDNNELLSTGKNSHQTTSLNLEGSPINLHAYKGTVTSIINDDSRNINKKTLSKQPVSEHKEKQTSFLRRFRVPGFSRDKDKTKDCPSSNSNPFHLASSNVKTLDASLDQGEWVPRIHRLESQIGLISKKKSFVLATMDDMKFTVVDITNVQNATQLRKLIAKSMYLDISIDQFDLFLTEVGGAQYIEILDDRKLDIARLYSDEFGTIKFFVKPSQNEESGMDSDTYLSFGTKSSSTYKADDDSIYHRKEDFKKQPSYPVLTSDFEITDAGPNLSLSGHQPDNKYYKGFSSAPNLAVVPELPSRRFRGFEKIRGAKGEMATKILDATEAQSEKNKFTVCRPHKKVTLKMPLNSGSSAPQSPSSNTSASVLTRNFVAHRDPPPPPTETSSLRRKNTLTRRPSIRHARSSPYIDTGHNEASKFSHTSFDPKASSKSSNSLKESVEALSEIPFEDAPALDESDLSGDPFWAIQPKQSSSQVPKENHHNIQSKLSINTEAATDLKANELSSPKTPEYCRGDDRSISLSPLSYRLRKSKHIRESPPSSKVINSGNWEVRPSADDLYEDVDRFFPRYDLDKVLVVDQSRMVSSPSKVSIRPKMKSVRLLAREASEARKEIRHNARRNKSGNLLRRSSTKLWGSRIVELKPDTTITSGSVVSQNATFKWMKGELIGNGTYGKVFLAMNINTGELIAVKQVEIPQTINGRHDQLRKDIVDSINAEISMIADLDHLNIVQYLGFEKTETDISIFLEYVSGGSIGRCLRNYGPFEEQLVRFVSRQVLYGLSYLHSKGIIHRDLKADNLLIDFDGVCKISDFGISKHSDNVYDNDANLSMQGSIFWMAPEVIHNDHQGYSAKVDVWSLGCVVLEMLAGRRPWSTDEAIQAMFKLGTEKKAPPIPSELVSQVSPEAIQFLNACFTVNADVRPTAEELLNHPFMKCDEEFNFKDTNLYDMLCKRKS

SEQ ID NO: 13027 - protein, 926 aa, Spinacia oleracea
MAASVDRQYHPAPMSGVVRTPFSNHHRSDSPVRNGYTFSNPPSSNGVVKPGEKIKLVDNNSNSNNGSNNNNNRYDSDSEEDDDENEMNVWNEMIKKGNSELEPSSVDSRDEGTADQWIERNPSMIRLTGKHPFNSEPPLTRLMHHGFLTPVPLHYVRNHGPVPNAKWEDWTVEVTGLVKRPIRFTMDQLVNDFQSREFPVTLVCAGNRRKEQNMTKQSIGFNWGSAAVSTSVWRGVPLRDVLKRCGVMSSLKGALNVCFEGAEDLPGGGGSKYGTSVKREFAMDPARDIILAYMQNGEKLSPDHGYPVRMIIPGFIGGRMVKWLKRIIVTTTESDNYYHYKDNRVLPSHVDAELANSEAWWYKQEYIINELNVNSVITSPCHEEILPINAWTTQRPYTMRGYAYSGGGRKVTRVEVTMDGGDTWDICELDHQERGSKYGKFWCWCFWSLEVEVLDLLGAKEIGVRAWDESLNTQPEKLIWNVMGMMNNCWFRVKTNVCKPHKGEIGIVFEHPTQPGNKSGGWMARERHLEISDSGPTLKRTASTPFMNTTSKMYSMSEVKKHNTADSAWIVVHGNVYNATRFLKDHPGGSDSILINAGTDCTEEFDAIHSDKAKRLLEDFRIGELISTGYTSDSSSPGNSVHGGSVYSGLAGLAPITEAVPLRNVALNPRVKIPCKLIEKVSLSHDVRRFRFGLPSEDQVLGLPVGKHIFLCANVDDKLCMRAYTPSSTIDVVGYFDLVVKVYFKDVHPRFPNGGVMSQHLDSLSLGSIVDVKGPLGHIEYLGKGNFTVHGKPKFAKKLAMISGGTGITPIYQVMQAILKDPEDKTEMHVVYANRTEEDILLREELDKWADEFRDRVKVWYVVEKAEEGWKYDTGFISEKILRDHVPAVGDDVLALTCGPPPMIQFAVQPNLDKMGFDIKEQLLIF

SEQ ID NO: 13028 - protein, 202 aa, Triphysaria versicolor
GVHFGHGTRKWNPKMAPYISAKRKGIHITNLTRTARFLSEACDLVFDAASSGKQFLIVGTKNKAADLVAWAAIKARCHCVNKKWLGGILTNWSTTETRLQKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 13029 - protein, 309 aa, Listeria monocytogenes
MGKALLIVNPSSGKEKGKTYQGKTEEVLKKRYDEVEVRLTEKAGDATEFASWAAEQGFEAVIAMGGDGTLNETINGLAIHEKRPDFGFIPLGTVNDLARSVGIPLKPEKAIQALEKAIAVPMDIGRIGDQYFMNVLAIGMIAQAVDQVSVEQKTKFGSVAYFLEGLKAFNRNELLHFKIEYDEEVWEGEAALVVAGLTNSVGGMESWAPDAKIDDGYLHIIILTKLGLLDAANMIPQLIRGNLKNSDGVVYIKTKKLTIDASGDDLSINVDGDPGPGVPAEIEVLGSHLNILAPKKSSKKRFGPFILKK

SEQ ID NO: 13030 - protein, 158 aa, Prochlorococcus marinus
MSVNISKVEVFSFKNQKITFDHYKGNVLLIVNVASKCGFTKQYKALQYLQDKYESKGFKVLGFPCNDFGNQEPGQLEEIKEFCSTTYGVTFQLFQKVHAKGKTTEPFTTLNQLSPSGDVEWNFEKFLINTEGDAVLRFKSSIEPDSPEITQAIEKLLD

SEQ ID NO: 13031 - protein, 202 aa, Lamourouxia viscosa
GVHFGHGTRKWNPKMAPYISAKRKGIHITNLTRTARFLSEACNLVFDAASSGKQFLIVGTKNKAADLVAWAAIRARCHCVNKKWLGGMLTNWSTTETRLQKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 13032 - protein, 361 aa, Desulfotalea psychrophila
MKKIAISTGGGDAPGLNAVIYAVVHACYRKGWEVYGSRNGYAGFLDLEEMIQLRPRDVEGIYAIGGTIIGSTNKGNPFANPVKNLAGETQVIDISDKILRNFKRMNFDCHIAIGGDGSMEIAHQFAEKGMPVIGVPKTIDNDLEETDRTFGFDTAVSTATEALDKLHSTAKSHDRVMVVEVMGRDSGWIALYSGISGGADIILIPEVPFDMDKVCEKITDNDLRGKDYSIVVVAEGAQALNGQRFIKGGLEPGRQEVILGGVGEWVATEIQRRTDKDTRSLVLGHLQRGGSPTTFDRLLALRFGAAAVRLVEQETFDHMVALKNSEMKAVPIADAIRARKKVDLTSDKVQTARDIGICLGD

SEQ ID NO: 13033 - protein, 202 aa, Macranthera flammea
GVHFGHGTRKWNPKMAPYISAKRKGIHITNLTRTARFLSEACDLVFDAASSGKQFLIVGTKNKAADLVAWAAIKARCHCVNKKWLGGMLTNWSTTETRLQKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 13034 - protein, 548 aa, Triticum aestivum
MGNQNGTPGNDYYNRFPREHPASRYADGIEDDSYSDLKKSDKPWPDADSFRPTAAGILRQGLDPTSISVLGRQTADLREHYILGRKLGQGQFGTTYLCTEISTGCDFACKTILKRKLITKVDVEDVRREIQTMHHLSGHKNVVSIKDVYEDVQAVHIVMELLPGGELFDRIQGNGRYSEMKAAEITRIVVSIVAMCHSLGVMHRDLKPENFLLLDKDDDLSIKAIDFGLSIYFKPGQVFSELVGSPFYVAPEVLHKRYGPESDVWSAGVILYVLLSGVPPFWADTQKGIFDAVLKGHLDLESDPWPKISDSVKDLIRKMLCNCPSERLKAHVVLRHPWICQNGMATDGVLDPSVISRLKRFSAMNNLQKLALRVIAERLSEEEIAGLRELFKTVDIKNRGVITFGELRKGLTRYGNELVDTEICDIMEAADTDTDVTINYEEFIAATMPLNKIEREEHLKAAFTYFDKDGSGYITVDKLQRACAEYNMEGTLLEEIILEADRNNDGQIDYAEFVAMMLGNANGGNIGLGRPTMETSLNVTLRDAPQVH

SEQ ID NO: 13035 - protein, 561 aa, Kineococcus radiotolerans
MNAGPVDPTTTAAWSSLSEHRSATTPDLRGWFAADPARARDLTLDVADLHVDLSKNLVTADTVALLLQLAEQTGVLARRDAMLAGEHVNVTEDRAVLHTALRRPAGASPALEVDGQDVDGDVQAELAKVFTFADAVRSGEWRGVTGKAITTVVNIGIGGSDLGPVMAYEALKPSVRAGLECRFVSNIDPTDVAETTKDLDPETTLFIVASKTFGTLETLTNARLARAWLWRGLAAAGVLADSDEARQEAVAKHFVAVSTALDKVAAFGIDPANAFGFWDWVGGRYSVDSAIGTSLAVAIGPEAFREFLAGFHAVDEHFRTTAPERNVPLLMGLLNVWYVNFLDAHTHAVLPYSQYLHRFPAYLQQLTMESNGKSVRYDGEPVTTHTGEVFWGEPGTNGQHAFYQLIHQGTRIVPSDFIAFATPAHPLVDGDADVHALFMANFFAQTKALAFGKTAEEVRAEGTAEDVVAARVFSGNRPTTSIMAPSLTPAVLGQLIALYEHVTFVEGAVWGIDSFDQWGVELGKKLALEIAPALTGDTAALEAQDPSTGALIRYYLEHRRD

SEQ ID NO: 13036 - protein, 390 aa, Yersinia enterocolitica
MSKQQIGVVGMAVMGRNLALNIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEAGKYLVDVILDEAANKGTGKWTSQSSLDLGEPLTLITESVFARYLSSLKDQRVAASKVLTGPTVKPFEGDKAEFIEKIRRALYLGKIVSYAQGFSQLKAASEENNWDLHYGEIAKIFRAGCIIRAQFLQKITDAYAENADIANLLV

SEQ ID NO: 13037 - protein, 209 aa, Haemophilus influenzae
MGKKKRSASSSRWLNEHFSDQFVQKAHKQKLRSRAYFKIDEIQQTDKLFKQGMTVVDLGAAPGGWSQYVVSQIGGKGRVIACDILEMDPIVGVDFLQGDFRDENVLNALLERVGEAKVDVVMSDMAPNFSGMPSVDIPRAMYLVELALDMCKQVLASKGSFVVKVFQGEGFDEYLREIRSLFNVVKVRKPEASRGRSREVYIVATGYKG

SEQ ID NO: 13038 - protein, 380 aa, Cucurbita maxima
MNPEVLSTDENDKLATRKTEKEQNDAPNSKEKLKKPDKILPCPRCNSMETKFCYYNNYNVNQPRHFCKACQRYWTEGGTIRNVPVGAGRRKNKNSASHYRHITISEALRAAQIDVPIEVNHLASKGNGRVLNFSVSPPVCESMVNVSHPAERKVLNGTRNEFEGAKGPCEGGETGDDCSSASSVTMSSSMKNGARRFPQEPHMQNINGFPSQIPCLPGVPWPCSWTAPIPPPALCPPGVPLSFYPATYWSCSASGSWNIPWVTPQPCPPIPGPNSPTLGKHSRDGDELQADNSEMKDPPKQKNGSVLVPKTLRIDDPNEAAKSSIWETLGIKNDSIKAVDLSNVFQSKGDLKSNVSEVLSPVLQANPAALSRSLTFHERS

SEQ ID NO: 13039 - protein, 857 aa, Alteromonadales bacterium
MQTAQKILIIGNGMVGHHFVEKMRQSDANANITVLCGEANLAYDRVYLSSVFDGKTANDLALTTLENYQQLNINVFTNQWVEGIDRLNKVVNTQTGDQYPYDKLVLATGSFPFVPPIKGNDQPHCLVYRTLEDLEQIKASAAASESGVVIGGGLLGLEAANAIKQLGLDTHVVEFAPQLMAVQLDEQGGTLLKNKIEKLGVTVHTSKATSEIVKGENSRFRLNFSDDTYLETDLILFSAGIRPYDQLGKVADLELGERGGIVINNQCQTSDPDILAIGECALWDKKLFGLVAPGYNMARVAASQLSGGELEFLGADMSTKLKLLGVEVGSIGDAHAKTPNCKELIYQDPIRDCYKKIILNETGDKLLGAVLVGDTSDYDTLLQYMLNDMDLPEHPECLILPDSAGAPSLAGSALPDTATICSCHNVSKGDIVGAIDGGSCDLASVKSCTKAASGCGGCAALLKSVVDDELASRGVEVNNHLCEHFAYSRQELLHMVKVESIKTFDDLIAKHGSGHGCEICKPAVASILASTWNDFILEPTHVGLQDTNDTFLANMQKDGSYSVVPRIAGGEITPDKLIVIGQVAKDFNLYCKVTGGQRIDLFGARLEELPVIWERLIEAGFETGHAYGKSLRTVKSCVGSTWCRYGVQDSVGHAIDIENRYKGLRSPHKIKMAVSGCTRECAEAQSKDIGIIATENGWNLYVCGNGGMRPRHADLFATDLDTTTLIKYIDRVLMFYIKTADKLQRTSVWMENLEGGLDYLKSVVIDDSLGICQELEEQMDLVANTYACEWKKTVDNPEATKRFRQFVNSPQTDDNILFVQERNQIRPATDAEKREQQITQNRIAVTEIQEEQADVLA

SEQ ID NO: 13040 - protein, 289 aa, Alteromonadales bacterium
MTVLSYFSGVENTWLNKVINKLTNGVKFTDKKAKNGHVYIIGAGPGDAELITVKAQRLIQSADIILYDWLVSEDLLNTLPKKAQRVFVGKRAGKHSMSQANICDLLVKYAQQGLNVVRLKGGDPSIFARINEEADALTQNNISFAIVPGVTTACAASAYTGIPLTARDVARSVTFLTAQFADPKKLPNWQNYTFMQGKNNPTLVVYMGLSRLNELCKGLKSVGWPDNTSIALIENATTTNQKIIAGSINDISNNESVATLMGPTLIIIGEVVNHTMNIDPALLVQHVNA

SEQ ID NO: 13041 - protein, 539 aa, Acidobacteria bacterium
MSDSDNFSDILKQYDHARNSKGQIEGTVVSVNDEFVFVDIGYKTEGTLPVSVFTKPVNPGDKLLVSIAGRDPEGGYYLLSRTRVQIPTDWSALEKAFADEATIMGTVTGVIKGGVTVDVGVRAFMPASRTGTRDAAEMEKLVGSEIRCRITKIDVADEDVVVDRRAVLEEETRAQEGRRYEELQEGATVHGTVRSLADYGAFVDIGGVDALLHVAEISWSRVNSPADVLTVGQEVEAKVIKVDPEKRRISLSMKQLQPHPWDSVPSKYKVGDRVRGTVSRLMDFGAFVELEPGIEGMIHVSEMSWAKKVRKPSDLLKTGDSVEAVILGINPAEKRIALGLKQALGDPWKDASQKFAAGTVIEGPVTSVQKFGAFVQLTEGVEGMVHVSELSDKRVDHPQDVVKLGQRVQAMVLAIDPEKRQIKLSMKQLIPTGLDEYIAEHKLGDIVSGRVLEVNGERGRAELGQGIQAEAKFTQKAAQPAAAATAKADLSSLTSMLQNKWKSGASASSKSEDLRAGQIRSFKITRLDADAKKIEVELE

SEQ ID NO: 13042 - protein, 242 aa, Silicibacter pomeroyi
MSGFVSFVGSGPGDPELLTLKAVDRLGKADAVLFDDLSSGPILAHARPDADLVGVGKRAGRPSPKQDHVSRLLVDYAQTGAHVVRLKSGDGGLFGRLEEELVALRAAGIGYEIIPGIPSAVAAAAAAGIPLTRRLTARRVQFVTGHDISGKLPPDLNLPALADPQATTVVFMGKRTFPLLLDALEAHGLPRSTPALMAESVSTPEQRLTRATMGELAERLAEEVGTAPALILYGPLAEFSDD

SEQ ID NO: 13043 - protein, 532 aa, Prochlorococcus marinus
MAITDIFQMNNNDKWARYCDLLYSDDSLGFWLDISRMDVAINDFEDFNEIYSKAFDALESLENGSIANIDEGRQVGHYWLRNPKVAPSPEISDSITKEIQDISKFGSSILNGEITNSDGEKYTDVFWIGIGGSGLGPLLIKESFKRESIGLDLHFLDNVDPEGISHKLNSILPNLNSTLFVVVSKSGGTPEPLIGMEQAMKFVRDNNQNWSSRAIAITSKGSKLDLLAHNENWLDIFDLPDWVGGRTSITGAVGLLPAALIGADINKFLNGASQMDALTRVKDIKNNPAALLSLAWFKSGNGKGLRDMVVLPYRDRLEVFSRYLQQLVMESLGKKFDRDENQVNQGIAVYGNKGSTDQHAYVQQLRDGIDNFFVNFIEILHDPLEIVEVKNKRPGDYLSGFLQGTRSALTEGGRQNLTITFKSFDESSLGALIALFERAVSLYAELINVNAYNQPGVEAGKKAATKIIKLQKEIEELLDDGKQRTLNEINDALSSDSTESIYLILRKLSENSDHYSMIGNQSNPDKLIISKT

SEQ ID NO: 13044 - protein, 454 aa, Janthinobacterium lividum
MTAVGITEPQELKRGLKSRHIQLIALGGAIGTGLFLGIAQTIKMAGPSVLLGYGIAGVIAFLIMRQLGEMVVDEPVAGSFSYFADKYCGHLPGFLSGWNYWVLYVLVSMAELTAVGIYVQYWWPGVPTWVSALIFFCVINAISLLNVKAFGEMEFWFALVKVVAIIGMIVFGAYLLASGDAGPQASVANLWQHGGFFPNGWQGLVMAMAVIMFSFGGLELVGITAAEADDPSTTIPRATNQAIYRILIFYIGALGILLSLYPWQNVVTGGSPFVLIFHALDSNLVATALNVVVLTAALSVYNSGVYCNTRMLFGLAKQGNAPRALLHLNRRGVPLVALGVSALATGACVVVNYFMPGEAFEVLMGLVVSALIINWAMISWIHLRFRAQKKIEGKTTLFQSLGYPFTNYLCLVFLAGILVIMYLTPGLRISVYLIPVWLAALGVGYWIKQSKAKA

SEQ ID NO: 13045 - protein, 194 aa, Hyacinthus orientalis
ATSGIFFRQTSLAGIHQSEDAIRKLFRIPADAPMGKSVATAIELCKEAPVEGQTRRCVTSAEDMIDYVVSSLGAKSSLTAKSTSNSNGLGSDVLIGEVKAAGGGELGRVVSCHHTTFPYLMYRCHSVPKTVLYDVEILDPETKGRINLAAAICHFDTSVWSPRHATFQALVYERGMDACHWVFPMDMAWTAAAE

SEQ ID NO: 13046 - protein, 505 aa, Acidobacteria bacterium
MSNLNDKITKVATHVSQNEDLIFEKSSPGKKAYRLPPLDVPDVDERALLGAEYVREDLGNMPEVSEIEIIRHFTRMSTWNYAVDYGMYPLGSCTMKYNARINEVVARLDGIAGAHPYQPEKLSQGNLRIMKMLADQLVEITGMDSITLQPAAGAHGEMTGILLIRAYLESQGNPRKKILIPDSAHGTNPATAAICGYQVENLKSNSAGLTDIPSLVAQMNEDVAALMLTNPNTLGVFEQEIHKIADILHEKGGQLYMDGANMNALVGKTRPGDFGVDVMHLNLHKTFSTPHGGGGPGSGPVAIKKHLEPFLPKPVVVANSDGTLRLDYDRPKSIGRVRMYFGNFGMHVRALAYIMANGPDGLRLTTEDAVLNANYIRKKLAGIYDLPYSTPSMHEVVFSDRNQARKGIKTGDIAKRLIDYGFHPYTTSFPLIVPGALMIEPTESESKEELDQFIEAMKAVAEEAENNPEIIAGAPYNTRVSRMDETAAARKPILRWKPKAKSAAE

SEQ ID NO: 13047 - protein, 160 aa, Prochlorococcus marinus
MTLNQDAKKVLLRKIPHGLFICAVREGDEINGFTASWVTQGSFTPPLVVMAVRADGSSHGIIQRTKMFSLNVLREDQKDLAAVFFKPQKGLGGRFEACKFTYGELGMPLIEDVIGGVECEVISGVEHGDHTVFVAEVKSAVLNKDGSALNLASTGWNYGG

SEQ ID NO: 13048 - protein, 443 aa, Acidobacteria bacterium
MRYLPKSQSDRDQMLRELGCATIDDLFAPIPAEYRLTRDLAIPRQYGESEILDFFKQRASENANGYSIFIGAGAYNHYRPVVIDSLISRGEWFTAYTPYQPEISQGTLQAIFEFQSMICELTGMEVANASMYDGSTGAAEAIMMAVRLTGRHSAIIANTVHPEYREVIATYAQHQGLPISHVGYNAETGRVDIKALEAAITDQTAAVLIQSPNFFGTIEDVAAIADLVHKKGALLVVSISEALSLGLIKPPSEADIISMESQSFGVPLGYGGPYVGVIATKEKFVRQIPGRLCGQTVDRNGKRGFVLTLSTREQHIRREKATSNICTNQALIALIASIFMTVYGKQGLRELAKQNLAKTAYAVSAFEKAGAKVLFKNSPFFNEFVVQTKSDSRELNDKLISDKIIGGFPLKKFYPELGNSAVWCVTELNAKAAIDAAAKGVAQ

SEQ ID NO: 13049 - protein, 472 aa, Schizosaccharomyces pombe
MKCSNKVLTIIKLLKAPLAECDPTVYKILESEKSRQKESIALIASENFTSRAVMDALGSIMQNKYSEGYPGARYYGGNEFIDQAERLCQTRALEAFHLDGEKWGVNVQPHSGSPANLQAYQAVMKPHDRLMGLDLPHGGHLSHGFSTPQKAISAVSTYFSTMPYNVNKETGIIDYDSLEKAAIQFRPKVIVAGASAYARLVDYKRMRKITEMCNAYLLCDMAHISGLVAAGVIPSPFEYADIVTTTTHKSLRGPRGAMIFYRKGTRSHDKRGNPILYELEDKINFSVFPGHQGGPHNHTITALAVALGQAKTPEFYQYQKDVLSNAKAMANAFITRGYKLVSGGTDTHLVLVDLTDKGVDGARVERILELVNISANKNTVPGDKSALIPRGLRLGTPACTTRGFDEKDFERVVELIDEVVSLTKKINEAALKEGKSKFRDFKAYVGDGSKFSEIAKLKKEVITWAGKFDFPV

SEQ ID NO: 13050 - protein, 189 aa, Mesoplasma florum
MKLHPLVKNVLFTEEQIKERTIEVAKEIKSFYEQNDKEDQSLLVIGLLKGCIPFYQTFCMNFDFLIDMDFMVVSSYLGGTKSSGEPKINLDVNMSVKDRNILIVEDIVESGLTLEFVQNYLLNKGAKSVKILTMLDKPTERKVDIKPDWTCFSIAKHFVIGYGLDYQEKLRNLPYVAVCDTDKLADWKW

SEQ ID NO: 13051 - protein, 392 aa, Triticum aestivum
MAAPTSAIGFEGYEKRLKITFSEASIFADPHGRGLRALSRAQIDSVLDLARCTIVSELSTKDFDSYVLSESSLFIYSQKIVIKTCGTTMLLLTIPRILELAEELCMPLAAVKYSRGMFIFPGAQPAPHRSFSEEVDVLNRYFGHLKSGGNAYVIGDPAKPGQKWHIYYATEQPEQPMVTLEMCMTGLDKKKASVFFKTQADSHVSCAKEMTKLSGISDIIPEMEVCDFDFEPCGYSMNAINGSAVSTIHVTPEDGFSYASYEVMGMDASALAYGDIVKRVLRCFGPSEFSAAVTIFGGRGHAATWGKKLDAEAYDCNNVVEQELPCGGVLIYQSFTVNEEVAVSAGSPRSVFHCFEAESVHSHPLVKEGKLANLLAWRAEEDSLEEGAVLCE

SEQ ID NO: 13052 - protein, 278 aa, Zea mays
MGRQPCCEKIGIKKGPWTAEEDQKLVTFLLSHGHCCWRLVPKLAGLLRCGKSCRLRWTNYLRPDLKRGLLSEEEEALVIDLHAQLGNRWSKIAARLPGRTDNEIKNHWNTHIKKKLKKMGIDPVTHGPLAPATQPLALALAQQRDPPQVVREEERCDDDPSKQASSQGLAAGADEDDDVEETPASAAQPHGATTTSPASAAAGSVSPSCSSSASGADADADAAAWPGPIDLFLEVDGIMDMDWAGILSGCGDDDAADISGVDLFDHYAGDGFDEQVWM

SEQ ID NO: 13053 - protein, 202 aa, Harveya capensis
GVHFGHGTRKWNPKMAPYISAKRKGIHITNLTRTARFLSEACDLVFDAASGGKQFLIVGTKNKAADSVAWAAIKARCHCVNKKWLGGMLTNWSTTETRLHKFRDLRMEQKAGRLNRLTKRDAAVVKRQLSRLQTYLGGIKYMTGLPDIVIIVDQHEEYTALRECITLGIPTICLIDTNCDPDLADISIPANDDAISSIRLIL

SEQ ID NO: 13054 - protein, 458 aa, Listeria monocytogenes
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQVLKASNRKTKIRHN

SEQ ID NO: 13055 - protein, 290 aa, Zea mays
MENNAVKEKNPGEKSKSAVIGHADSYPSQFLETNLGKQQYRNGYKNQEFREKDIFNHSNSSAFSRYGNRRIESSGEIQFLPSRCIVGQEQHVHGKDPVFQPNGVLLPPNDHNTGESTRQARITLDSSMEGADIICSSSAREDAGASSSSHRKDSMSHPSYGFVPVPIPVGAMMPYHCGAILQPVYYPQGPLMHCNSSAINKATIHQTSGQSNYREDCGSGRPSHVLIEHKQRTKLTWRELTWIVLTRLQAAAKVRYHSRKKLAEQRPRVKGQFVSQKLNSATTTDAEADS

SEQ ID NO: 13056 - protein, 202 aa, Orobanche fasciculata
GVHFGHGTRKWNPKMAPYISAKRKGIHIMNLTRTARCLSEACNLVFDSAGRGKQFLIVGTKNKAADLVAGAAIKARCHCVNKKWLGGMLTNWSTTEKRLHKFRNLRMEQKKGKINLLPKRDAAVVKRQLSRLQTYLGGMKYMTGLPDIVIIVDQHEEYMALRECITLVIPTICLIDTNCDPDLADISIPANDDAISSLRLIL

SEQ ID NO: 13057 - protein, 614 aa, Clostridium cellulolyticum
  misc_feature (257)..(257): Xaa can be any naturally occurring amino acid
AGTYNYGEALQKSIMFYEFQRSGDLPADKRDNWRDDSGMKDGSDVGVDLTGGWYDAGDHVKFNLPMSYTSAMLAWSLYEDKDAYDKSGQTKYIMDGIKWANDYFIKCNPTPGVYYYQVGDGGKDHSWWGPAEVMQMERPSFKVDASKPGSAVCASTAASLASAAVVFKSSDPTYAEKCISHAKNLFDMADKAKSDAGYTAASGYYSSSSFYDDLSWAAVWLYLATNDSTYLDKAESYVPNWGKEQQTDIIAYKWGQXWDDVHYGAELLLAKLTNKQLYKDSIEMNLDFWTTGVNGTRVSYTPKGLAWLFQWGSLRHATTQAFLAGVYAEWEGCTPSKVSVYKDFLKSQIDYALGSTGRSFVVGYGVNPPQHPHHRTAHGSWTDQMTSPTYHRHTIYGALVGGPDNADGYTDEINNYVNNEIACDYNAGFTGALAKMYKHSGGDPIPNFKAIEKITNDEVIIKAGLNSTGPNYTEIKAVVYNQTGWPARVTDKISFKYFMDLSEIVAAGIDPLSLVTSSNYSEGKNTKVSGVLPWDVSNNVYYVNVDLTGENIYPGGQSACRREVQFRIAAPQGTTYWNPKNDFSYDGLPTTSTVNTVTNIPVYDNGVKVFGNEP

SEQ ID NO: 13058 - protein, 215 aa, Unknown
  Synechococcus sp. WH 5701
MGWTVDDIPSQEGRIAVVTGANIGLGLETTRALAAKGATVVMACRSRSRGEAARRQLLDEGLTGLDLLEIDLADLRSIERAIAVLSDQYGHLDLLLNNAGVMAPPRQLSPQGHELQFAVNHLGHMALTQGLLPLMASQTDPRVVTVTSGAQYFGTIRWDDLSWAQGYDRYGAYGQSKLANVMFALELHNRLQSENSSVKSLAAHPGIARTNLQPA

SEQ ID NO: 13059 - protein, 202 aa, Orobanche uniflora
GVHFGHGTRKWNPKMAPYISAKRKGIHIINLTRTARFLSEACNLVFDSAGRGKQFLIVGTKNKASDSVAGAAIKARCHCVNKKWLGGMLTNWSTTEKRLHKFRDLRMEQKTGRINLLSKKDAAVVKRELSRLQTYLGGIKYMTGLPDIVIILDQHEEYMALQECITLVIPTICLIDTNCDPDLADISIPANDDAISSLRLIL

SEQ ID NO: 13060 - protein, 324 aa, Sulfolobus solfataricus
MSLLPRTTSVKPGEKFDVIIVGLGPAAYGAALYSARYMLKTLVIGETPGGQLTEAGIVDDYLGLIEIQASDMIKVFNKHIEKYEVPVLLDIVEKIENRGDEFVVKTKRKGEFKADSVILGIGVKRRKLGVPGEQEFAGRGISYCSVCDAPLFKNRVVAVIGGGDSALEGAEILSSYSTKVYLIHRRDTFKGQQPIYVETVKKKPNVEFVLNSVVKEIKGDKVVKQVVVENLKTGEIKELNVNGVFIEIGFDPPTDFAKSNGIETDTNGYIKVDEWMRTSVPGVFAAGDCTSAWLGFRQVITAVAQGAVAATSAYRYVTEKKGKK

SEQ ID NO: 13061 - protein, 652 aa, Mycobacterium tuberculosis
MCGLLAFVAAPAGAAGPEGADAASAIARASHLMRHRGPDESGTWHAVDGASGGVVFGFNRLSIIDIAHSHQPLRWGPPEAPDRYVLVFNGEIYNYLELRDELRTQHGAVFATDGDGEAILAGYHHWGTEVLQRLRGMFAFALWDTVTRELFCARDPFGIKPLFIATGAGGTAVASEKKCLLDLVELVGFDTEIDHRALQHYTVLQYVPEPETLHRGVRRLESGCFARIRADQLAPVITRYFVPRFAASPITNDNDQARYDEITAVLEDSVAKHMRADVTVGAFLSGGIDSTAIAALAIRHNPRLITFTTGFEREGFSEIDVAVASAEAIGARHIAKVVSADEFVAALPEIVWYLDEPVADPALVPLFFVAREARKHVKVVLSGEGADELFGGYTIYREPLSLRPFDYLPKPLRRSMGKVSKPLPEGMRGKSLLHRGSLTLEERYYGNARSFSGAQLREVLPGFRPDWTHTDVTAPVYAESAGWDPVARMQHIDLFTWLRGDILVKADKITMANSLELRVPFLDPEVFAVASRLPAGAKITRTTTKYALRRALEPIVPAHVLHRPKLGFPVPIRHWLRAGELLEWAYATVGSSQAGHLVDIAAVYRMLDEHRCGSSDHSRRLWTMLIFMLWHAIFVEHSVVPQISEPQYPVQL

SEQ ID NO: 13062 - protein, 421 aa, Haemophilus influenzae
MFTRNMTIADYDPVLWQAIQDENRRQEEHIELIASENYASPRVMEAQGSQFTNKYAEGYPGKRYYGGCEYADIVEQLAIDRAKELFGADYVNVQPHSGSQANAAVYGALINAGDTILGMDLAHGGHLTHGAKVSFSGKIYNSVLYGITADGLIDYEDVRQKALECKPKLIVAGFSAYSQVVDWAKMREIADEVGAYLFVDMAHVAGLIAAGLYLNPLPHAHVVTTTTHKTLGGPRGGLILSSCGDEEIYKKLQSSVFPANQGGPLVHIIAAKAVCFKEALEPQYKEYQANVIKNAKAMVEVFKQRGYDVVSNGTENHLFLVSFIKQGLTGKAADAALGKANITVNKNAVPNDPQKPFVTSGIRVGTPSVTRRGFNENDVRELAGWMCDVLDALGKENEEQVIAETKEKVLAICKRLPVYPK

SEQ ID NO: 13063 - protein, 193 aa, Zea mays
  misc_feature (53)..(53): Xaa can be any naturally occurring amino acid
  misc_feature (124)..(124): Xaa can be any naturally occurring amino acid
  misc_feature (140)..(140): Xaa can be any naturally occurring amino acid
  misc_feature (145)..(145): Xaa can be any naturally occurring amino acid
  misc_feature (157)..(157): Xaa can be any naturally occurring amino acid
  misc_feature (162)..(162): Xaa can be any naturally occurring amino acid
SPRPLTSPLRFTRNRLQQFPYCADLAARQKDSVLPLLLAPVRLACNECLTNAXRHCTFQLRGSCHPTPVIRLLEMIPRARADRIPTAMSRACQHSPAAWTTAHTAHSLISMRCSDNNAAHASEXLRTDNCKIPVRQQIFXSIEWXITMYMRADYSEXETEGXIVPDGVNAQLLYIHNRLVEHAPEIAFLDAVA

SEQ ID NO: 13064 - protein, 960 aa, Rhodobacter sphaeroides
MKDFILPDDRDFGTPRSRATETVTLEIDGFPVTVPAGTSVMRAAAEAGISVPKLCASDTLDAFGSCRLCLVEIEGRAGTPASCTTPVAPGMKVRTQTPKLKQLRRGVMELYISDHPLDCLTCAANGDCELQDMAGAVGLRDVRYEAVENHFTPRSAAGDLNPQWMAKDESNPYFTYDPSKCIVCSRCVRACEEVQGTFALTIDGRGFDSRVSAGMASDSFLTSDCVSCGACVQACPTATLQEKSVIEIGTPERAVVTTCAYCGVGCSFKAEMRGDELVRMVPYKGGKANHGHSCVKGRFAYGYAAHKDRILKPMVRESIHDPWQEVSWDEALGFAARRLTAIQEKHGRQSVGVITSSRCTNEETYLVQKLTRAVFRNNNTDTCARVCHSPTGYGLGQTFGTSAGTQDFDSVEAADVVMVIGANPTDGHPVFASRLKKRLRKGAKLIVVDPRRIDLVKSPHIAAAHHLALRPGTNVAVVTAMAHVIVTEGLADEKFIRERCDWDEFQDFAEFAADPRHAPEAIESLTGVPAAELRAAARLYATGGNAAIYYGLGVTEHSQGSTTVIGIANLAMLTGNIGRPGVGVNPLRGQNNVQGSCDMGSFPHELPGYRHVKSDAARAVFERLWGVEIDPEPGLRIPNMLDAAVEGTFKGLYCQGEDILQSDPDTRHVAAGLAAMECVIVHDLFLNETANYAHVFLPGSSFLEKDGTFTNAERRINRVRKVMAPKNGFADWEVTQMLANALGAGWGYTHPSQIMDEIAATTPSFAGVSYERLEEAGSIQWPCNEEHPLGTPLMHVEGFVRGRGKLIRTEYVATDEKTGPRFPLLLTTGRILSQYNVGAQTRRTANSVWHPEDVLEIHPHDAEVRGVAEGDWVRLASRAGETTLRARLTDRVSPGVVYTTFHHPTTQANVITTDFSDWATNCPEYKVTAVQVAPSNGPSDWQEDYRAQANLARRILPAAE

SEQ ID NO: 13065 - protein, 320 aa, Escherichia coli
GTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 13066 - protein, 1344 aa, Cryptococcus neoformans
MKPANLVCRFIYQAPILPIMDPEEESSYDSFEFIDIANRDLQTIPIFLHLHAHDIIILNISKNPMTDIPLDFIQACTSLKELRMSNMALKRVPISIRASTTLARLDVSCNRIADLESVALHEVETLVSLKVQNNKLTSMPSYFAQMKSLKYLNISNNKFETFPSVVCEMSNLVDLDVSFNNIAELPAKMSDLKSLEKLGLYSNDISNFPESFSTLANLRILDVRRNKITDLSAVYALPNLATLQADNNNIVTLDAQLGANVRQFSVPHNSVTRFTLAPPPNMAVVTYMLTNLDLSHGKISTLADEAFSGLTNLITLNLNFNQFTKLPATLDRLTSLEVFSCTDNMLNLVPAGFGKLRRLRVINLHNNNLKSLPEDLWACGALEIFNASSNLLDSFVPPPADIESVVGRVGSGTSQTSNGRKKHSVPPIGLSIRKLFLADNRLNDDIFHWISLMPSLRIINLSFNDIYEVPPFTLCKCERLEALYLSGNKLTSLPSEDLEKLQSLKVLHLNGNKLQTLPSELGAIKTLQHLDVGSNVLKYNIANWPYDWNWNWNTSLRYLNLSGNKRLEIKPTSAHEMNHASSFRKELSDFTALTQLRVLGLMDVTLRIPSLPDESDEKRVRTSFSDINNMAYGISDMLGSIDNLAMFDLVVPHFRGKENECLFGMFGRATTTLQGGKIAKHVQEIFAETLTAHLHKLEPGEEPSEALRRTFLWGDRKAFEFFSGKLQLEKERKPSWTSFASFDSMFRGWTPGVNSVLRTGASGAVVYLVDKVLHVGSIGDTLVVLSRKGDAELLSKRHDPTDREESARIRKAEAWVSTKGFVNDDKDLDISRAFGYWHECPAVNAAPEIRTRRLQESDEFVIIGNHALWQFCSYQTAVDIARTERDDPMIAAQKLRDFAISYGAEGNVMVMVVNVSDLFLGKGGRARGPSEQTAADASTDVEGYTVAKRQVRRRYDEVGDRTLNRLQQEIEPPVGQVAIVFTDIVNSTHLWETNPAMPTAIKMHHNLMRRQLRLDGGYEVKTEGDSFMVSFQSVTAALLWCFNCQIGLLQQEWPRELLEAHDGKVVHDSNGTIVQRGLRVRMGVHWGAPECEKDPITRRMDYYGPMVNRAARINASADGGQLMASQDVLNEIAPLMEYLNSSDEQVLNDLQGDLKREVMELRRIGLEVRDMGDRKLKGLEVPERLHLLYPKTLAGRLEISNEIRAEVEVNDARKSAERQRSVDIDQVCQLSDIALRLEAVCSYNPTPSSPGDTPTAGVMRLHPPASYLGPSIREDMNDEELWTIIESLVGRIENAMSTLYLKNFGEFSTVLAALESATKIDQKLIVHALALMNEAMGNAEENAI

SEQ ID NO: 13067 - protein, 133 aa, Arabidopsis thaliana; identical to SEQ ID NO: 430

SEQ ID NO: 13068 - protein, 353 aa, Haemophilus influenzae
MKLSKTFLFITALCSATPTLAIQNSTSSSGEQKMAMENTQNIREIYLAGGCFWGMEAYMERIHGVKDAISGYANGNTGKTSYHMIGLTDHAETVKVTYDANQISLDKLLKYYFKVIDPTSVNKQGNDRGRQYRTGIYYQDGADKAVIEQALAQLQTKYKKPVQVEVQPIKNYIVAEEYHQDYLKKNPNGYCHIDITKADEPVIDEKDYPKPSDAELKAKLTPLQYSVTQNKHTERSFSNEYWDNFQPGIYVDVTTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 13069 - protein, 395 aa, Glycine max
MISSLRQPVVGISGSDLLLRQRHATLIKARSFLPSLSREKGQRSLVSVQKPLHIAASLGVGNFVSVKSDDDKRGDLVKCEAYEADRSEVEGASTPSEAAKKVKIGIYFATWWALNVVFNIYNKKVLNAYPYPWLTSTLSLACGSLMMLISWATGIAEAPKTDPEFWKSLFPVAVAHTIGHVAATVSMSKVAVSFTHIIKSGEPAFSVLVSRFLLGESFPVPVYLSLIPIIGGCALAAVTELNFNMIGFMGAMISNLAFVFRNIFSKKGMKGKSVSGMNYYACLSILSLAILTPFAIAVEGPQMWAAGWQTAMSQIGPQFIWWLAAQSVFYHLYNQVSYMSLDQISPLTFSIGNTMKRISVIVSSIIIFHTPVQPINALGAAIAILGTFLYSQAKL

SEQ ID NO: 13070 - protein, 430 aa, Paracoccus denitrificans
MKDELTKDGKDAVGTSRRAFLRGGAVAGAGLVAGAGLARAAGTPDPLITEIQPWASEFGEAVDAHPYGLPIHFESHVKRQYVEWLTESPVSSINFTPIHALEGTITPQGCAFERHHSGAIELSKQDYRLMINGLVEKPLVFTFEDLLRFPRTTTTAFCECAANGGMEWGGAQLEGCQYTQGMIHNMEYVGVPLSVLLAEAGVKPEGKWLYAEGADASSNGRSFPMEKVMDDVMLAFFANGEALRKEHGYPARLVVPGWEGNMWVKWVRRLGIYDKAVESREETSKYTDLMPDGRARKWTWVMDAKSVITSPSPQVPIRHGKGPLVISGLAWSGNGRITRVDVSLDGGKNWTTARITGQALPKALTRFHLDIDWDGSEMLLQSRAVDETGYVQPTKDALRAIRGRNNVYHNNGIQTWWVKADGEVENVEIA

SEQ ID NO: 13071 - protein, 489 aa, Yarrowia lipolytica
MTDTSNIKPVADIALIGLAVMGQNLILNMADHGYEVVAYNRTTSKVDHFLENEAKGKSIIGAHSIKELCALLKRPRRIILLVKAGAAVDSFIEQLLPYLDKGDIIIDGGNSHFPDSNRRYEELNEKGILFVGSGVSGGEEGARYGPSIMPGGNKEAWPHIKKIFQDISAKADGEPCCDWVGDAGAGHFVKMVHNGIEYGDMQLICEAYDLMKRGAGFTNEEIGDVFAKWNNGILDSFLIEITRDIFKYDDGSGTPLVEKISDTAGQKGTGKWTAINALDLGMPVTLIGEAVFARCLSALKQERVRASKVLDGPEPVKFTGDKKEFVDQLEQALYASKIISYAQGFMLIREAAKTYGWELNNAGIALMWRGGCIIRSVFLADITKAYRQDPNLENLLFNDFFKNAISKANPSWRATVAKAVTWGVPTPAFASALAFYDGYRSAKLPANLLQAQRDYFGAHTYQLLDGDGKWIHTNWTGRGGEVSSSTYDA

SEQ ID NO: 13072 - protein, 536 aa, Streptococcus mutans
MQKHWWHKATVYQIYPKSFMDTNGDGIGDLKGITSKLDYLQKLGVMAIWLSPVYDSPMDDNGYDIANYEAITDIFGNMADMDNLLTQAKMRGIKIIMDLVVNHTSDEHAWFIEAREHPDSSERDYYIWCDQPNDLESIFGGSAWQYDDKSDQYYLHFFSKKQPDLNWENANLRQKIYDMMNFWIDKGIGGFRMDVIDMIGKIPAQHIVSNGPKLHAYLKEMNAASFGQHDLLTVGETWGATPEIAKQYSNPVNHELSMVFQFEHIGLQHKPEAPKWDYVKELNVPALKTIFNKWQTELELGQGWNSLFWNNHDLPRVLSIWGNTGKYREKSAKALAILLHLMRGTPYIYQGEEIGMTNYPFKDLNELDDIESLNYAKEAFTNGKSMETIMDSIRMIGRDNARTPMQWDASQNAGFSTADKTWLPVNPNYKDINVQAALKNSNSIFYTYQQLIQLRKENDWLVDADFELLPTADKVFAYLRKVREERYLIVVNVSDQEEVLEIDVDKQETLISNTNESAALANHKLQPWDAFCIKIN

SEQ ID NO: 13073 - protein, 459 aa, Listeria monocytogenes
MGRNLALNIESRGHTVSIFNRSTEKTKAVMEENADKKLVPTYSLEEFVESLEVPRRILIMVKAGDATDMMIEAVKPFLNEGDILIDGGNAFFKDTIRRNKELSEEGFNFIGTGVSGGEEGALKGPSIMPGGQRKAYDLVAPILREIAAVADGEPCVTYIGPDGAGHYVKMVHNGIEYGDMQLIAEAYTILKEIGGLSHDELADVFEEWNNGELDSYLIEITKNILKVKDEETGKPIVDVILDKAGQKGTGKWTSQSALDLGVPLSLITESVFARYISALKDERVYASTVLSGPSNYRFEGDKKAFVESVRRALYFSKIASYAQGFAQMRAASEENDWDLQYGEIAKIFRAGCIIRARFLQKITDAYNKDKNLKNLLLDPYFKDIAHNYQGDLRTVVAEAVKAGIPVPTFTAAISYYDSYRSEVLSANLIQAQRDYFGAHTYERVDKPGVFHTEWPQVED

SEQ ID NO: 13074 - protein, 251 aa, Burkholderia xenovorans
MGKVYLIGAGPGAADLITVRGARLLGLADVVLHDALVEPAMLDYAPSHARRIAVGKRCGQLSTAQQFINKQIVDAALEHDVVVRLKGGDPMLFGRADEEMRALEAAGIEYEVVPGITAALASAASLKRSLTLRGVSRSVALATFSRAPGSEEIREQVNADSLVFYMGRDSGVEIAQQLIEAGRSVATPVAIVEACSTARERMLSLTLEELAAGDAQKWVDASQPSLLMIGEAFAARQSGVVRSAGGLLVAA

SEQ ID NO: 13075 - protein, 596 aa, Silicibacter pomeroyi
MECVLMKMTTEEAFVKTLQMHGIQHAFGIIGSAMMPISDIFPAAGITFWDCAHEGSGGFMADGYTRATGKMSMMIAQNGPGITNFVTAVKTAYWNHTPLLLVTPQAANKTIGQGGFQEMEQMRMFADCVAYQEEVRDPSRVAEVLNRVIMNAKRASAPAQINIPRDMWTQVIDIALPAIVEFERPSGGEEAVAAAAEMLSNAKNPVILNGAGVVLSKGGIAASKALAERLDAPVCVGYQHNDAFPGSHPLFAGPLGYNGSKAGMELIKTADVVLCLGTRLNPFSTLPGYGMEYWPADAKIIQVDINPDRIGLTKKVSVGIIGDAAKVARGILAQLSDTAGDEGRAARKDRIAQTKSAWAQQLSSMTHEDDDPGTTWNERARADKPDWMSPRMAWRAIQAALPREAIISSDIGNNCAIGNAYPDFDEGRKYLAPGLFGPCGYGLPAVVGAKIGCPDVPVVGFSGDGAFGIAVNELTAIGRGEWPAVTQIVFRNYQWGAEKRNSTLWFDDNFVGTELDQRVSYAGIAKACGLQGVVARTMDELTAALAKAIEDQKAGKTTLIEAMINQELGEPFRRDAMKKPVRVAGIDKADMREQQV

SEQ ID NO: 13076 - protein, 183 aa, Zea mays
  misc_feature (130)..(130): Xaa can be any naturally occurring amino acid
  misc_feature (154)..(154): Xaa can be any naturally occurring amino acid
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLXFGCTDSAQGVKEVQKCKTEDPNAXFIRIIGFDNNRQVQCISFIAYKPPSFTGA

SEQ ID NO: 13077 - protein, 483 aa, Mesorhizobium loti
MPQANAKLNAFPVFVRVEGEAVAIVGGGDEALAKARLIGQSSAVLRIIAENAEPELLAFIGQSGASHVAAAYDASQLEGAVMVFAASGDEALDRRVAADARELGIPVNAVDRPELCDFFTPALVNRAPVAIAIGTEGAGPVLAQMLRGRIDQMLSPSLGSLATLAATLRGAAEKLLPKGNARRRFWNSFFEGAPAHAVEAGQLSQAHDAAVDLLLSNAPASGHIALVGAGPGAEDLLTLRAHRLLMEADVIVHDALVPEAVVAMGRRDAERLPVGKRKGCHTKSQAEINALLVELGRQGKRVVRLKSGDPLVFGRAGEEMAALRDAGIAYEVVPGVTAAFAAAADFELPLTLRGVSSSMVFTTGHDLKGNSLPDWAKLAISGATVAVYMGRSVAAEVAGRLIEAGLSPDTAVAVVENASLANRRRFHGTLADLPSLEARGDLSGPVMTIIGDAVAGANFERSEPLAAHRNEGAAKVAAERVQP

SEQ ID NO: 13078 - protein, 327 aa, Pyrobaculum aerophilum
MQMGDLMDVDYDVIIVGAGIAGLSAALYTARQRLKTLVISRDLGGQLNMTTLIENYPAIPKISGPELAKRVEQQARTFGAEIIFDEVKAVEKHGDVFVVKTEGGDEYKSLAVILAFGKTPKELGVPGESKFKNRGVSYCTICDAPFFKGQDIALISWGDLAREPVTILSSVANKFYWIYPGEKPIHDDEFIEQAKRLGKAVFVPNSEVVEIKGDTKVKSVVVKNRKTGETQELPVSAVFIEVGYVTKSDFVKHLVELNERGEIIADWEGKTKTPGVFAAGDIVAYPYKQAVISAAMGVAAALSATAYVMKLKGKPVHSLVDWRAEKK

SEQ ID NO: 13079 - protein, 1211 aa, Oryza sativa
MLCLTLSLSLSLSISFSFLELELCIDGHLAPLNCFPLTPSPLTVLALAFGSKGTLFLKGEGQAQEAAGSPQGVVLEEEIKVKEEFNNHKDYDYLFRFHFEVHTIDVSLLCMWLIIAKCLESIPFSYDHSFLDEAAMEGHVIVPLEKLSLELNNGGIMLNHDKDISALQEEISALRSRQRHLDHRRQEALDKLIDLKGSIRVFCRVRPSISANNFMTKSPVTVENEKIVVRAVGIKKEFSVDRVFDQESTQEDVFQEVKPILRSALDGHNVCILAYGQTGTGKTYTMEGNNGKLGIVPRAIQELFSHASQDSSSTYSFSISMLEVYMGTVRDLLTPRQPLFRSTECNTSSIISILATKSGAVEVEGLTDVAIQDLKKANQCLTRITIKRSSGGTTEECSKLWLVDLGGSERLLKTGASGLTMDEGKAINLSLSALGDVIAALRRKRSHVPYRNSKLTQILSDSLGDGSKVLMVVHISPSDDDIGETVCSLSFAKRARSIESSKELSEDIKKLKQKRIAELDKEICDAEQELKDLNEQIKRAETSLEERKKLSSSACQALSDEKGSPRSTLVVVGHIDSAESPQATEKTKSRASHGSVPHFMSPTVCSRQRHSSASHSATKTRLTKSVNRYPAAELSGSHSFSYSSCKNAAKARSRRRPAIFPVVFIPSWPRVMTVALTASCKILTEALNIDRVIVQQLQNSENSQFLYLPLHQCTGIWQEEAKNMLHVEWQLAREISRTSNAESNADIWTHVDREQHGHVAHRFQVKKKQFFRNFMTITLFGAIGTLISFSVISLGSLGLISRLNIGSLDLGDYLALGAIFSATDSVCTLQVLNQDETPFLYSLVFGEGVVNDATSVVLFNAMQNFDLANFSSVKFLQFIGNFLYLFATSTFLGVAAGLLSAYIIKKLYFGRHSTDREVSIMMLMAYLSYMLAELLDLSGILTVFFCGIVMSHYTWHNVTESSRVTTKHAFATLSFIAETFLFLYVGMDALDMEKWKIVGETFSPMKSIALSSTILFLVLVARAAFVFPLSFLANLTKKTEEGKISIKQQVIIWWAGLMRGAVSIALAYNKFTRSGHTQLPSNAIMITSTITVVLFSTMVFGLLTKPLIRLLIPARHLNRESSALSDPPSPKSFLDPLILNGSDVDPEIGVGIRRPTSLRLLLASPTQSVHHYWRKFDNAFMRPVFGGRGFVPFVPGSPTERSVPLLQGNEN

SEQ ID NO: 13080 - protein, 296 aa, Listeria monocytogenes
MNTIKIALIQQKAVPNNKEANLKLAIKYIKEAHEKGADLVLFPEMWSNGYAPPFEDAFNHPLATDFDNERTKWLNEAITEDSAYFLTLKELAKELKIGICATYLSKTEQKPQNTAIIIDRKGEIILDYAKVHTCDFSLEILLQSGEEFKVCEFDGIKLGVMICYDREFPESARVLMLKGAEIILVPNACDMNPARLNQLNSRAFENMVGVAMANYPGEKWGRSTAFSPIVFDENGDYRDNTIIETDDVSEGIFIAEFNLDEIRTYRENETWGNAYRKPQTYTDLISLDVEAPFKRN

SEQ ID NO: 13081 - protein, 202 aa, Orobanche hederae
GVHWGHDIKKWNPKMAPYISANRKGIHITNLIKTARFLSEACNLVFDAASRGKQFLIVGTKKKTANSVACAAIKARCHCVNKKWLGGTLTNWSTTERRLHQFRDLRIEQKMGRFKRLPKRDAAVSKRQLSRLQTYMGGIKYMTGLPDIVIIVDQHEEYTALRECITLGIPTICLIDTNCDPDLADLSIPANDNSIFSIRLIL

SEQ ID NO: 13082 - protein, 202 aa, Orobanche cernua
GVHFGHGIRKWNPKMAPYISAKRKGIHITNLIKTARFLSEACNLVFDAASRGKQFLIVGTKKQAANSVACAAIKARCHCVNKKWLGGTLTNWSTTESRLHQFRDLRIEQKMGRFKRCPKRDKAVVKRQLSRLQTYLGGIKYMTGLPDIVIIVDQHEEYTALQECITLGIPTICLIDTNCDPDIADLSIPANDDSISSIRLIL

SEQ ID NO: 13083 - protein, 450 aa, Bacillus halodurans
MSGKVCFDYSKALDFIQEHELDNLQDQVHAAHRALHDGTGAGNDFLGWIDLPVNYDREEFSRIQKAAEKIRNDSDVLLVIGIGGSYLGAKATLEALNHSFYNIVDKSERKGPQIFFVGHHISSTYVQELFDVLEGKDVSINVISKSGTTTEPAIAFRIFRDYLEKKYGKEESRKRIYATTDRERGALKTLANEEGYESFIIPDDVGGRFSVLTAVGLLPIAASGLDIEAMMKGAADARDAFRNSDLKENPAYQYAVVRNALYNKGKTIELMVNYEPALQYFSEWWKQLYGESEGKDGKGIFPASVNFSTDLHSMGQYVQDGRRDLFETIIQVEKPKKNMTIEKADQDLDGLNYLAGETMDFVNKKAFEGTLLAHVDGGVPNLVVSVPELDEYYMGYLMYFFEKACGLSGYLLGVNPFDQPGVEAYKKNMFALLGKPGFEEQKAALEKRLK

SEQ ID NO: 13084 - protein, 202 aa, Melampyrum sylvaticum
GVHFGHGTRKWNPKMAPYISAKRKGIHITNLTKTARFLSEACDLVFDAASRGKQFLIVGTKNKAADLVVWAAIKARCHCVNKKWLGGMLTNWATTETRLHKFRDLRMEQKTGRLNRLPKRDAAVVKRQLSRLQTYLGGIKYMTGLPDIVIIVDQYEEYMALRECITLGIPTICLIDTNCDPNLADISIPANDDAISSIRLIL

SEQ ID NO: 13085 - protein, 486 aa, Listeria monocytogenes
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCKFDQK

SEQ ID NO: 13086 - protein, 202 aa, Pedicularis attollens
GVHFGHGTRKWNPKMAPYISAKRKGIHITNLTRTARFLSEACDLVFDAASRGKQFLVVGTKNKAADSVAWAAIKARCHCVNKKWLGGMLTNWSTTETRLQKFRDLRMEQKTGRLKRLPKRDAAVVKRQLSRLQTYLGGIKYMTGLPDIVIIVDQHEEYTALRECITLGIPTICLIDTNCDPDLADISIPSNDDAISSIRLIL

SEQ ID NO: 13087 - protein, 834 aa, Arabidopsis thaliana
MKRQAKPPEKKTKRTTNASSPTPSSSSPSLSSLPDEIVENCLARISRSYYPTLSIVSKSFRSIISSTELYVARSHLRNTEECVYVCLSDKSFEFPKWFTLWVNPNQANSMVEKKRKKKKTIGKLLVPIPSSNLSPVSKSAIAVGSEIYVIGGKVDGALSSAVRILDCRSNTWRDAPSMTVARKRPFICLYDGKIYVIGGYNKLSESEPWAEVFDIKTQTWECLSDPGTEIRNCTIYRIAEIEGKIHFGYTQKTYAYDPKQGEWECCEGEVAFPRSQCVMESVLYTFANNYTWEDDYGCKWWSTDGYGEKVKGLESLLEIHKRNGGSSDNTTKLVACGGKLLLLWEGYMKHNPNNRKKIWCAVIALEKRDGGKVWGIVEWVDVVHIVPTSCKLLHCLVVSLERGEGSKGKKECNMDYLSPHDQHSVFSFKIPSLPLIVITVAMNFQVEPPEKKKTKNSSPPHSPPSSSSPSLSLLPEEIVVHCLARISRLYYPTLSLVSKSFRSILSSTELYATRSHLGSTEQCVYLCLWDPSYQFPQWLRLLVNPNRTLANSIIKKRRKKKKTTGQMLVPLTSSKFTSVSKATVVVGSEIYVLGGPVDSAVRVLDCCSHTWRDAPSMNVSRMNAWACFHDGKIYVMGGCQGLKDEPWAEVFNTKTQTWEGLPEPGSEVRKCSIDRSGVIEGKIEFGNVNEMCAYDTKLCKWEYCVNKSAALRSECMIENVSYGFWNMRLLWYDNDIQKDYWKRLEGLESLDDKYMRNGGSSGNTTKLVACGGKLLLLWEGYMKHNPNNRKKIWCAVIAIEKCDGGGVWGIVESVDVLYTVPISCQLLHCLVVSV

SEQ ID NO: 13088 - protein, 313 aa, Medicago truncatula
MAKPPSSPPLTTIGTLIYYLSEHPSIISFRWSHSHSWGSTWSFLITSIATYLILSLFLHLSLSLLFPNRRHIPLGPIPALHSLTMSLISATIFTGTLISAVSEIRDTQWFWHRSKTPLRWLLCFPLGTRPSGRVFFWSYVYYLSRFLHMLRTILTILHRRRLSFYQLVNHSVSTLVSFLWLEFSQSFQVLAILFATLVYSLVYGYRFWTAIGLRSACFPFVLNCQILLLGCNVACHVGVFLLHFFFEVGGCNGMGAWVFNSILNTAVLVIFIHFYVRMYFVGKSERRMVQETESMDCSSSCPDLIVGSRARSR

SEQ ID NO: 13089 - protein, 188 aa, Glycine max
  misc_feature (42)..(42): Xaa can be any naturally occurring amino acid
  misc_feature (55)..(55): Xaa can be any naturally occurring amino acid
  misc_feature (57)..(57): Xaa can be any naturally occurring amino acid
  misc_feature (79)..(79): Xaa can be any naturally occurring amino acid
SKVHILRRHSAAHSAKGTVGGFSWHFAQGSLQFPPMGYRFVXGINTDSCSLTLHXRXGSLSVWDDLFTSFVYTMVYAPXKEDNRSFILFVASFGAFLFMRQDIGACGRFAAFDGVLLAVIEGPAIMLNNFISAQQHTLMIMYELHAHLSQSVRASRGSEGGSLEAAERTSPAAAEARRRLRRVSIVPL

SEQ ID NO: 13090 - protein, 493 aa, Ashbya gossypii
MSFEDLHKAQRGKVEEPVDEICKDFEVTEDKLRELTAYFIECMEQGLKNGETDGTYRGLPMIPSYVMGRPNGTEEGTFLAADLGGTNFRVCSVRLNGDHTFKLEQLKSKIPEELLDDDVTSDELFGFIAKRTMAFVKRYHSEVLQSEGGQLKLGFTFSYPVAQTSLSSGTLIRWTKGFNIKDAIGKDVVKMYQEQLDAVGLGSVRVVALANDTVGTFLSHCYNSRNSASLTTGEITEPVIGCIFGTGTNGCYMEKLENIEKLPQELRQKLTAQGKTEMCINIEWGSFDNELKHLPTTKYDLLIDQKFTHNPGFHLFEKRVSGMFLGEVLRNVLVDLHSQGLILRQYPQGQLPHRLLKPFNLSSEILSHIEIDDSSDLRETELSLLQALRLPTTADERRQIQRLVRAISRRSAYLASVPIAAVIIKTGALEKRYHGEVEIGCDGSVFEFYPGFRSMMRHGLALSPLGPDGERKVHLHVAKDGSGVGAALCALVA

SEQ ID NO: 13091 - protein, 1100 aa, Pseudomonas aeruginosa
MARREKPVFLNDPQWYKDAVIYQVHVKSFYDANNDGIGDFAGLIEKLDYIADLGVNTLWLLPFYPSPRRDDGYDIAQYRGVHSDYGSLADARRFIAEAHRRGLRVITELVINHTSDQHPWFIRARHAKKGSRARDYYVWSDSDEKYQGTRIIFIDTEQSNWTWDPVAQQYYWHRFYSHQPDLNFDNPQVLREVLGVMRYWLDMGVDGLRLDAIPYLIERDGTSSENLPETHQVLKRIRAELDAHYPDRMLLAEANQWPEDTRPYFGGEDGGEGDECHMAFHFPLMPRMYMAIAQEDRYPITDILRQTPDIPANCQWAIFLRNHDELTLEMVTDDERDYLWNHYAADRRARLNLGIRRRLAPLVERDRRRIELLHSLLLSMPGTPTLYYGDEIGMGDNIYLGDRDGVRTPMQWSVDRNGGFSRADPAKLVLPPILDPLYGYQTINVEAQARDPHSLLNWMRRLLAVRSQQKAFGRGSLKMLAPSNRRILAYLREYAEGERQDSILCVANLSRAAQAVELDLASHAGKVPVEMIGGMSFPPIGELTYLLTLPPYGFYWFYLADATQMPSWHVAADERLPELPTLVVKQRLGELLQGASRNILEGETLPAYLPKRRWFAGEKGQPRLCYIVPLDEAEPRCALCEVEIDGLRYQLPLGFLDADQRGDSLPQLLALARLRRGRKVGLLTDAASLPLFARKVLAQLRAEAVIAHGDGEIQFIPAAGLAEMDDIADEDVLPFSVEQSNSSIRFGERMVLKVLRKILPGLHPEIEVGGYLTRHGYPGIAPLLGEVRRVGADGEPHTLMILQGYLNNQGDAWNWTLDNLERAVRDEISAASEALEGQYDSLAELRGFAANLGARLGEMHSVLAGESDDPAFGSRESDEASVQAWALRIAEQLREAGKRLSEPPRPLQGEAAEQARRLLERLPALLERLPLLARQAAGGLLIRVHGDLHLGQVLMVQGDARFIDFEGEPARSLEERRQRHSPMKDVGGMLRSFDYAAAMVLRNAQSTDSSEQADSARRKVAMRYRSEARDAFLAGYRAAAAGLMHAWHGREGEGAALALACLEKAAYELLYEADYRPDWLEVPLAGLAELTEHLLKGKNR

SEQ ID NO: 13092 - protein, 454 aa, Mesoplasma florum
MDIKFLYDNHETLKEQKVTIIGRVRSNRQGKAVSFMVLNDGTVLNDLQVVYKPETFGFEQGSKARVSSIVEIEGILIPTPTRPQPFEINATSITLLDQAIEEYPLQKKEHSPEFLREISHLRARTKTFQAIFRIRSTAAFAIHKFFQENNYVYVTTPIITSNDAEGAGEQFVVTVNEDKDYANDFFGKKASLTVSGQLNGEAFAQAFKNIYTFGPTFRAENSHTTKHASEFWMIEPEVAFADINDNIQLMQDMLKSVVGYVLEKNMTELEFLQEQLEPGLIDKITGIVNVEFKVNTYEEVLKTLQDAIDKGHKFEENNIHFGLDLGTEHERFICEEVNKCPTFVINYPKDIKSFYMKQNDDGKTVAAVDLLVPGIGELCGGSEREANLDKILERCEFYGINPEELDWYIGLRKYGFYKSAGFGLGFERLIMYITGASNIRDVIPFPRTPKTLLY

SEQ ID NO: 13093 - protein, 345 aa, Aspergillus nidulans
MKYMSLDQRGSVMAEYIWIDAHGGTRSKTKTLSKAPSSVDELPEWNFDGSSTAQAPGDNSDVYLRPVAMYPDPFRRGDNILVLCETWDSDGSPNKFNYRHDCARLMETHAKEEFWFGLEQEYTLLGPDGWPYGWPKGGFPGAQGPYYCGVGTGKVYCRDIVEAHYRACLYAGVKISGINAEVMPSQWEYQVGPCHGIEMGDHLWISRFLLHRVAEEFGVKISFDPKPIKGDWNGAGLHTNVSTTSTRAEGGIKAIESYMKKLEARHVEHIAVYGEGNEERLTGRHETGNIDKFSYGVADRGGSIRIPRQVAKDGKGYFEDRRPASNADPYQITGIIAETVSFSNR

SEQ ID NO: 13094 - protein, 256 aa, Kineococcus radiotolerans
MSVLDKFSLQGKVALVTGGYKGLGRGFAQALAEAGADVVVAARDEAASVAAAAEIAASTGRRTLGLRLDVTSRPEVEAAVARVTAELGRFDVLVNNAGTCVHRPALEVTDEEYDDVITTNLKGVWLPSVVTAAWMAEHGGGSIVNVGSISAQIVNRPQMQPVYNASKAAVHQLTKSLAAEWAPLGIRVNAIAPGYVKTEMAPVDRPEFRRMWIEDAPMQRYSSPEEIAATVVYLASDASSFSTGAVVVTDGGYTLF

SEQ ID NO: 13095 - protein, 984 aa, Staphylococcus aureus
MQEHLVVTLDGKDYLVEPGTNLLEFIKSQDTFVPSICYNESMGPIQTCDTCTVEIDGKIERSCSTVIDRPMTVNTVNNDVKDAQKEALDRILEKHMLYCTVCDYNNGDCEIHNTMDAWGLQHQTYEYKEKPYEKDYGPFYRYDPNQCILCGRCVEACQDIEVNETIRIDWDREHPRVIWDNDVPINESSCVSCGQCATVCPCNAMMEVNMEGNAGYMTDTEPGSLAAMIDLTKKAEPGYGPLFAISDSEAEMRKERIKKTKTVCTYCGVGCSFEVWTKDREILKVQPSHDSPANKIATCVKGKFSWGHINSDQRLTKPLVRKNGEFHEVEWDEALNVIADNFTAIKEKHGPDALSFISSSKATNEESYLMQKLARQVIGTNNVDNCSRYCQAPATKGLFRTVGHGGDSGSIEDLEKAAMSVLIGTNTAEAHPVIASRMKRAQKLFGQKIHVFDIRKHEMAERADRFYQPKPGTDLAWLSAVTKYIIDHDLHDKAFIDEWVDDFDEYYKSLETFTMAFAEEATGIPESELIKFAEECAKAESVVICWAMGITQQDIGSDSSTAISNLLLVTGNYRRPGTGAYPLRGHNNVQGCSDMGSMPDKITGYQSIEADDIRAKFEKEYGVKLNPKAGKDNHEMVEGIHDGEVHSLYLYGEDTGIVDSNINFVQAAFEKLDFMVVQDEFLTFTATYADVVLPASPSLEKDGTFTNTERRIQRLYQALEPLGDSKPDWKIFQAIANRLGFDWNYKHPSEIMDEVARLTPLYAGVSYDRLEGFNSLQWPVQPDGTDEPILYLEGFNFDNGKAKLFPLSFDNYFKQDEIYDIHVNNGRLLEHFHEGNMTYQTPMIKYKVPRAFVEISPELAEDRGIHEGAEVKLISETGEAVLQVHVTDRVKGKEIYIPLNNDAMENGDLGAINLLTNSDVDQYTDTPSYKRTSCRLEVITKRGKSPLNPNNFRVNKKRQPQYSVQVQKKWERSDYVFPGNQVDK

SEQ ID NO: 13096 - protein, 575 aa, Arthrobacter ramosus
MNRRFPVWAPQAAQVTLVVGQGRAELPLTRDENGWWALQQPWDGGPDLVDYGYLVDGKGPFADPRSLRQPRGVHELGREFDPARYAWGDDGWRGRDLTGAVIYELHVGTFTPEGTLDSAIRRLDHLVRLGVDAVELLPVNAFNGTHGWGYDGVLWYAVHEPYGGPEAYQRFVDACHARGLAVVQDVVYNHLGPSGNHLPDFGPYLGSGAANTWGDALNLDGPLSDEVRRYIIDNAVYWLRDMHADGLRLDAVHALRDARALHLLEELAARVDELAGELGRPLTLIAESDLNDPKLIRSRAAHGYGLDAQWDDDVHHAVHANVTGETVGYYADFGGLGALVKVFQRGWFHDGTWSSFRERHHGRPLDPDIPFRRLVAFAQDHDQVGNRAVGDRMSAQVGEGSLAAAAALVLLGPFTPMLFMGEEWGARTPWQFFTSHPEPELGEATARGRIAEFARMGWDPAVVPDPQDPATFARSHLDWSEPEREPHAGLLAFYTDLIALRRELPVDAPAREVDADEARGVFAFSRGPLRVTVALRPGPVGVPEHGGLVLAYGEVRAGAAGLHLDGPGAAIVRLE

SEQ ID NO: 13097 - protein, 157 aa, Mycoplasma pneumoniae
MKQIYFGGGCFWGTQKYFDLIKGVQKTSVGYLNSNMKNPTYEQVCSGQTNAVEAVFVEYDENKVSLNELIDAFFKVIDPTIRNRQGNDIGTQYRTGVYWVDPQDEQLITQKFRELQANYPKPIVTENRAMENYFLAEEYHQDYLKKNPHGYCHIKFD

SEQ ID NO: 13098 - protein, 158 aa, Saccharomyces cerevisiae
MSADHSRDPCPIVILNDFGGAFAMGAIGGVVWTGIKGFRNSPLGERGSGAMSAIKARAPVLGGNFGVWGGLFSTFDCAVKAVRKREDPWNAIIAGFFTGGALAVRGGWRHTRNSSITCACLLGVIEGVGLMFQRYAAWQAKPMAPPLPEAPSSQPLQA

SEQ ID NO: 13099 - protein, 146 aa, Triticum aestivum
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECK

SEQ ID NO: 13100 - protein, 374 aa, Oryza sativa
MAVPLVLVVLPLGLLFLLSGLIINAIQAVLFLSIRPFSKSLYRRINRFLAELLWLQLVWLVDWWAGVKIQLHADDETYKAMGNEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAVSQGLPAPRNVLIPRTKGFVSAVTIMRDFVPAIYDTTVIIPKDSPQPTMLRILKGQSSVVHVRMKRHAMSEMPKSEDDVSKWCKDIFVAKDALLDKHLATGTFDEEIRPIGRPVKSLLVTLFWSCLLLYGAVKLFLWTQLLSTWKGVGFTGLGLALVTAVMHVFIMFSQSERSSSAKAARNRVKKD

SEQ ID NO: 13101 - protein, 355 aa, Erwinia carotovora
MGQKYLFIDRDGTLIAEPPEDFQVDRLDKLALEPDVIPSLLALQKAGYTLVMITNQDGLGTDSFPQETFDPPHNLMMQILTSQGIHFEHVLICPHLPADNCTCRKPKTELVTAYLNGGLMDVANSYVIGDRQTDIQLAQNMGITGLLYQRGGLNWQAITDQLTKRNRHAHVNRVTRETAIDVNVWLDQEGGSKINTGVGFFDHMLDQIATHGGFRMNIEVKGDLYIDDHHTVEDTGLALGEALNNALGDKRGIGRFGFILPMDECLARCALDISGRPHLEYKAEFNYQRVGDLSTEMVEHFFRSLSYSMACTLHLKTKGRNDHHRVESLFKVFGRTLRQAIRVEGDTLPSSKGVL

SEQ ID NO: 13102 - protein, 212 aa, Triticum aestivum
  misc_feature (156)..(156): Xaa can be any naturally occurring amino acid
  misc_feature (163)..(163): Xaa can be any naturally occurring amino acid
  misc_feature (166)..(166): Xaa can be any naturally occurring amino acid
  misc_feature (204)..(204): Xaa can be any naturally occurring amino acid
QTNMEGGGQLGGAFMGSTGSGGDGDSLGRAREDENDSRSGSDNLDGASADELDPDNSNPRKKKKRYHRHTPQQIQELEAVFKECPHPDEKQRMELSRRLNLESRQVKFWFQNRRTQMKTQIERHENALLRQENDKLRTENMTIREAMRSPTCGNCXGAACFGXECXLEEQHLRIENSRPQDELDRVCALAGKFLGRPVSASPSXEACRRPSA

SEQ ID NO: 13103 - protein, 515 aa, Debaryomyces hansenii
MGQILSQPVTEKISEHGIDKHLAYGISCMQGWRVNMEDAHATILNLYDLKNEGKGAVSDKAQDNSSSGKSGTDNDTTEEHTSFFGVYDGHGGEKVAIFTGQHLHEIIKSTKAFQEKDYVNAFKEGFLNCDQAILNDDEMKEDDSGCAAVSVIITPRQVICGNAGDSRSIMSINGFAKALSYDHKPSNEGEKSRICSAGGYVDMGRVNGNLALSRGIGDFEFKKNIDLPPEEQTVTCYPDVIQHNLDFTKDEFVVLACDGIWDCLSSQQCIECVSRGLYERKPLQDICEEIMELCCAPTSDGSGIGCDNMSMSIVALLDESRNESLDQWYDRVIKRIELSQSEDEESQFYGNISGEYNDMYKQMYGEYFEIGQQSQNSNTKSAGNNSSYYSMFGGLPGLRNGPGLNQNEDEEENELSNEPTEEIQEDGTAADLAGNGAISLQKLLASNAITNENGVIYLDTSSAQSLLAHFGMSGEDDEYEGNDVHDKHIEEEEVEEDDDQESKSKIEEEPQDDEE

SEQ ID NO: 13104 - protein, 103 aa, Hyacinthus orientalis
MSGRRKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 13105 - protein, 97 aa, Raphanus sativus
ATYKVKFITPEGEQEVECDDDVYVLDAAEEAGIDLPYSCRAGSCSSCAGKVVSGSVDQSDQSFLDDDQIAEGFVLTCAAYPTSDVTIETHREEDMDV

SEQ ID NO: 13106 - protein, 158 aa, Streptococcus pneumoniae
MTSLYDFSVLNQNNQATPLDSYRGKVLLIVNTATGCGLTPQYQGLQELYERYQDQGFEILDFPCNQFMGQAPGSAEEINTFCSLHFQTTFPRFAKIKVNGKEADPLYVWLKDHKSGPLGKRIEWNFAKFLIGRDGQVFERFSSKTDPKQIEEAIQTLL

SEQ ID NO: 13107 - protein, 1016 aa, Unknown
  Gemmata sp. Wa1-1
MRESLGPRMRFPTTVRSINVTLTNHQPLSQHRSAPRETNVAHDESYQAAERKIDAAHQFRATILDLNSHRLTTLPESLRKLNRLQRLYLGANDLTELPEWLGQFTGLRVLQLESNHLTRLPEWLGQLTQLQRLDLANNSLTELPEWLGQLTRLQRLDLANNSLTELPEWLGQLTQLQKLIIDNNLLNELPESLGRLTQLQTLRLNKNPLNPELMVAYAEGLTSVVRYMQAKAEKSIVLNEAKLILIGEGEVGKSCLLGALRGDPWEDGRPTTHGIEIKQVKVVDPDGSTEIILNGWDFGGQPVYRPTHQLFFSAPAVYLVVWKPREGPQAGAVKEWIKLVKHREPRAKILVVATHGGPKDRQPDIDRQEFWDLFGKRTVIDFFHIDSQPEDDKATGKRTGTCTGIKILKDAIARIATKLPEVGRTVPESWQRARVALKENGAPYLPLKDVLAICGKCRINETTAKLFVKLSHQLGHLIHYDHDPALRDIVVLKPDWLSTAISFVLDDKETRANSGLVTADRLAELWNDPARANEFRYESHCYPVFRRLMERYDISYRIAETGQHTESETSLIAQLVPDVRPEHKLARAWPATPFGGEAQQMQICRVVDTMNHSAPAEGLLYQLIVRLHKYSLGRADYAKSVHWQRGLVLEDTFGARALLEHVENDIRITVRSPYPERFLAALTYEVQWLVESFWKDLRCGVMVPCLNPLQRKPSCAGAFEVGKLIENKRRNRLEQPCPLCNEWQRIEELLHNSPAAQPDALKELLLTELVDLRADLKAIGDRIAAQHGVVIGRFDQADHNADARGKALVSKVEAAYADLIRTLLDEAKEGPRLFSFEPVEPDFFDRPKWVSEKFRFTLWCEHSRQPLPALNAKSGKKEDLKRGVYDVNIPRKWLKKAAPFLKVLGTTLSLVLPVAGAITKVALDEATYKGIEKQLDLGQKSLEFVLKGGEKLEPWLTKDDASKGIDQGDPVRADSSALRQLHVWLKEKDASFGGLVRVRNKRNEFLWVHEQFEGEY

SEQ ID NO: 13108 - protein, 431 aa, Unknown
  Synechococcus sp. WH 7805
MKRVLAIILGGGAGTRLYPLTKMRAKPAVPLAGKYRLIDIPISNCINSNINKMYVLTQFNSASLNRHLSQTYNLSAGFGQGFVEVLAAQQTPESPSWFEGTADAVRKYQWLFQEWDVDEYLILSGDQLYRMDYSLFINHHRSTGADLTVAALPVDAKQAEAFGLMRTDQDGRILEFREKPKGDSLLEMAVDTSRFGLSADSAKERPYLASMGIYVFSRDTLFDLLHQNPTHKDFGKEIIPEALARGDRLKSYVFDDYWEDIGTIGAFYEANLALTQQPTPPFSFYDAEFPIYTRPRYLPPSKLVDSQITDSIIGEGSILKSCSIHHSVLGVRSRVEDDVVLQDSLLMGSDFFESSSERAVLKERGGIPLGVGKGTTVKRAILDKNARIGSNVTIVNKDHVEEADRPEHGFYIRNGIVVVVKNASIPDGTVI

SEQ ID NO: 13109 - protein, 223 aa, Cryptococcus neoformans
MASHLANIFGTEQDRVNCSFYLKIGACRHGDRCSRKHIKPQFSQTILLPNVYNNPGHTPEGQNMSAEELQADFDRFYEDFFIELAKYGNLQEMIVCDNVGDHLLGNVYARFEYEAEAARAVQALNDRWYAMRPLHAELSPVTDFRESCCRQNELGECKREGFCNFMHLCHPTRSLVSALQASQRVSRRRAHKGAEVDSGDMGWTPAVAAGGEGDLGWMPERRY

SEQ ID NO: 13110 - protein, 472 aa, Unknown
  Synechococcus sp. WH 7805
MSKAHFGLIGLGVMGENLVLNAESNGFSSVVYNRTYSKTEEFLSGRGAGKNIQGATDLQDFVSKLERPRRILMMVKAGGPVDAVIEQISPYLEEGDLLIDGGNSEYHDTERRVAELESKSFGFIGMGVSGGAKGALEGPSMMPGGTKASYDAIESLVQKMAAQVEDGPCVTYIGPGGSGHFVKTVHNGIEYGIEQILAEGYDLMKRVGGMNGTQMADVFAHWNSTEELCSYLVEITEVCLRTKDPDDGSDLVEKIQDKAGQKGTGLWTVVSALQMGASVPTIYASLNGRVMSSMKEQRIKAEPILKGPAIKPFDMGTPADGMAPLMDAMVLACMASYAQGMELMRIASAEHNYNLHMPAIAQIWKGGCIIRSRLLKRIQDAFNADPQLANLLIDPWFADQVNRRLPGLAKVVAGAAEAGIPVPCLSSTLDYINSYRTSRLPQNLVQAMRDCFGSHTYARVDKDGVFHTEWLN

SEQ ID NO: 13111 - protein, 391 aa, Myxococcus xanthus
MADDYYQTLGVDRSASAEDVKKAYRKLARKYHPDVNPGNKAAEEKFKQVSAAFEVLSDTRKRKLYDEFGPDAEKIGFDEKKAEAYRAYKASAGSAGAGGIPYGAEGFDLGDLFGDLFGGRGGGAAGGAPGGFDIGEMFGRRGRNAGPERGEDLTVRVQLTLAEAVSGTERPLAFNRPGRCSTCSGRGTSGPVSTCNVCNGTGRARRSGSLFGGAGACPNCHGTGKAAPPCPQCGGAGVKEELARLTVKIPAGVHTGSKVRLSGQGAAGTRGGPPGDLYIETEVAEHPLVRREGDDLHLDLPVTVSEALLGADVRVPTFQGEVTVKVLPHSQSGRRMRLKGRGVPSLKGGAQGDLYLHLQVKVPEETTAEARAAAEALARAYQGDVRRELTL

SEQ ID NO: 13112 - protein, 643 aa, Zea mays
RMRSCRLPCKSPPMCEGGRPEAASMASHRRPQSAGLSSGLPVPEQEAAGGGGGGAAEATRRPRGWRAVAFIIGFYAAASIAGNAFSFSLTSYLIGRYNMKQNAATNVNNIFSGTYNFSPVIGAFVADAFWGRFRTLLVGTVFGVAAMAVITLSATVHQLKPPPCSPLAQQAGTCAAPSALQRAVLYLGMGLLVVSAGGTSPTGLPFGADQFDERKEQHSKQGGLARFYNWYYAVAMVATFLALTVVLYVQVKVSWGLGFAIPTALMLIAFLVFLVGTKLYVYVPPEGSIFSSVARVFVASCRKWRLRLPHPDDARRQEELLYDPPAVGIGGGRRVFKLPLTLQLSFLNKAAIVTDAAAEIRPDGAPARPWSLCSVQQVEEAKCLLKIIPVWISGTVWFTMVTELTNYTFLQASTMDLHMGKHFTVPPASIVAVFYLAVALFVPVYDLLVSRATLRRGITLLQRQGAGLVVAALAFVVAAAVEPRRRRSALAHGDGMSPLSVFLLAPQLAVMGVSGGFTLVGQVEFYNTQFPEQMRTLANAVFYCAQGISSYLATLVVNIVNARTRRHGGSAGWVTDDINAGRIDYFYYAMAVLSGANFVYFLVCSYFYQYKGEQAADTPPARCEPATDSDSRTSESAAALLRT

SEQ ID NO: 13113 - protein, 202 aa, Schwalbea americana
GVHLGHGTRKWNPKMAPYISAKRKGIHITNLTRTARFLSEACDLVFHAASRGKQFLIVGTTKKAAGSVAWAAIKARCHCVNQKWFGGMLTNWSNTERRLRKFRDLRMEQKTGRLNRLPKKDAAVVTRQLSRLQTYLGGIKYMPGVPDIVIIVDRYEEYTALRECITFGIPTICLIDTNCDPDLADLPIPANDDAISSIHFIL

SEQ ID NO: 13114 - protein, 682 aa, Listeria monocytogenes
MEIFLYVLALLVAIFISNLLNRFVPFVSVPLIQIGLGVLIAIMPITFDLQLNPELFLVMFIAPLLFNDGRQTDKAALWGMRMPILVLALGLVFATVVVIGYFVHWMIPTIPLAAAFALAAALAPTDAVAVSSLSGRINLPKRIMNLLEGEALINDASGLVAFQFAIAAMVTGVFSFMDASISFFVIAIGGILVGLILSWLKFRLLKWVRGLGMEDVTFHMLIQILTPFIIYLAAEEIHVSGILAVVAAGIMHSMEQKKMDPQSVKLNVVSQSTWSVIIFVLNGLVFLLLGTQLPAITEVVWNDSGSSNLQVMAYILSITAALILLRFLWVYISWSIGAKQRQKQNKKTQLPKFRPVVLTSLSGVRGAVTLASALAIPFFLDDGSLFPQRSLIIFIASGVILCTLVIATFILPLLAKSEEVTTEDERAETATRIRILRNVIRELKEQTLPETKAATDEVIEDYRRRIYDLQQNNSSNRGMDERERAKRLEIIQWERENTQKMTDEGRIVATDSYRYQHYLNMMEQAIKQRFRTKIKTAWMFLYRLIMLVIHPKKWGRITHKVKKGISKDSERFQAIRQLREENEVLIISKLKEQLTKENVDIIGPLITEHTIFLERVRKEHSPRGKRAKFEQKKREVQVLAFQLERDIIQNMFEKGGISRDLARDLRQNLNMIETYLYDDFLE

SEQ ID NO: 13115 - protein, 202 aa, Lindenbergia philippensis
GVHFGHGTRKWNPKMAPYISAKRKGIHITNLTRTARFLSEACDLVFDAASSGKQFLIVGTKNKAADSVAWAAIKARCHCVNKKWLGGMLTNWSTTETRLHKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 13116 - protein, 202 aa, Schlegelia parviflora
GVHFGHGTRKWNPKMAPYISAKRKGIHITNLTRTARFLSEACDLVFDAASRGKQFLIVGTKNKAADSVARAAIKARCHCVNKKWLGGMLTNWSTTETRLHKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 13117 - protein, 136 aa, Arabidopsis thaliana; identical to SEQ ID NO: 577

SEQ ID NO: 13118 - protein, 318 aa, Medicago truncatula
MGTLVGHVAPGFAFLILGLWHLFNHIKLHIKNPNSYISPTWFPTSKFKYLELYLIMLATTASISMELFIGPARHQPFDTDGTIPSYHLHNFEHALISMAFFAYAASSIILDKIENQAKLALTQFLASMAFFQQLLLFHLHSADHMGPEGQYHLLLQVLVFVSLSTTLLGIPMQKSFLVSFVRSLSIFFQGLWLMVMGYMLWTPSLIAKGCFMNSEEGHKVVRCSDEESLHRAVSLVNILFSWLVIVVAVFGVSLYLVLTKYYGANKVRYFSLGIEDEEREDVEKLSDDVESQKRNLVGKPKSFIHVGQKTLSSVDIER

SEQ ID NO: 13119 - protein, 202 aa, Verbena bonariensis
GVHFGHGTRKWNPKMAPYISAKRKGMHITNLTRTARFLSAACDLVFDAASRGKQFLIVGTTNKAANSVARAAIKARCHCVNKKWPGGMLTNWSITETRLHKFRDLRMEQKTGRLNRLPKRDAAVVKRQLSRLQTYLGGIKYMTGLPDIVIIVDQHEESTALRECITLGIPTICLIDTNCDPDLADISIPANDDAISSIRLIL

SEQ ID NO: 13120 - protein, 1010 aa, Glycine max
MRVLVLLMLFLHSLHAARISEYRALLSFKASSITNDPTHALSSWNSSTPFCSWFGVTCDSRRHVTGLNLTSLSLSATLYDHLSHLPFLSHLSLADNQFSGPIPVSFSALSALRFLNLSNNVFNQTFPSQLARLSNLEVLDLYNNNMTGPLPLAVASMPLLRHLHLGGNFFSGQIPPEYGTWQHLRYLALSGNELAGYIAPELGNLSALRELYIGYYNTYSGGIPPEIGNLSNLVRLDAAYCGLSGEIPAELGKLQNLDTLFLQVNSLSGSLTSELGNLKSLKSMDLSNNMLSGEVPASFAELKNLTLLNLFRNKLHGAIPEFVGELPALEVLQLWENNFTGSIPQSLGKNGRLTLVDLSSNKITGTLPPYMCYGNRLQTLITLGNYLFGPIPDSLGKCESLNRIRMGENFLNGSIPKGLFGLPKLTQVELQDNLLTGQFPEYGSIATDLGQISLSNNKLSGPLPSTIGNFTSMQKLLLDGNEFSGRIPPQIGRLQQLSKIDFSHNKFSGPIAPEISRCKLLTFIDLSGNELSGEIPNQITSMRILNYLNLSRNHLDGSIPGSIASMQSLTSVDFSYNNFSGLVPGTGQFGYFNYTSFLGNPELCGPYLGPCKDGVANGPRQPHVKGPLSSSLKLLLVIGLLVCSILFAVAAIIKARALKKASEARAWKLTAFQRLDFTVDDVLDCLKEDNIIGKGGAGIVYKGAMPNGDNVAVKRLPAMSRGSSHDHGFNAEIQTLGRIRHRHIVRLLGFCSNHETNLLVYEYMPNGSLGEVLHGKKGGHLHWYTRYKIAVEASKGLCYLHHDCSPLIVHRDVKSNNILLDSNFEAHVADFGLAKFLQDSGASECMSAIAGSYGYIAPEYAYTLKVDEKSDVYSFGVVLLELVTGRKPVGEFGDGVDIVQWVRKMTDSNKEGVLKVLDPRLPSVPLHEVMHVFYVAMLCVEEQAVERPTMREVVQILTELPKPPSSKQGDLTITESSLSSSNSLESPTTASKEPKDQHPPQSPPTDLLSI

SEQ ID NO: 13121 - protein, 400 aa, Haemophilus influenzae
MNFLLCIFKGVYVIKLIQRFFKLESAGGILLLFSAVVAMLLANSPLSNQYNDFLNLPVSLQIGSFSINKTLIHWINDGFMAVFFVLVGMEVKKELFEGALSTYQQAIFPAIAAIGGMVIPAVVYWFIAKQDPSLANGWAIPMATDIAFALGIMALLSKQVPLPLKIFLLALAIIDDLGAIVVIALFFSHGLSVQALIFSAVAIIVLILLNRFKVSALCAYMVVGAILWASVLKSGVHATLAGVIIGFSIPLKGKKGERPLDDFEHILSSWSSFVILPLFAFANAGVSFAGIDVNMISSPLLLAIASGLIIGKPVGIFGFSYLSVKLGLAKLPDGINFKQIFAVAVLCGIGFTMSMFLASLAFDANAGESVNTLSRLGILLGSTVSAILGYLFLKQTTKLS

SEQ ID NO: 13122 - protein, 716 aa, Pseudomonas aeruginosa
MSRKRSPAPSRISEGHPFPLGATWDGLGVNFALFSAHATKVELCLFDARGEKEIERIELPEYTDEIWHGYLPDAHPGQIYGYRVHGPYEPDAGHRFNPNKLLLDPYAKQLVGRLRWSEALFGYTIGSADADLSFDERDSAPFVPKSKVIDPAFTWAERPPVRVPWDRTVIYEAHLRGLSMRHPQVPEAVRGTFAGLMNADLLAHIRRLGVTSVELLPIHGFVDDKHLLENGMSNYWGYNSIAFFAPHPAYLASGQVNEFKEMVAHLHDAGLELILDVVYNHTAEGNELGPTLCMRGIDNASYYRLMPDQRRYYINDSGTGNTLDLSHPCVLQMVTDSLRYWATEMRVDGFRFDLATILGRHPDGFDERHGFLVACRQDPVLSKCKLIAEPWDCGPGGYQVGGFPPGWAEWNDRFRDCVRAYWRGDDGMLPELARRLTASGDLYDQRGRRPYASVNFVTAHDGFTLRDVVSYDHKHNEANGENNADGSDHNLSWNHGCEGPTDDPEIRALRLRQMRNLLSTLLLSQGTPMLVAGDEFSRTQQGNNNVYCQDNELGWIDWRLDDEGRSLLAFTQRLLALRQRYPILRRGRFLVGEYNEALGVKDVTWLAPGGEEMTEEHWHDEHARCLGVLLDGRAQPTGILRSGEDATLLLILNAYHDAVSFRLPEVAEGSGWTCLLDTQRPEDPLGERYPFASEFLVGGRSFLLFELQPPGAGAEG

SEQ ID NO: 13123 - protein, 232 aa, Bacillus cereus
MLILDGMVMTTEKDEFVYHEMVAHVPLFTHPNPENVLVVGGGDGGVIREVLKHPSVKKATLVEIDGKVIEYSKQYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVSEERFHEIETKYYTKELHNAAFALPKFVGDLIK

SEQ ID NO: 13124 - protein, 202 aa, Diplacus aurantiacus
  misc_feature (112)..(112): Xaa can be any naturally occurring amino acid
GVHFGHGTRKWNPKMAPYISAKRKGIHIINLTRTARFLSEACDLVFDAASRGKQFLIVGTKNKAADSVAWAAIKARCHCVNKKWLGGMLTNWSTTETRLHKFRDLRMEQKTXRLNRLPKRDAAVVKRQLSRLQTYLGGIKYMTGLPDIVIIVDQHEEYTALQECITLGIPTICLIDTNCDPDLADISIPANDDAISSIRLIL

SEQ ID NO: 13125 - protein, 709 aa, Haemophilus influenzae
MNPIVKQFKYGQHTVTLETGAIARQATAAVMASMDDTTVFVTVVAKKDVKEGQDFFPLTVNYQERTYAAGKIPGGFFKREGRPSEGETLIARLIDRPIRPLFPEGFFNEIQVVATVVSVNPQISPDLVAMIGASAALTLSGVPFNGPIGAARVGFIDNQFVLNPTMAEQKQSRLDLVVAGTDKAVLMVESEADILTEEQMLAAVVFGHQQQQVVIEAVKEFAKEAGKPRWDWVAPQPNTDLINKVKAIAEARLGDAYRITEKQARYEQIDAIKADVIAQITAEDEEISESKIVDIFTALESQIVRGRIIAGEPRIDGRTVDTVRALDICTGVLPRTHGSAIFTRGETQALAVATLGTERDAQIIDELTGERQDHFLFHYNFPPYSVGETGMIGSPKRREIGHGRLAKRGVAAVMPSLAEFPYVVRVVSEITESNGSSSMASVCGASLALMDAGVPIKAAVAGIAMGLVKEEEKFVVLSDILGDEDHLGDMDFKVAGTREGVTALQMDIKIEGITPEIMQIALNQAKSARMHILGVMEQAIPAPRADISDYAPRIYTMKIDPKKIKDVIGKGGATIRSLTEETGTSIDIDDDGTVKIAAVDSNAAKNVMGRIEEIVAEVEAGAIYKGKVTRLADFGAFVAIVGNKEGLVHISQIAEERVEKVSDYLQVGQEVNVKVVEIDRQGRIRLTMKDLAPKQETEINQEDPVEEQE

SEQ ID NO: 13126 - protein, 361 aa, Nicotiana longiflora
DNKPSPSPSPPAKSPPSQVKSSLPSPAKSPPTPPAKSPPPPSPPAQPPKQSPPPPPAKQPPPPPPSAKPPVKPPSPSPAAQPPATQRATPPSQSPPMQRASPPKLPLPPPPAQLPIRKPPPPATQLPIRKPPPPAYTQPPFKTPPPPPIRSSPPPQDAYDEPPIVDSPPAPPSDHEPPVVEPPPSDYEPPIVEPTPPTDQPPIITPSPPTLTPPITPPVRLPPPLFHPAGTPLIIVGRVHCKSCNNRGLPTLYKASPLQGAVVELVCHNNARKANVQTAMTDKNGEFVIIPMSLTRADVHKCKVYLVKSPKPICNVPTNFNGGKSGALLKPRPGPVQPPMFDYHGVGPSIFEASSKLPCKK

SEQ ID NO: 13127 - protein, 553 aa, Escherichia coli
ASIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 13128 - protein, 395 aa, Pseudomonas fluorescens
MPLRSTFTRFFQLEAASGLLLIAAAILALIINNSPLSWLYNGLLDTPVVAQIGALKIAKPLLLWINDGLMALFFLLIGLEVKREVLDGQLSKPSQIVLPGAAAIGGMLVPALIYWFLNRDNPAALDGWAIPTATDIAFALGVLALLGKRVPVSLKLFLMTLAIIDDLGAIVIIAIFYSGELSTLSLGLAAACIAALVAMNRLGVVKLGPYMIIGLILWVCVLKSGVHATLAGVTLAFCIPLRTKNAEPSPLLTLEHALHPWVAYGILPLFAFANAGLSLSGVTVESFTHHVPMGIAVGLLLGKTLGVFGLTWLAVKTGIAALPQGANWGQVLGVAILCGIGFTMSLFVGSLAFVPGASEYAGMDRMGILTGSVFAALIGYAVTAAASRKNTALPS

SEQ ID NO: 13129 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKEHKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 13130 - protein, 417 aa, Erwinia carotovora
MLKREMNIADYDADLWQAMEQEVVRQEEHIELIASENYTSPRVMQAQGSQLTNKYAEGYPGKRYYGGCEYVDIVEQLAIDRAKALFGADYANVQPHSGSQANFAVYTALLQPGDTILGMNLAHGGHLTHGSPVNLSGKLYKVIPYGIDESGKIDYDEMAELARTHQPKMIVGGFSAYSGVVDWAKMREIADSIGAYLFVDMAHVAGLIAADVYPNPVPHAHIVTTTTHKTLAGPRGGLILAKGGDEDLYKKLNSAVFPGGQGGPLMHVIAGKAVALKEAMEPEFKVYQQQVAKNAKAMVEVFLSRGFNVVSGATSNHLFLLDLVSKNLTGKEADAALGRANITVNKNSVPNDPKSPFVTSGIRIGTPAATRRGFKEAEVRELAGWICDVLDNINDEATIERVKQKVLDICARFPVYA

SEQ ID NO: 13131 - protein, 199 aa, Bifidobacterium longum
MARTAHIVRETSESHIDLELNLDGTGKTDIDTSVPFYNHMMTALGKHSLIDLTIHAHGDTDIDVHHTVEDTAIVFGEALKQALGDKKGIRRFADATVPLDEALAKAVVDISGRPYCVCSGEPEGYEFCMIGGHFTGSLVRHVLESIAFHAGICLHMQVLAGRDPHHIAEAEFKALARALRFAVEIDPRVDGVPSTKGAL

SEQ ID NO: 13132 - protein, 112 aa, Erwinia carotovora
MKKIDAIIKPFKLDDVREALAEVGITGMTVTEVKGFGRQKGHTELYRGAEYMVDFLPKVKIEIVVSDDIVDTCVETITQTAQTGKIGDGKIFVFDVARVVRIRTGEEDEEAI

SEQ ID NO: 13133 - protein, 149 aa, Arabidopsis thaliana
  misc_feature (59)..(59): Xaa can be any naturally occurring amino acid
  misc_feature (63)..(63): Xaa can be any naturally occurring amino acid
  misc_feature (80)..(80): Xaa can be any naturally occurring amino acid
  misc_feature (82)..(82): Xaa can be any naturally occurring amino acid
  misc_feature (102)..(102): Xaa can be any naturally occurring amino acid
  misc_feature (138)..(138): Xaa can be any naturally occurring amino acid
MASSMLSSAAVATYPAQANMGAPFTAMKPCASLPDTRKANNDITYITCNGGRASRMKGXPPIXKKTLETLSYLPDLTDYXIXKEVDYLLHNKWITRGEFQMXHGLEYREHGNTPGYYDGRDWTIAKLPLFGCTDSAQXLNEGEECKNEY

SEQ ID NO: 13134 - protein, 180 aa, Brassica napus; identical to SEQ ID NO: 452

SEQ ID NO: 13135 - protein, 604 aa, Perilla frutescens
MATVTASQFAAYVHGGATSVDSKSNLGQIGQRAQLITHNGLRSVNRADALQMRNNVKVSAKRVGQVPINKDRCETSGMTLIFVSAECGPWSKTGGLGDVVGGLPPALAANRHRVMTVSPRYDQYKDAWDTSVVVEIQVGDKVETVGFFHCYKRGVDRVFVDHPLFLEKVWGKTKSKVYGPSAGVDYEDNQLRFSLLSLAALEAPRVLNLTSNKYFSGPYGEDVVFVANDWHTAVLPCYLKTIYQPKGIYTNAKVVLCIHNIAYQGRFAFSDFYKLNLPDQLKSSFDFMDGYEKPVKGRKINWMKAGIIESDRVLTVSPYYANELVSGPDKGVELDNILRKCTVTGIVNGMDTQEWNPATDKYIDNHYDITTVMDGKPLLKEALQAEVGLPVDRNVPLVGFIGRLEEQKGSDILVAALHKFIEMDVQVVILGTGKKEFEKQIEQLEELYPGKAVGVAKFNVPLAHKITAGADFMLVPSRFEPCGLIQLHAMRYGTIPICASTGGLVDTVKEGFTGFHMGAFNVECDAVDPADVLKIVKTVGRALEVYGTPAFREMINNCMSLDLSWKGPAKNWETVLLSLGVAGSEPGVEGDEIAPLAKENVATP

SEQ ID NO: 13136 - protein, 770 aa, Oryza sativa
MRVLLPFLALYRRHSLLISLGIILAIVTLLASIGLLALSGWFLAASSLAGLAGLLTFNYMLPAAGVRGAAIFRTAGRYAERVVSHDATFRVLSHLRVFTFSKILPLTPGGIARFRQADLLNRLVADVDTLDHLYLRVISPLISAAVVILVVTYGLSWLDPALALTLGGILLLLLLLVPPVFYRAGKPIGGQLTALRGQYRTDLTAWLQGQAELVVFGAVNDFRQTLNATEQRWQRRQWQQASLSGKAQALMILASGLTVTLLLWLTAAGIGGDTQPGALIALFVFAALASFEALMPVAGAFQHLGQVIASATRVKQIIDRQPEVTFPAAGPAAADRAQLSLQQLSFTYPDQPQPVLRDVTLEVAAGEHIALLGRTGCGKSTLLQLLTRAWRTDGGKILLNGEPLEDYDETTLRRMTTVVSQRVHIFSDTLRENLRLAAPDADDARLSDVLQQVGLGKLLAGDGGLNAWLGEGGRQLSGGEQRRLGIARALLHPAPLLLLDEPTEGLDAETEQQILALLRRHCQGKTLILSLAFPSPEGALRDPNGLLAIGGDLTAPRLLAAYERGIFPWYSPGEAILWWSPDPRAVLFPAEFHLNRSLKRFLRHDPFRITLNHDFAAVIAACAHRPDEGTWIGPEVQRAYQHLHRLGYAHSVEVWQDDQLVGGMYGVAQGALFCGESMFSRVTNASKCALMAFCRHFAAYGGELIDCQGTVLDTLPNTMFRVELENGHVVTAHISGKMRKNYIRILTGDKVTVELTPYDLSKGRIVFRSR

SEQ ID NO: 13137 - protein, 378 aa, Arabidopsis thaliana
MALSTTPSQMSVALPTRIDGSSRSMIKVQSISFTDKSWGPPLLRLDSKSRSLGVKKRSTICMSLQQSSKSKVLVTPLELEDPKETPLNLFRPKEPYTATIVSVERIVGPQAPGETCHIVIDHDGNVPYWEGQSYGVIPPGENPKKPGAPHNVRLYSIASTRYGDSFDGKTASLCVRRAIYYDPETGKEDPSKAGVCSNFLCNAKPGDKVKITGPSGKVMLLPEDDPKATHIMIATGTGVAPYRGYLRRMFMENVPNFKFDGLAWLFLGVANSDSLLYDEEFAGYRKDYPENFRYDKALSREEKNKKGGKMYVQDKIEEYSDEIFKLLDNGAHIYFCGLKGMMPGIQDTLKRVAEERGESWEQKLTQLRKNKQWHVEVY

SEQ ID NO: 13138 - protein, 466 aa, Unknown
  Synechococcus sp. WH 7805
MTSRVDSPKPGLTISVQGEDLDQQGRGIARWNGWVITVPELIPGEDASVQLLQRQRRLWHGKKIKSIKPSPDARRPPCILAHACGGCTLQHISVNAQNQWKQEHLKATLLRIGGVTTLAGPLISPEDESLGYRNRALIPIQRGEGGLRLGYYRRGSHRIVNLNHCPVLDPRLDALIEPIKNDLALTDWPMDSDLRGEPGLRHLGLRIGVRTGQILISLVAATDHLPGLDRLTAEWMQRWPQLKGVTLNVQPKRSNTVIGEQTLCIQGDDVIEENFCGLSLQLGTTTFFQVNTTRAEQVVTMICDWIHASAPSANVIDAYCGIGTIALPLAASGLNVVGLEINRDSVIQAQENAQRNGLEKVCFLDGDVAEHLEQLLPHHQALVVDPPRKGLAPAVLQMILAIPPAFLIYLSCDPATLARDLQQLAGPDGPYRIEQIKPVDFFPQTSHLECLVMMIRVSSAVPPRTA

SEQ ID NO: 13139 - protein, 397 aa, Candida glabrata
MSLRALRGFLIGTRNLPLRGIRYQSTSTGTSNNVDVNENTDDLYLMKQQELNNVVVQQLKEFSKMSQAEIDNYLNNSKGAEPTEKEQLLEQELRNLFQKYSQDNQLLGGLDTAEEGHSRAVEEILQTKRFPFLVPSASDKPYSPQELYLRQAHHGSHVAKLGARVEQVFSPNRDIYTPPTPEKMSIEKLMAAGVHLGQSTSLWRSSTQPFIYGEYNGIHIIDLNQTLAYLKRAAQVVEGVAERGGVILFLGTRKGQKVALEEAAKRTHGYFVSTRWIPGTLTNSTEISGGWEKHEVDLQDKPTGRPLQTDEKSRIVKPDLLVVLNPTENRNALNEAMKSRVPTIGIVDTDSEPSFLTYPIPGNDDSLRSVNLLLGVLAKAGERGVKNRIRKASEMKQ

SEQ ID NO: 13140 - protein, 244 aa, Aspergillus oryzae
MWPGQAMSLKVNQILHHEKSKYQDVLVFESSDYGTVLVLDNVIQCTERDEFSYQEMITHLAMNSHPNPEKVLVIGGGDGGVLREVVKHDTVKKAILCDIDEAVIRVSKKYLPGMSIGFQHPNVEEFVGDGFEFLKTHKNEFDVIITDSSDPEGPAESLFQKPYFELLRDALRDGGVITTQGCSSPFLPVCLWLPERFPVFFFSLSLPLSPSLCCYIPIFCTTFALQFLPDPSPPLLLSLLTAHK

SEQ ID NO: 13141 - protein, 161 aa, Cryptococcus neoformans
MSAADHGRDPCPYVILNDFGGAFSMGAIGGGIWHGIKGARNSPRGERLVGSLSAIKARAPVLGGNFGVWGGLFSTFDCAVKGYRQKEDPWNAIISGFLTGGSLALRSGPKSAFGSAVGCAILLGVFEGVGVVANRMMAQPIPQMQLPEQAPPPVAPAVATA

SEQ ID NO: 13142 - protein, 197 aa, Paulownia tomentosa
HGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLNRLPKRDAAVVKRQLSRLQTYLGGIKYMTGLPDIVIIVDQHEEYTALRECITLGIPTICLIDTNCDPDLADISIPANDDAISSIRLIL

SEQ ID NO: 13143 - protein, 267 aa, Hordeum vulgare
MGRSPCCEKAHTNKGAWTKEEDDRLTAYIKAHGEGCWRSLPKAAGLLRCGKSCRLRWINYLRPDLKRGNFSHEEDELIIKLHSLLGNKWSLIAGRLPGRTDNEIKNYWNTHIRRKLTSRGIDPVTHRAINSDHAASNITISFESAQRDDKGAVFRRDAEPAKAAAAAAAISHHVDHHHRSNPQLDWGQGKPLKCPDLNLDLCISPPIHEDPMVDTKPVVKREAGVGVGVVGLCFSCSMGLPRSSDCKCSSFMGLRTAMLDFRSIEMK

SEQ ID NO: 13144 - protein, 176 aa, Unknown
  hyperthermophilic archaeon G1-H
PYGGGKGGIIVDPKKLSDREKERLARGYIRAIYDVISPYEDIPAPDVYTNPQIMAWMMDEYEAISRRKTPAFGIITGKPLSIGGSLGRNEATARGASYTIREAAKVLGWGDLKGKTIAIQGYGNAGYYLAKIMSEDYGMKVVAVSDTKGGIYNPDGLNADEVLKWKQEHGSVKDFP

SEQ ID NO: 13145 - protein, 202 aa, Leucophyllum frutescens
GVHFGHGTRKWNPKMAPYISAKRKGIHITNLTRTARFLSEACDLVFDAASRGKQFLIVGTKNKAADSVAWAAIKARCNCVNKKWLGGMLTNWSTTETRLHKFRDLRMEQKTERLNRLPKRDAAMVKRQLFRLQTYLGGIKYMTGLPDIVIIVDQHEEYTALRECITLGIPTICLIDTNCDPDLADISIPANDDAISSIRLIL

SEQ ID NO: 13146 - protein, 613 aa, Haemophilus influenzae
MTDKITFNDLGLPEFILKAVSDLGFETPSPIQQACIPHLLNGNDVLGMAQTGSGKTAAFALPLLAQIDPSEKHPQMLVMAPTRELAIQVADACEQFVKYAHGTRIVTLYGGQRYDIQLRALKQGAQVVVGTPGRILDHIRRRTLNLSELRFIVLDEADEMLRMGFIDDVETVMAELPENHQTALFSATMPEPIRRITKRFMNDPQEVKIKVNNENAPDIDQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQEDIAAAMLMLLQGKQKLILPPDPPMEKRRRERNDRGDRRENPRSAERRGERKGYGNPQPMDLYRIEVGRADGVEVRHIVGAIANEGDINSRYIGHIKLYDDYTTVELPQGMPKELLQQFAKTRVLNKQMQMSFLGAVKSDNSRGSDDFNGKRKGRGGDFRGERGRERGNDNRGNRKFNEKSNRTFSDKPRRDRRSSF

SEQ ID NO: 13147 - protein, 202 aa, Myoporum parvifolium
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLNRLPKRDAAMVKRQLFRLQTYLGGIKYMTGLPDIVIIVDQHEEYTALRECITLGIPTICLIDTNCDPDLADISIPANDDAISSIRLIL

SEQ ID NO: 13148 - protein, 217 aa, Caulobacter crescentus
MLSLHKTLEMPSADTALPGRAAPIPTAQTHFVNGHALKGPYPEGLETAIVAMGCFWGVERVFWKVPGVYVTAAGYAAGITPNPTYEEVCTGRTGHTEVVLVVFDPKVVTYEALLKTFWENHDPTQGMRQGNDIGTQYRSGLYVTSDAQAAAAAESKAAYQQALSARGLGTITTEIAPAGPFYFAEDYHQQYLAKNPNGYCGIGGTGVVCPIGLGVEG

SEQ ID NO: 13149 - protein, 237 aa, Nicotiana langsdorffii
PPPPAKSPPPPPAKSPPPPPPPAQPPKQSPPPPPAKQPPPPPPSAKPPVKPPSPSPAAQPPATQRATPPSQPPPMQRAPPPKLPLPPPPAQLPIRQPPPPATQLPIRKPPPPAQLPIRQPPPPATQLPIRKPPPPAYTQPPFKTPPPPPIRSSPPPQDAYDEPPIVESPPTPPSDHEPPVVEPPPSDYEPPIVEPTPPTDQPPIIITPSPPTLTPPFIPPITPPVKLPPPSIHPAGK

SEQ ID NO: 13150 - protein, 112 aa, Methanocaldococcus jannaschii
MKKVEAIIRPEKLEIVKKALSDAGYVGMTVSEVKGRGVQGGIVERYRGREYIVDLIPKVKIELVVKEEDVDNVIDIICENARTGNPGDGKIFVIPVERVVRVRTKEEGRDVL

SEQ ID NO: 13151 - protein, 202 aa, Selago thunbergii
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLNRLPKRDAAMVKRQLFRLQTYLGGIKYMTGLPDIVIIVDQQEEYTALRECVTLGIPTICLIDTNCDPDLADISIPANDDAISSIRLIL

SEQ ID NO: 13152 - protein, 703 aa, Unknown
  delta proteobacterium MLMS-1
MEKKLSVEIGGRTLTLETGRLAKQASGSVLVTYGQSVVLVTATAAREARASVDFLPLTIEYQERFYAVGRIPGSFFRREIGRPTENETLACRIIDRPLRPLFAAGYQNETQVIATVLSADNENDPELMAMIGASAALTVSHIPFNGPVAGVRVGMIDGEYVLNPPLDQRHNSRLDLIVAGTSKAVVMVEGGADGLPEDEVREGIFFAHEAMQPLIDLQEELCKDVGRPKMEVAPPPVDEDLRTRVESLAAAEMTEVISTADKKARGEAAHNLQERVLATLEADLVANTPEADLESKLKEAKGLLKDLQKKMMRQRIVKEHQRIDNRRLDEVRPITSEVAALPRVHGSALFTRGETQVLVSATLGSGDDEQRIESLSGMNFKPFMLHYNFPPYCVGEVRFLRGPSRRDIGHGALAERAIQAVLPDADSFPYTIRVVSEVLESNGSSSMATVCGASLSLMDAGVPMKKAVSGIAMGLIKEGEEVAILSDILGDEDHLGDMDFKVAGTDEGITALQMDIKVEGVSREIMTQALNQAKDARLHILEKMQQALEAPRREVPEHAPKLFTININPDKIRDVIGPGGKVIRGITADYGVKIDVEDDGKVKIFAPNGEVADQVRELVLSLTAEAEIGKIYTGTVQKIMDFGAFVQILPGTDGLVHISELENRRVEKVTDVLKEGDEVRVKVLDIDGRGKIRLSRKAVLAEE

SEQ ID NO: 13153 - protein, 367 aa, Nicotiana langsdorffii
PVNKPSPSPSPPAKSPPPQVKSSPPPPAKSPPPPPAKSPPPPPPPAQPPKQSPPPPPAKQPPPPPPSPSPAAQPPATQRATPPSQPPPMQRAPPPKLPLPPPPAQLPIRQPPPPATQLPIRKPPPPAYTQPPFKAPPPPPIRSSPPPQDAYDEPPIVESPPTPPSDHEPPVVEPPPSDYEPPIIEPTPPTDQPPIIIPSPPTLAPPFIPPITPPVKLPPPSIHPAGKPLIIVGHVHCKSCNSRGLPTLYKASPLQGAVVKLVCHNNGRKANVQTAMTDKNGEFVIMPMSLTRADVHKCKVYLGKSPKPICNVPTNFNGGKSGALLKPILPPKPPVNPGPGPVQPPMFDYHGVGPFIFEASSKLPCKK

SEQ ID NO: 13154 - protein, 202 aa, Callitriche hermaphroditica
GVHFGHGTRKWNPKMAPYISAKRKGIHITNLTRTARFLSEACDLVFDAASRGKQFLIVGTKNKTANSVAWAAIKARCHCVNKKWLGGMLTNWSTTETRLHKFRDLRMEQKTGRFNRLPKRDAAVLKRQLSRLQTYLGGIKYMTGLPDIVIIVDQHEEYTALRECITLGIPTICLIDTNCDPDLADISIPANDDAISSIRLIL

SEQ ID NO: 13155 - protein, 1025 aa, Kluyveromyces lactis
MSCLIPENLRNPKKVHENRLPTRAYYYDQDIFESLNGPWAFALFDAPLDAPDAKNLDWETAKKWSTISVPSHWELQEDWKYGKPIYTNVQYPIPIDIPNPPTVNPTGVYARTFELDSKSIESFEHRLRFEGVDNCYELYVNGQYVGFNKGSRNGAEFDIQKYVSEGENLVVVKVFKWSDSTYIEDQDQWWLSGIYRDVSLLKLPKKAHIEDVRVTTTFVDSQYQDAELSVKVDVQGSSYDHINFTLYEPEDGSKVYDASSLLNEENGNTTFSTKEFISFSTKKNEETAFKINVKAPEHWTAENPTLYKYQLDLIGSDGSVIQSIKHHVGFRQVELKDGNITVNGKDILFRGVNRHDHHPRFGRAVPLDFVVRDLILMKKFNINAVRNSHYPNHPKVYDLFDKLGFWVIDEADLETHGVQEPFNRHTNLEAEYPDTKNKLYDVNAHYLSDNPEYEVAYLDRASQLVLRDVNHPSIIIWSLGNEACYGRNHKAMYKLIKQLDPTRLVHYEGDLNALSADIFSFMYPTFEIMERWRKNHTDENGKFEKPLILCEYGHAMGNGPGSLKEYQELFYKEKFYQGGFIWEWANHGIEFEDVSTADGKLHKAYAYGGDFKEEVHDGVFIMDGLCNSEHNPTPGLVEYKKVIEPVHIKIAHGSVTITNKHDFITTDHLLFIDKDTGKTIDVPSLKPEESVTIPSDTTYVVAVLKDDAGVLKAGHEIAWGQAELPLKVPDFVTETAEKAAKINDGKRYVSVESSGLHFILDKLLGKIESLKVKGKEISSKFEGSSITFWRPPTNNDEPRDFKNWKKYNIDLMKQNIHGVSVEKGSNGSLAVVTVNSRISPVVFYYGFETVQKYTIFANKINLNTSMKLTGEYQPPDFPRVGYEFWLGDSYESFEWLGRGPGESYPDKKESQRFGLYDSKDVEEFVYDYPQENGNHTDTHFLNIKFEGAGKLSIFQKEKPFNFKISDEYGVDEAAHACDVKRYGRHYLRLDHAIHGVGSEACGPAVLDQYRLKAQDFNFEFDLAFE

SEQ ID NO: 13156 - protein, 322 aa, Acidobacteria bacterium
MSRKIAVLTSGGDAPGMNAAIRSVTRSAIAKGWTVMGVNQGYAGLVAGDYRELAARDVGGLLSKGGTFLGSARCPEFQKEDVREKALRNLNRSGIGALVVIGGNGSQTGGAALNDMGFPTLGVASTIDNDLVGSEITIGVDTALNIALEAIDRLRVTAASHQRGFLIEVMGRKCGYLALMAGIAGGAELVLVPEIDFEPDQIAEAIHDAYRRGKAHAMVVVAEGAKHNAEQLVRYFHDKNTGFELRATILGHVQRGGTPTAYDRLLASRLGAGAVEALDKGISGVVVGMNQGVVSTTPYSEVTGRTKGISPELYQLAHVLSR

SEQ ID NO: 13157 - protein, 221 aa, Arabidopsis thaliana; identical to SEQ ID NO: 562

SEQ ID NO: 13158 - protein, 192 aa, Cryptococcus neoformans
MVNFKNPPAPTVPSAIKAKESLKPGEGVEQAIFASGCFWGTEHLFTKHYGNLPQFSAISGYIGGHAESPSYRQVCTGATGHAEAVKVTYQTGSVAYAELVEFFYRTHDPTTVDRQGPDTGTQYRSAIFYTTPEQEETAKKVTAEVQEKYLKGRPIVTQIAKAGTFYQAEDYHQNYLDNNPGGYECPTHRFYW

SEQ ID NO: 13159 - protein, 648 aa, Medicago truncatula
MTKSVNTKTRVCCSYCEIILVFLVAASFSSPSPESDTIPKEFTLSVTKFRKRMVFMYVCMCMQMEPAGPPNNVNPDNIEVVEATEGNHVNGEVADGKSKGGWTTAYILLANQALATLAFFGVGVNLVLFLTRVLRQDSAEAANNVSLWTGTVYIFSLLGAFLSDSYWGRYLTCAIFQLFFVLGLGLMSLTSWLFLIKPLGCGNEHSVCNEPTPLGIGLFYLSIYLVAFGYGGHQPTLATFGADQFDDKSIQQTNSREAFFSYFYFALNVGSLFSNTILVYYEDTGMWTLGFGVSLASAIIALISFLAGSRKYRYVKAYGNPVIRVIQVFVAATRKWNVEPAKEDQLYEVDGNVSAIKGSRKILHSQDIRFMDKAATRTVKDGNESGNQWRLCTVTQVEEAKCVLRMIPVWLCTIIYSVVFTQMASLFVEQGDVMNNKVGKFHLPAATMSVFDICSVLVCTGLYRQVLVPLAGKLSGNPKGLSELQRMGVGLVIGMLAMVAAGVTEFERLKQVQPGQKQSNLSIFCQIPQYVLVGASEVFMYVGQLEFFNGQAPDGIKSFGSSLCMASISLGNYVSSMMVKLVMIFTARGEEPGWIPNNLNVGHMDRFFYLIAALSALDLVIYVFCARWYKGVTNIEGSDNVGSQEDNV

SEQ ID NO: 13160 - protein, 571 aa, Xanthobacter autotrophicus
MSAVETTRDDFAALLDESFGRADMQEGAVVKGIVVAIEKDLAIIDIGLKTEGRVALREFAGPGRENPIQVGDEVEVYLERVENAMGEAVLSRDKARREESWIKLEKAFTANEKVFGVIFNQVKGGFTVDLDGAVAFLPRSQVDIRPIRDVGPLMHNQQPFQILKMDRRRGNIVVSRRTVLEETRAEQRHELVQNLEEGQAIDGVVKNITDYGAFVDLGGIDGLLHVTDIAWRRVNHPTEVLNIGQTVKVKIIKINHETHRISLGMKQLLGDPWEGIEAKYPVEARFKGRVTNITDYGAFVELEPGIEGLIHVSEMSWTKKNVHPGKIVSTSQEVEVQVLEVDSAKRRISLGLKQTLQNPWEAFAEKYAPGAVVEGEVKNKTEFGLFLGLDGDVDGMVHLSDLDWNRPGEQVIDEYRKGDMVKAVVLDVDVEKERISLGIKQLAGDPFAEAGEVKKGAIVTCEVTDVKDGGIEVKLTGTDLSAFIKRSELARERNDQRPERFSVGDKLDARVTLFDRKARKVQVSVKALEIAEEKEAVATYGSQDSGASLGDILGAALKQRAAGGETEEKED

SEQ ID NO: 13161 - protein, 818 aa, Zea mays
RLVTHSTRTHYLIGQSQTNWAPSPPLPLPMAQKLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLSLFAPGDLKADRVTEEVPLDPLLNRTGNVWHVFIHGDELHGMLCGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQEGQFPHWNVWSEWNGKYRDTVRQFIKGTDGFAGAFAECLCGSPQLYQAGGRKPWHSIGFVCAHDGFTLADLVTYNSKYNLSNGEDFRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTEFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 13162 - protein, 612 aa, Streptomyces rimosus
MCGIAGWIDFERNLAQERATAWAMTDTMACRGPDDAGLWTGGHAALGHRRLAVIDPAHGRQPMHSTLPDGTSHVITFSGEIYNFRELRVELESQGHRFRTHCDTEVVLHGYTRWGRELVDRLNGMYAFAVWDEARQELLLVRDRMGVKPLYYHPTATGVLFGSEPKAVLAHPSLRRRVTAEGLCEVLDMVKTPGRTVFSGMREVLPGEMVTVGRSGVARRRYWTLQAREHTDDLETTIATVRGLLTDRVRRQLVSDVPLCTLLSGGLDSSAVTALAARAGDGPVRTFSVDFSGAGTRFQPDAVRGNTDAPYVQEMVRHVAADHTEVVLDSADLAAPEVRAAVLGATDLPPAFWGDMWPSLYLFFRQVRQHCTVALSGEAADELFGGYRWFHRTAAIDAGTFPWLTAGSARYFGGRGLFDRKLLDKLDLPGYQRDRYAEARKEVPVLPGEDAREAELRRVTYLNLTRFVQTLLDRKDRMSMATGLEVRVPFCDHRLVDYVFNVPWAMKSFDGREKSLLRAAVRDLLPESVVTRVKTPYPATQDPVYERLLRDELAALLADSQAPVRELLDLGRARDLLRRPVGAVSQPYDRGSLELVLWMNTWLAEYGVSLEL

SEQ ID NO: 13163 - protein, 716 aa, Rhodobacter sphaeroides
MFNVTKKSIEWGGETLTLETGKVARQADGSVIATLGETSVMANVTFAKAAKPGQDFFPLTVHYQERYYAAGKVPGGFFKREARPSEKETLTSRLIDRPIRPLFVDGFKNEVLLIVTVLSHDLVNEPDIVAMIAASAALTISGVPFMGPIGAARVGFAGGEYVLNPDVDDMQKLRENPEQRLDLVIAGTKDAVMMVESEAYELSEAEMLGAVKFGHEAMQPVIDMIIDFAEEAAHEPFDFSPPDYAALYAKVKSLGETQMRAAFAIREKQDRVNAIDAARAAIKAQLSEAELADENLGTAFKKLESSILRGDIINGGARIDGRDTKTVRPIISETSVLPRTHGSALFTRGETQALVVTTLGTGEDEQIIDALHGNSRSNFLLHYNFPPYSVGEVGRFGPPGRREIGHGKLAWRALQAVLPAATDFPYTIRVVSEITESNGSSSMASVCGGSLSMMDAGVPLKAPVAGVAMGLILEDDGKWAVLTDILGDEDHLGDMDFKVAGTENGITSLQMDIKVAGITPEIMEQALAQAKDGRMHILGEMSKALSSANSFSAYAPKIETLTIPTDKIREVIGSGGKVIREIVETSGAKVDINDDGVIKIASNDQAAIKKAYDMIWSIVAEPEEGQIYTGKVVKLVDFGAFVNFFGKRDGLVHVSQIANKRLTHPNEVLKEGQEVKVKLLGFDERGKVRLGMKMVDQETGQEIQPEKKEKEEAGEA

SEQ ID NO: 13164 - protein, 369 aa, Lilium speciosum
MAPVATTFLPTISDEKTLRASFVRDEDERPKVAYNNFSDDIPIISLAGMDEDGPIRSEICGKIVAACEDWGIFQVVDHGVDAGLVTEMNRLAREFFALPPEDKLRFDMTGGKKGGFIVSSHLQGEAVQDWREIVTYFSYPIRVRDYSRWPDKPEGWRAVVEAYSEQLMGLACKLLGVLSEAMGLDKEALTKACVDMDQKIVVNFYPKCPQPDLTLGLKRHTDPGTITLLLQDQVGGLQATKDGGNTWITVKPIEGAFVVNLGDHGHFLSNGRFKNADHQAVVNSNSSRLSIATFQNPAPEATVYPLAIRDGEKPVLDAPMTFSEMYRKKMSKDIELAKLKKLANTEAQEVAKKPTEVAVQPGKLDQILA

SEQ ID NO: 13165 - protein, 213 aa, Nostoc punctiforme
MQTTNRQVNSNYDQSTKNPRIATVHRTTGETDVQVTINLDGRGTCTAATGIPFLDHMLHQIASHGLIDIDVQAKGDLEIDDHHTNEDVGITLGQAFNQALGDRKGIVRFGNFLAPLDEALVQVALDFSGRPHLSYGLQIPTQRVGTYDTQLVREFFVALVNHSQMTLHIRQLDGINSHHIIEATFKAFARATRLAVEIDPRRAGLIPSSKGVL

SEQ ID NO: 13166 - protein, 407 aa, Methanococcus maripaludis
MKADAVKISEGVYWVGTYDWDIRSYHGYTLKGTTYNAYLVFGDEKVAVIDNVYPGTSAQMWGRIKDAFEKEGREFKIDVIVQNHVEKDHSGALVEITKKFPDAPIYCTEVAVEGLKKHYAGLKNAPFKVIKSLESVDLGGKTLTFLEAPLLHWPDSMFTLYGEAGILFSNDAFGQHLCLTKRFDNEIPENILMDANQKFYANLITPLSKLVLKKFNEVISLGLLEKITMIAPSHGQIWTDPMKVISAYQNFATGQCKDKATIVYDTMHYSTQKMAHAFAEGLLSEGIEVVIYNLHSDERSEIVKDILDSKAVLFGIPTINDQPFPSIGDLMYYLRGLRFDRTGFKKLALTFGSMGGRGGAIEKIANELGSSGFDVVNEYELYYIPNEDELEKCYSLGNELGKNIKSI

SEQ ID NO: 13167 - protein, 406 aa, Methanococcus maripaludis
MKADAVKISEGVYWVGTYDWDIRSYHGYTLKGTTYNAYLVFGDEKVAVIDNVYPGTSAQMWGRIKDAFEKEGREFKIDVIVQNHVEKDHSGALVEITKKFPDAPIYCTEVAVEGLKKHYAGLKNAPFKVIKSLESVDLGGKTLTFLEAPLLHWPDSMFTLYGEAGILFSNDAFGQHLCLTKRFDNEIPENILMDANQKFYANLITPLSKLVLKKFNEVISLGLLEKITMIAPSHGQIWTDPMKVISAYQNFATGQCKDKATIVYDTMHYSTQKMAHAFAEGLLSEGIEVVIYNLHSDERSEIVKDILDSKAVLFGIPTINDQPFPSIGDLMYYLRGLRFDRTGFKKLALTFGSMGGNGGATKLIGNDLKECGFEVLDDSYEVLYVPEEDELEKCYNAGKRLGMKLK

SEQ ID NO: 13168 - protein, 449 aa, Streptococcus mutans
MTTGKEYVASVFEKVKAQNAHEPEFLQAVEEVFESLIPVFDNYPKYIEENLLERLVEPERIVSFRVPWVDDKGQVQVNRGFRVQFSSAIGPYKGGLRFHPSVNQSIIKFLGFEQIFKNSLTGQPIGGGKGGSNFDPKGKSDNEIMRFCQSFMTELSKHIGADTDVPAGDIGVGGREIGYLYGQYKRLRNEYTGVLTGKGLTWGGSLARTEATGYGAVYFAEQMLKARGQDFAGKTAIVSGSGNVAIYATEKLQTLGAKVVAVSDSSGYVYDPDGIDVALLKELKEVQRARIIKYADARPNASFTPAGGDSIWTIKADLAFPCATQNELNEADAKTLVANGVIAVSEGANMPSTLEAIDVFLKAGVSFGPAKAANAGGVAVSALEMAQNSQRTAWTFEEVDRKLYDIMKGIYDNSAAAAKSFGQEGNLVVGANIAGFLKVADAMSAQGIV

SEQ ID NO: 13169 - protein, 120 aa, Triticum aestivum
MACYFSCAAGVNSAVPVAAPEAEMPEEGAEGASPEEEEAAAHDNGPKGGDDAKNKGLDDENQKLKEMLQKVLASGNDQMGVIAELSDKVKSLERKLARKRRPKVRVQHRPARNATANDVL

SEQ ID NO: 13170 - protein, 87 aa, Arabidopsis thaliana
  misc_feature (21)..(21): Xaa can be any naturally occurring amino acid
  misc_feature (23)..(24): Xaa can be any naturally occurring amino acid
  misc_feature (36)..(36): Xaa can be any naturally occurring amino acid
  misc_feature (58)..(58): Xaa can be any naturally occurring amino acid
  misc_feature (60)..(60): Xaa can be any naturally occurring amino acid
  misc_feature (68)..(68): Xaa can be any naturally occurring amino acid
  misc_feature (77)..(77): Xaa can be any naturally occurring amino acid
  misc_feature (84)..(86): Xaa can be any naturally occurring amino acid
KTNKKSNLRVSQSLGEANREXAXXTASASTDSAARXALLLKPTVAISAPVLGLPPMGXNXAGVRCSMXTKQGNVSFXGAGVSAXXXE

SEQ ID NO: 13171 - protein, 449 aa, Methanococcoides burtonii
MATDIEQKVMEAKMASIVLASVDTQTKDNALEAMAKALDANRNKILEANKADLEEAERMKNEGKLSQALVDRLKVTDPKIDGMISGIRDVIKLEDPSGRTINTLELDKGLELYQVSSPIGLIGVIFESRPDVVPQVMSLCLKSGNATVFKGGSEALNSNRVIFNILVEALEDTPGIPKGAFQLMETREEVMDILALDEYIDLLIPRGSNDFVKFIQDNTKISVLGHADGICHVYVDTNADLNKAYDVCFDSKVQYPAVCNAMETLLINREIAEEFLPEMVRRYEEVGVELRFDEGSYAIAEKLGSANIAKATEDDWKTEYNDFILSIKLVDSIEEAIDHINKYGSHHTDAIITENKTKRKQFIALVDSSSVMVNASTRFADGFRYGKGAEVGISTNKIHARGPVGMEGLVIYKYVLLGNGDKVATYAGDTPRPFTHKELDSKLSDIINE

SEQ ID NO: 13172 - protein, 956 aa, Acetivibrio cellulolyticus
MVMKKGSKIRKVQAVFLAICIFGTLFTAPAYSETTTTDATTVNDYNFAKALQMSLYFYDAEKCGRGITDGRLEWRGDCHLEDEAVPLIPMESKESPGTNMSQAFIDKYREFLDPDNNGTLDQGGGMHDAGDHVKFGLPQGYAASTLEWGFYEFRQAFIDKGLEDHMIEILRWFTDYFLKSTYMDADGNVIAFCYQVGNGDVDHSYWGPPELQQQVRPAFFATSENPAADQCANVSAALSISYLNFKDSDKEYAEKCLTTAKALYEFAKKYRGTGYSGGYYGSAYDDDEMSWAAVWLNIATGNKQYIDDIVSVKDGKYTGYMKKIIVNEQNHWQNIWVHSWDVVWGGVFAKLAPITNTDRDWYIFRWNNEYWASIQHENASDTAYLKPSPAGFKVVNTWGSARYNCAAQLCCLVYRKYTGREDFSEWAKGQMEYIMGNNPLNRCYIVGYAENSAKHPHHRAAHGSKTNSMEVPTEHRHTLWGALVGGPDAEDVHEDITTDYVYNEVAIDYNAGFVGALAGLCTYFGQDQEILKDFPPKEDPVDVYYTEAMLEQENKERTQVTIKLYNESVHPPHREGDMKVRYYFDIDEMLDAGQTVDDVELQIMYDENDSSYGGPIKYSGPFKWDDTGVYYVEFDWSDYEVYGTRNIQFALIGAQDSNYKFHWDPTNDWSRQGITEEFVKSKYIPVYNNGELVFGSEPPKGVATPTATPDPNATPTPQEKPSLKVMYKYGYADDGIEGVGDVKGIIKVLNNGKKPVDLSTVSIRYWYTKDSNSSQDYVFDYIKVDAEKVEGNFVEISKPVDTADSYFDISFKDGAGVIGPGSDSGEIQFRISQQGLPYSLSNDYSFNADAEGYIENSKITVYVNSELVYGIEPDGVTTPTPTPAQYVYGDVNGDGSLNSIDFGVMRKYLLGMIKEFSYENGLKAGDVDGNGMFNSLDFAYMRQYMLGIISKFPVQK

SEQ ID NO: 13173 - protein, 234 aa, Pyrococcus abyssi
KISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETIARRKTPAFGIITGKPLSIGGSLGRNEATARGASYTIREAAKVLGWDDLKGKTIAIQGYGNAGYYLAKIMSEDYGMKVVAVSDSKGGIYNPDG

SEQ ID NO: 13174 - protein, 376 aa, Unknown
  Azoarcus sp. EbN1
MAKRDYYEVLGVNRDASDNEIKKAYRKLAMKHHPDRNPDNKDSEDHFKEAKNAYEILSDAQKRAAYDRYGHAGVDPSAGAGPGGQGFDGFADAFSDIFGDIFGGAGGAGRGRSNVYRGADLRYNLEISLEEAARGADKTIRIPTVEECETCHGSGAKPGTQPKPCPTCGGAGQVRIQQGFFSIQQTCPKCHGTGRIIPDPCRDCGGAGRVKRQKTLEVKIPAGIDEGMRLRHAGHGEPGVNGGPPGDLYVEIHIRAHPVFQRDHDDLHCEMPISITTAALGGEIEIPTLEGMARLKIPAETQSGKVFRLRGKGIRNVRSQAHGDLMCHVVVETPVNLTERQKELLREFEEVSSSDADRHNPKAKSWMDKVKDFFGA

SEQ ID NO: 13175 - protein, 418 aa, Oryza sativa
MASLAQHVAGLASPPLSGAPRRRPAAPTRPSALVCGTYALTKEERERERMCQLFDEASERCRTAPMEGVSFSPEDLDSAVESTDIDTDIGSLSTAFLPLDEACLLDVNHIEEAGIRAGLVEEFMIIDENPGDETLILSLQAIQQDLAWERCRQLQAEDVVVTGKVIGGNKGGVVALVEGLKGFVPFSQVSSVYVHVHGMSCLSSAVLNHIVNTSCPLFYKPLLDLDQKSTAEELLDKELPLKFVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLTLSSEGILGPLSSDTPSEGSGEGQTTDE

SEQ ID NO: 13176 - protein, 172 aa, Oceanicola granulosus
MNAENLSRAVLAGGCFWGMQDLIRKLPGVEKTRVGYSGGDVPNATYRNHGTHAEAIEILYDPDRISYRRLLEFFFQIHDPTTKNRQGNDRGMSYRSAIYYVDEDQERIARDTIADVEASGLWPGKVVTEVEPVGDFWEAELEHQDYLERIPNGYTCHFPRPDWVLPRRDAAE

SEQ ID NO: 13177 - protein, 440 aa, Vibrio vulnificus
MKVVVVGGSAAGMSFAAKYKRNQPSDEVIVLDKRDYISFGACGLPYFAGGMFDDTERMISRTPEQAIKSGLDVRIETEMVALDRIEKQITVRHQGEETILDYDMLVIATGARPIIPSFGEFNPEHVYTLTSMEDGLAVKQALKDSNKQRVCVIGGGFIGLEVFDAAHLLGKHVTIIEREQHVMSRQFSPEMIDVVEGAIRESGAELKTSCSVSAIRDAEQGGYLVETDNGSVAADVVIMSLGFKPNTEAFELPKAANGALLVDEFGATEDEHIYAVGDCAVVHHMALGKSVYVPLATTANKQARMMADKLAGKDTYMNGFLGSSCLKVLDYELACTGVSELLAKEHGLDVSVSTISDKNQTDYYPGQEDIKVKLVYHPETKVLLGGEIVGKKGAVGRINALAVAITAKMTTQQLGYMDFCYAPPFARTWDALNVAGNVAK

SEQ ID NO: 13178 - protein, 110 aa, Stenotrophomonas maltophilia
MKAPVRVAVTGAAGQIGYALLFRIASGEMLGKDQPVILQLLELPVDKAQAALKGVMMELEDCAFPLLAGMVGTDDAEVAFKDADIALLVGARPRGPGMERKDLLLENAKI

SEQ ID NO: 13179 - protein, 381 aa, Bifidobacterium longum
MADYYETLGVERGASDDEIKKAYRKLSRKYHPDIAGPEFEDKFKEVNNAYDVLSNPDKRRMYDSGVDPNNPNAGAGGFSGAGFGDMSDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRTVGVTVPAGINDNARLRLANQGEVGEGGGAAGDLYIDIRIKADKQFTRDGDDLHCWIQVPMSWAVLGHDLSIDTFDGEKTVSIPAGCQPEDTVTLKGLGVTNIRNKDERGNLIAHVNVLIPTKLNETERGLIEQFAASHDSGATHVSQASRPQAGQKKGFFSKLKDALS

SEQ ID NO: 13180 - protein, 514 aa, Zea mays
RDSERRGDADAGAPRSLLAARRRRRRPTDRPGPGGGGGKGSTDTMEADSGKLFVGGISWETDEDRLREYFGRFGDVTEAVIMRDRNTGRARGFGFVVFADSGIAERVTMEKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNFLNGFNQGYNPNPLGGYGMRVDARYGLLAGARNGFSSFGPGYGMGMSVEGGMRGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMSNISSLGSGNLGRGTGDNNFGLPSGNYVRSNSTGTIGEPFSASANAYESNNPGAYGSSSIYGDSTWRFNSSEVDMPPFGHDLGNDDPDIKSEISASYMGNYTVNNNQTSRGITS

SEQ ID NO: 13181 - protein, 329 aa, Sinorhizobium meliloti
MTKYKLEYIWLDATRPYQTLRGKTQIKEFDAFPTLEQLPLWGFDGSSTLQAEGRTSDCVLKPVTVYPDPVRTNGALVMCEVMMPDAETPHASNTRATVLDDEGAWFGFEQEYFFYKNGRPLGFPEQGYPAPQGPYYTGVGYKNVGDVARQIVEEHLDICLAAGINHEGINAEVAKGQWEFQIFGKGSKKAADEVCVARYLLVRLTEKYGIDVEFHCKPLGDTDWNGSGMHANFSTAYLREVGGQDYFEALMAAFEKNLHDHINVYGPDNHLRLTGKHETAPWDKFSYGVADRGASIRVPHSFVNNAYPGYLEDRRANSQGDPYQMLLSS

SEQ ID NO: 13182 - protein, 414 aa, Bacillus cereus
MVDHLKRQDEKVFAAIEAELGRQRSKIELIASENFVSEAVMEAQGSVLTNKYAEGYPGKRYYGGCEHVDVVEDIARDRVKEIFGAEHVNVQPHSGAQANMAVYFTILEQGDTVLGMNLSHGGHLTHGSPVNFSGVQYNFVEYGVDADSHRINYDDVLAKAKEHKPKLIVAGASAYPRVIDFKRFREIADEVGAYLMVDMAHIAGLVAAGLHPNPVPHAHFVTTTTHKTLRGPRGGMILCEEQFAKQIDKSIFPGIQGGPLMHVIAAKAVAFGEALQDDFKTYAQNIINNANRLAEGLQKEGLTLVSGGTDNHLILIDVRNLEITGKVAEHVLDEVGITVNKNTIPFETASPFVTSGVRIGTAAVTSRGFGLEEMDEIASLIAYTLKNHENEAALEEARKRVEALTSKFPMYPNL

SEQ ID NO: 13183 - protein, 752 aa, Medicago sativa
MANADPCREFVKDVKRIIIKVGTAVVTRQDGRLAVGKLGALCEQIKELNILGYEVILVSSGAVGLGRQRLRYRKLIQSSFADLQKPQVELDGKACAAVGQSSLMATYDILFSQLDVTSAQLLVTDNDFRDQDFRKQLSETVRSLLALKVIPIFNENDAVSTRKAPYEDSSGIFWDNDSLSALLALELKADLLILLSDVDGLYNGPPSDPLSKLIHTYIKEKHQNEITFGDKSRVGRGGMTAKVKASVHAADAGIPVIITSGNAAENLTKILQGQRIGTLFHKDAHKWVPSKEVDVREMAVAARDCSRRLQVSLISEQLENVSRIPGYYQASVYRSFQNMLISNLTLQAVSSEERKQILLNIADALQSREKEIRIENEADVVAAQEAGYEKSLVARLVLKSEKIVGLANNIRIIANMEDPIGRVLKRTELAEGVILEKTSSPLGVLLIIFESRPDALVQIASLAIRSGNGLLLKGGKEANRSNAILHKVITEAIPDTVGSKLIGLVTSRAEIPELLKLDDVIDLVIPRGSNKLVSDIKSSTKIPVLGHADGICHVYVDKSANLEMAKQIVLDAKTDCPSGCNAMETLLVHKDLVEKGWLNSISDDLRSEGVTLYGGPKASSLLNVPLARSLHHEYCSLACTLEIVDDVYAAIHHINLYGSAHTDSIVTEDHEVADVFLRQVDSAAVFHNASTRFSDGARFGLGAEVGISTSRIHARGPVGVDGLLTTRWLLKGSGQVVDGDKTVTYTHKDLTT

SEQ ID NO: 13184 - protein, 238 aa, Unknown
  Synechococcus sp. WH 5701
MAVVTLSEMMEAGAHFGHQTRRWNPKMSRYIYCARNGVHIIDLVQTAVCMNNAYKWTRNASRSGKRFLFVGTKKQASEVIAIEASRCGAAYVNQRWLGGMLTNWSTMRARIDRLKDLERMESSGAIAMRPKKEAAVLRRELERLQKYLGGLKNMRRLPDVVVLVDQRRENNAVLECRKLDIPLVSMLDTNCDPDLADVPIPCNDDAVRSVQLVLGRLADAINEGRHGSQEQRAEDDEA

SEQ ID NO: 13185 - protein, 108 aa, Hyacinthus orientalis
LTVSVASGQYFCLHFEAFQLGMAPVYRAFLRFMGDDSEAKNYSYSREVGATGRKMIWQGVPRSIRDSHRKVRDSYDAIVIQRNIALFFSGGDRKELKLRVTGRIWKEQ

SEQ ID NO: 13186 - protein, 202 aa, Hippuris vulgaris
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKMGRLNRLPKRDAAVLKRQLSRLQTYLGGIKYMTGLPDIVIIVDQHEEYTALRECITLGIPTICLIDTNCDPDLADISIPANDDAISSIRLIL

SEQ ID NO: 13187 - protein, 202 aa, Hemiphragma heterophyllum
GVHFGHGTRKWNPKMAPYISAKRKGIHITNLTRTARFLSEACDLVFDAASRGKQFLIVGTKNKAADSVAWAAIKARCHCVNKKWLGGMLTNWSTTETRLHKFRDLRMEQKTGRLDRLPKRDAAMLKRQLSRLQTYLGGIKYMTGLPDIVIIVDQHEEYTALRECITLGIPTICLIDTNCDPDLADISIPANDDAISSIRLIL

SEQ ID NO: 13188 - protein, 346 aa, Kluyveromyces lactis
MSTTFGNVFRRVNVKTLSFIVGAGALAGSATGTVMEYQDMRNYNNRNYNKQKLAALAAAHVAAKEKYDVAKYQKVYNDIALKIRDEDEYDDFIGYGPVLVRLAWHCAGTWDAKDNTGGPYGGTYRFAMETNDPSNNGLQNAAKFLEPIHEKYPWLSHGDLYSLAGVTAIQEMQGPTIPWRSGRVDQPEDTTPENGRLPDASKDAKYVRCFFHRLNFEDRQVVALLGAHALGKTHLKNSGFEGPWGAATNIFTNEFYNNLLNEKWDLITNDAGNKQYVNDKGWMMLPTDMALVQDPKYLPIVKEFANDQDTFFKEFTKAFVVLLENGIDFPQENKPIKFKTLDAQDL

SEQ ID NO: 13189 - protein, 202 aa, Unknown
  Calceolaria sp. dePamphilis 90.203
GVHFGHGTRKWNPKMAPYTSAKRKGIHITNLTRTARFLSEACDLVFDAASRGKQFLIVGTKSKAAGSVASAAIKARCHCVNKKWLGGMLTNWSTTETRLHKFRDLRMEQKTGRLNRLPKRDAAMLKRQLYRLQTYLGGIKYMTGLPDIVIIVDQHEEYTALRECITLGIPTICLIDTNCDPDLADISIPANDDAISSIRLIL

SEQ ID NO: 13190 - protein, 523 aa, Acidobacteria bacterium
MGYDPKQCINSVQIRPSTHMGPMKKFKALFVHPSALMSSKVFLRLEPIGCELVAAACKAAGYDVRLLDLQIFSHKDYFRILDEWKPDAIGFSLNYLPNVPEVVDLAKETKRKMPGVFFFVGGHSASFVAKDILNHAEGAIDCVVRGEGEGVAPRVLEAAADDRKRVHELPGVVSLDGEGPHAEMVKSIDDLHPARELTSKRKSYFIGVLDPAASVEFTRGCPWDCVFCSAWTFYGRSYRKRSPESAAEEMARIKEPGVFLVDDVCFIEPEHGFAIGRELEKRNVKKEYYLETRGDVLLRNKEVFKYWRKLGLEYMFLGLEAIDDEGLKANRKRTTAGKNLEALEFTRKEGITVALNIIADPSWDKAKFAAVREWSLSVPEIVSISVNTPYPGTESWLTESREFSTRDYRLFDVQHAVMPTKMSLEEFYRELVNTQKAMTMKYMGWRAALDATSIAAKLLMRGQTNFVKMLFKFDSVYNAERQIAEHREPVKYEMSMPQRMTGKVDRSKLYIHPQELVKLQPQG

SEQ ID NO: 13191 - protein, 202 aa, Gratiola pilosa
  misc_feature (100)..(100): Xaa can be any naturally occurring amino acid
  misc_feature (167)..(167): Xaa can be any naturally occurring amino acid
GVHFGHCTRKWNPKMAPYISAKRKGIHITNLTRTARFLSEACDLVFDAASKGKQFLIVGTKNKAADSVAWAAIRARCHFVNKKWLGGMLTNWATTETRLXKFRDLRLEQKTGRLNRLPKRDAAMLKRQLSRLQTYLGGIKYMTGLPDIVIIVDQHEEYTALRECMTXGIPTICLIDTNCDPDLADISIPANDDAISSIRLIL

SEQ ID NO: 13192 - protein, 72 aa, Staphylococcus aureus
MAKQDVIELEGTVLDTLPNAMFKVELENGHEILAHVSGKIRMNYIRILPGDKVTVEMSPYDLTRGRITYRYK

SEQ ID NO: 13193 - protein, 789 aa, Zea mays
MAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 13194 - protein, 202 aa, Kohleria digitaliflora
GVHFGHGTRKWNPKMAPYISAKRKGIHITNLTRTARFLSEACDLVFDAASRGKQFLIVGTKNKAADSVASAAIRARCHCVNKKWLGGMLTNWSTTETRLHKFRDLRMEQKKGRLNRLPKRDAAMLKRQLSRLQTYLGGIKYMIGLPDIVIIVDQHEEYTALRECITLGIPTICLIDTNCDPDLADISIPANDDAISSIRLIL

SEQ ID NO: 13195 - protein, 939 aa, Wolinella succinogenes
MSEALSGRGNDRRKFLKMSALAGVAGVSQAVGSDQSKVLRPATKQELIEKYPVSKKVKTICTYCSVGCGIIAEVVDGVWVRQEVAQDHPISQGGHCCKGADMIDKARSETRLRYPIEKVGGKWRKTSWDSAMDKIAKQLQDLTQKYGPDSVMFIGGSKCSIEQSYYFRKFAAFFGTNNLDTIARICHAPTVAGVSNTLGYGGMTNHLADMMHSKAIFIIGGNPAVNHPVGMVHILRAKEAGAKIIVVDPHFSRTATKADHYVRLRNGTDVAFMYGMIRHIVKNGLEDKEFIRQRLFGYEEILKECEQYTPEVVEEVTGVPAQQLIEITEIFAKAKPASLIWGMGLTQHTTGTSNTRLAPILQMILGNIGKRGGGTNVLRGHDNVQGATDMGNLADSLPGYYGLDKNAWNHFCGIWKVDFEAMQKRFKTPDMMHKKGFSVSTWRYGVTEEENIPHNAGTKLRSLIVVGSGISTIARVDTTKDALDKMDLVVFFDPYFNDAAALTNRKDNLYILPAATQMETSGRVAATNRSYQWRSMVMKPLFECRPDEEILFDLAKRLGFYEEYTRSLGDGKGNFVWPDDATREVAKAIRTVGFQGRTPERLKAHAENWHMFDKFTLRGKGGPVKGEYYGLPWPCWSEKHPGTPNLWDDSIPVMDGGLGFRVRWGDVSPTGESLLASQDSSLPGSKFKGGHSMITDKNVEAITGIALTEEEKAKVAGKTWATDTTNILVEKALAAGLSPMGNGRARAIVWEWTDQIPKHREPIYTIRHDLISQYPTFKDKPNHFRANIRYESRQKEKDWTKEFPLNMLSGRLVAQFGTGTETRSAHYLAEVQPEMFVEIHPETATDLGVKHGDMVWVHGTNGAKILVKARHSYKVNKTSVFLPQNFGGMYQGESLVPYHIAGTEPYVIGESCNTITSDAYDINTSTPETKCGLCRIEKA

SEQ ID NO: 13196 - protein, 91 aa, Xanthobacter autotrophicus
MAKEELLEFEGTVTEVLPDGNFRVRLDNDHQILAYAAGKMKKNRIRTIEGDRVVVEMSPYDLDRGRINFRHKAEGNAPPPGARRQQNFRRR

SEQ ID NO: 13197 - protein, 472 aa, Pseudomonas putida
MSGQNMHSGELKRGLKNRHIQLIALGGAIGTGLFLGSAGVMKSAGPSMILGYAICGFIAFMIMRQLGEMIVEEPVAGSFSHFAHTYWGGFAGFLSGWNCWVLYILVGMSELSAVGKYVHYWWPEIPTWVTAAAFFVLINAINLMNVKFFGEAEFWFAIIKVVAIVSMIGLGAYLLTSGSGGPDATVANLWSHGGFFPNGVSGLVMALAFIMFSFGGLEMLGFTAAEADKPKSVIPKAINQVIYRILIFYVGALVVLLSLTPWDNLVASIDASGGSYGSSPFVQVFSLLGSDVAAHLLNFVVLTAALSVYNSGTYCNARMLLGMAEQGDAPASLAKVDKRGVPVRSILVSAAFTFVAVLLNYLMPQNALELLMSLVVATLVINWAMISYSHLKFRQHLDRTGQKPLFKAMWYPYGNYLVLAFVVLILGIMLMIPGIQVSVYAIPFWLFGMFVIYMVKPRRKLNAGGAAGHVAK

SEQ ID NO: 13198 - protein, 431 aa, Bifidobacterium longum
MSDELSPEVFDAVCRQADQAARAQERLAQANAEAKNELLLAIADALDEHAADIEAANALDMLESKENGMDAGKLDRLLFDVPRVAAAAQGVRHVATLPDPVGEIVRGYNLPNGLRLTQTRVPMGVIGMIYEARPNVTVDVASLCLKSGNAALLRGGHAAERTNAATLGVIAPVLEAHGFESALVQSVDQYGRAGATAMMEARGHIDVLVPRGGAGLIQAVVRNSKVPVIETGAGNVHIYIDKSGNLAKAIPIIINAKTQRVGVCNAAEKLLVHKDVAAEFLPRIAAALAEANVVLQADTTSYDIISGAAIEGLDLNHATEEDWDTEYLALKMGIKVVSDLGAAIDHINTHSTGHTESIIAEDYAAIEEFTKRIDSAVVMVNASTRFTDGGVFGFGAELGISTQKMHARGPMGLREMTTTKWIGYGTGQVRA

SEQ ID NO: 13199 - protein, 181 aa, Nostoc punctiforme
MWKRIVLILLLVLSFSLSNSDIAAAAGLKSFVDTSDGYQFLYPNGWLQVKVANGPDVVFHDLIEVSENVSVVISPVPEGKTLSELGTPTEVGYKLGKAALAPPDSGRSAELVNAAQREVDGKTYYLLEYEVKLPNKQQRHNIASVAVSRGKLFTLNASIPEKRWQRVKGMIDEVVNSFSVY

SEQ ID NO: 13200 - protein, 548 aa, Unknown
  Candidatus Desulfococcus oleovorans Hxd3
MFCFQCQETAKNQGCTVKGVCGKPEETADLQDLLIYVCKGIAIYGEALNAAGTLDREAAHFICRALFTTITNVAWDDDVLVDRIKEGLAVRDAVKAKAGEAVSGSLPDCATWASEDKAAIMAKALSDEVRITTMANEDVRSLRELLILGCKGVAAYTDHAAILGYEKDDIYAFLMEALASTTKELSVDDMIGLVMKAGETAVAAMALLDEANTATYGHPEITEVNIGVGKNPGILISGHDLKDMEELLRQTEGTGVDVYTHGEMLPANYYPAFKKYSHFIGNYGGSWWHQNKDFESFNGAILLTTNCLIPIKGDNTYKDRLFTTGVVNYPGAAHIGDRPDGGAKDFSPIIERAKTCAPPTEIETGTIVGGFAHHQVLALADKVVDAVKSGAIKRFVVMAGCDGRMKSRSYFTEVAEALPKDTVILTAGCAKYRYNKLNLGDIGGIPRVLDAGQCNDSYSLAVIALKLKEVFGLADINDLPISYDIAWYEQKAVAVLLALLFLGVKGIRLGPTLPAFLSPTVAGVLVDKFDIKPIGTVADDVAAMMAGK

SEQ ID NO: 13201 - protein, 398 aa, Brassica napus
MALQAASLVSSAFSVRKDGKLNASSSSFKDSSLFGASITEHGSSSLRFKREHSSRNVLAVRAQTAATSSPSVTKSSSGGKKTLRKGNVVVTGASSGLGLATAKALAETGKWHVIMACRDFLKAERAAKSAGMPKDSYTVMHLDLASLDSVRQFVDNFRRSEMPLDVLVCNAAVYFPTAKEPTYSAEGFELSVATNHLGHFLLSRLLLDDLKKSDYPSKRLIIVGFITGNTNTLAGNVPPKANLGDLRGLAGGLNGLNSSAMIDGGDFDGAKAYKDSKVCNMLTMQEFHRRYHEETGITFASLYPGCIASTGLFREHIPLFRTLFPPFQKYITKGYVSETESGKRLAQVVSDPSLTKSGVYWSWNKASASFENELSEEASDVEKARKVWEISEKLVGLA

SEQ ID NO: 13202 - protein, 411 aa, Zea mays
MNALAATSRNFKQAAKLVGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRRVLFATEALLAEHGKGIAGQRFVIQGFGNVGSWAAQLISEAGGKVIAISDVTGAVKNVGGLDIAEVVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELQTYMTRAFGDVKQMCRSHSCDLRMGAFTLGVNRVARATVLRGWEA

SEQ ID NO: 13203 - protein, 358 aa, Lactuca sativa
MALLSDLVNLDLSSITDKIIAEYIWIGGSGMDLRSKARTLSGPVSDPSELPKWNYDGSSTGQAPGEDSEVIIYPQAIFKDPFRRGNHILVMCDAYTPAGEPIPTNKRAAAAKIFSNPEVEKEVTWYGIEQEYTLLQKDTNWPLGWPLGGFPGPQGPYYCGIGADKAFGRDIVDAHYKACLYAGVNISGINGEVMPGQWEFQVGPSVGIAAADQIWVARYILERITEIYGVVVSFDPKPIPGDWNGAGAHTNYSTKTMREEGGYEVIKKAIEKLGLRHKEHIAAYGEGNERRLTGRHETADINTFLWGVANRGASIRVGRDTEKEGKGYFEDRRPASNMDPYVVTSMIAETTILWDNKS

SEQ ID NO: 13204 - protein, 355 aa, Zea mays
MATPDDGPAPAGGRKFWRSVSWSEAREPPPPAPPDVAGGQSRRGLPPPPLTPRSMSSKARSCLPPLQPLAITRRSLDEWPKAGSDDVGEWPNPTTPGASRAGGGGGGPSPAKPGEGLRLDLSSLRSQGRKDQIAFFDKECSKVADHVYLGGDAVAKNRDILRKNGITHVLNCVGFVCPEYFKSDLVYRTLWLQDSPTEDITSILYDVFDYFEDVREQGGRVLVHCCQGVSRSTSLVIAYLMWREGQSFDDAFQFVKAARGIANPNMGFACQLLQCQKRVHAIPLSPNSVLRMYRMAPHSQSFKAFWHGINTLSFQDLFYSRKERRLHTSKATISPKGSCIATKGAVYCIATKGAI

SEQ ID NO: 13205 - protein, 112 aa, Rhodobacter sphaeroides
MKKIEAIIKPFKLDEVKEALQAAGVQGLSVTEVKGFGRQKGHTELYRGAAYVVDFLPKVKIEVVLADDMVEAAVEAIVSASRTDKIGDGKIFISPVEQAIRIRTGETGEDAV

SEQ ID NO: 13206 - protein, 1423 aa, Ashbya gossypii
MAFLKRLNVSSHSRSSSGSSGRTPQNTSGGSKATAVKPLPQIPVEMGGIESEVIKNGEGGQSVVILCDDVGSGSYTSVLLSPSDPHMFSADGQRLSVEEQAEKTLYSWDVTDPEQWTMQRVMSWFKAHDFDEQWILFFKRNHISGKKFLQLLAHDNFNKYESFLSATKNSSYNRFQHLLKRTLEENVSNSHRRQRSNKSNDSKGSADCSLRYRRRRSVASEQRTLTAAEGVTPRKTVEVADDRAGSSKNHRKAKSASVLYRRSFISLRSSSSSNIKNDVDDDCKTLPAMKISIPPRPFSSIERSTSSSPASTLKSQSSPLSPGNHNMFRKDHKSSSSDSSLFNNLFGSADEITKAVGGTAPQGEQIAVKKYNDTLPSPMRVSPRHIDDKSTIWDKLKKRALPSTEQYTPSRIKQLTSGRNSSYIQTLQESPDECSANNEDPPATATLEAPIIDDLVLEEKHYPSQKQDSSAQYVLVTKDNRIFLPLNIAPYKTTQELKDGMTAFLGISSKAYTIHLTDLGCDPGVSLSDDVIAAIGQRKLNTRHLKFYVKDATRMHLRLKNDSFTSDHNITTEMSRSKGSLRSAASSFISSNDDTNSFSDITSIDEHGNITGRRVYPQTPSHYYDQSAATHSPEVDYWNIKERLSEGTSPMNISLLRSTTKAASLPSSIDEIKKSSFKVIRKASVTDIDFNKGRESPYIRPKLAPKREAPRPPRTSSQVSLASSSSIQSSLVEQKSISNSPTKPQRQHAGTYVKNKTRPPPPPSIGSTMTVDTKVMTSVSDSPVSNEPPNRPYGPFSTQKLVPQGFKGVGVHPGTRKVEEQMHTNPVTQYIQKQRSRNSISKMGNNPSLYSPPRLKKRISTRRMVSSTSAADIFDENEISFADAPDLSDYDSENSESSDDIIWSTTNTTSLDASKISVSDSTTGDDSNFSVASSVELQSSIKNDAKTSEDSIVDSIKEEGDSVCNLVGRKMTLRPTTEVVYQNLEMFFPGTDLDKPILEGLTPPASPDSEANKMPDQDLTPLSKVSTISSESSMRQSTPRLLITKKSDSPQPMPVRNLKPPKRTKTIRSIAREASEARKKSLYNNLKRQNTKMWGTRVVEVTDKRMVSINKSKNSKGEYREFAWIKGEMIGKGSFGAVYLGLNVTTGEMMAVKQVEVPKFGSQDETTVNNAEALISEVSTLKDLDHLNIVQYLGFENKNCIYSLFLEYVAGGSVGSLIRLYGHFDEQLIRFLTTQVLEGLAYLHLRGILHRDMKADNLLLDNDGVCKISDFGISRKSNNIYSNSEMTMRGTVFWMAPEMVDTTQGYSAKVDIWSLGCVVLEMFAGKRPWSNLEVVAAMFQIGKSKSAPPIPEDTLPHISQDGRAFLDDCFMIDPEERPTADTLLSHPFCQVPKEFNFRDTDLYNFIKQNDKLNNSKLTRNSQR

SEQ ID NO: 13207 - protein, 195 aa, Triticum aestivum
  misc_feature (150)..(151): Xaa can be any naturally occurring amino acid
MVSEAANAGIDRVLWTEAEIATRVAEVASELAADISRLAEPAVVVGVATGAFLFLADLVRRVDAPLTVDLVRVESYGDGTESSGRPRVTADLKVDVAGKHVVVVEDIVDTGNTVSCLIAHLQKKGALSISVCTFLDKPARRTVDFQLVGXXKFYRGFECPDSFVVGYGMDYAELYRNLPYVGVLKPEMYSKKTDN

SEQ ID NO: 13208 - protein, 220 aa, Galdieria sulphuraria
MMMTFVQPCRLFTGRWNPLIKVRSNSCCVATNLYFLRASASLPQKSKAIPFLDRPPALDGSMVGDVGFDPLNISSYLDLRWLRESELKHCRIAMLAVVGWFVQEVFHLPNQIYSASDPTEAFWKTLATGPMGQIVLWTSFFEIISTPAVIQMLQGSGREPGYFGFDPLGLGKNPQLYKRFQLSELKNGRLAMIAIGGLIHQSFLTHMGAIQQLQQHKWFP

SEQ ID NO: 13209 - protein, 66 aa, Glycine max
MARCFGLGSVLVLAALAASMVVLPLMLPPLPPPPLVLLFFPVGIMAALMLLAFSPSDQNGVVYAST

SEQ ID NO: 13210 - protein, 566 aa, Schizosaccharomyces pombe
MNELHDGESSEEGRINVEDHLEEAKKDDTGHWKHSGTAKPSKFRAFIRLHFKDSRKFAFSRKKEKELTSEDSDAANQSPSGAPESQTEEESDRKIDGTGSSAEGGDGSGTDSISVIKKSFFKSGRKKKDVPKSRNVSRSNGADTSVQREKLKDIFSPHGKEKELAHIKKTVATRARTYSSNSIKICDVEVGPSSFEKVFLLGKGDVGRVYLVREKKSGKFYAMKVLSKQEMIKRNKSKRAFAEQHILATSNHPFIVTLYHSFQSDEYLYLCMEYCMGGEFFRALQRRPGRCLSENEAKFYIAEVTAALEYLHLMGFIYRDLKPENILLHESGHIMLSDFDLSKQSNSAGAPTVIQARNAPSAQNAYALDTKSCIADFRTNSFVGTEEYIAPEVIKGCGHTSAVDWWTLGILFYEMLYATTPFKGKNRNMTFSNILHKDVIFPEYADAPSISSLCKNLIRKLLVKDENDRLGSQAGAADVKLHPFFKNVQWALLRHTEPPIIPKLAPIDEKGNPNISHLKESKSLDITHSPQNTQTVEVPLSNLSGADHGDDPFESFNSVTVHHEWD

SEQ ID NO: 13211 - protein, 335 aa, Unknown
  Nocardioides sp. JS614
MSAGKVAVFSAGSWGTAFSIVLADAGNDVTLWARREEVAAAITEQRENPEYLPGVELPPQVSATHDVEKALHGADLVVLATPSQSLRANLSEWAPYVEPNAVLVSLMKGVELGTLERMSQVIAEVTGAGPERIAVISGPNLAKEIARREPAASVVACEHEEVARQLQARIHSPAFRPYTSVDVLGCEVGGAYKNVVALSVGMAVGLGFGDNTTASVITRGLAETARLATALGANPMTLMGLAGLGDLVATCSSPLSRNRTFGEKLGQGMTAAEIYATTRQVAEGAKSCASLLALAERTGVDAPIAHHVTAVVDGRMTAQEMMDSFIARDTKAETD

SEQ ID NO: 13212 - protein, 139 aa, Porphyromonas gingivalis
MKEKEYLFSLDMKVRDYECDLQGVVNNSNYQRYMEHTRHEFWESLGDNFGQMHEKGLDAFVYKVTITFKQSLRSGDRFRSCLTCHKKGPKLIFMQDIIREDGVMAARGEVEVVAVQDGVLTRGEYFDVLMKDILSKTTK

SEQ ID NO: 13213 - protein, 324 aa, Dechloromonas aromatica
MSKWFADNSQSIGRTPLIKLNRVIDGAKATVLAKIEGRNPAYSVKCRIGAALINDAEKRGLLGPGKELVEPTSGNTGIALAFVAAAKGIPLTLTMPETMSIERRKLLTAFGAKLVLTEGAKGMSGAIAKAEEIAASDAKYVLLQQFKNPANPAIHELTTGPEIWDDTDGAIDILVSGVGTGGTITGVSRYIKNTKGKAIQSVAVEPTASPVLTQARAGEPIKPGPHKIQGIGAGFVPAVLDLSLLDAVEQVSNEDAVLYARRLAKEEGIISGISSGAAVAAAARLARIPENAGKTIVAILPDSGERYLSSILFEGLFNEAGLAA

SEQ ID NO: 13214 - protein, 309 aa, Mycobacterium tuberculosis
MSAGQLRRHEIGKVTALTNPLSGHGAAVKAAHGAIARLKHRGVDVVEIVGGDAHDARHLLAAAVAKGTDAVMVTGGDGVVSNALQVLAGTDIPLGIIPAGTGNDHAREFGLPTKNPKAAADIVVDGWTETIDLGRIQDDNGIEKWFGTVAATGFDSLVNDRANRMRWPHGRMRYYIAMLAELSRLRPLPFRLVLDGTEEIVADLTLADFGNTRSYGGGLLICPNADHSDGLLDITMAQSDSRTKLLRLFPTIFKGAHVELDEVSTTRAKTVHVECPGINVYADGDFACPLPAEISAVPAALQVLRPRHG

SEQ ID NO: 13215 - protein, 427 aa, Triticum aestivum
  misc_feature (176)..(176): Xaa can be any naturally occurring amino acid
MAPEPEDDIMAEKNPRPLDEDDIALLKTYGLGPYSTSIKTAEKEIKELAKRINDLCGIKESDTGLAPPSQWDLVSDKQMMQEEQPLQVARCTKIINPNTDDAKYMINVKQIAKFVVGLGDKVSPTDIEEGMRVGVDRNKYQIQIPLPPKIDPSVTMMTVEEKPDVTYNDVGGCKEXQIEKMREVVELPMLHPEKFVKLGIDPPKGVLCYGPPGTGKTLLARAVANRTDACFIRVIGSELVQKYVGEGARMVRELFQMARSKKACIIFFDEVDAIGGARFDDGAGGDNEVQRTMLEIVNQLDGFDARGNIKVLMATNRPDTLDPALLRPGRLDRKVEFGLPDLEGRTQIFKIHTRTMNCERDIRFELLARLCPNATGADIRSVCTEAGMYAIRARRKTVTEKDFLDSVNKVIKGYQKFSATPKYMVYN

SEQ ID NO: 13216 - protein, 281 aa, Zea mays
MAQELHETSSCSATTTSSCTTSCCSSTVTDSSSSPPSPAAANAAPATRKRQALEAEAEAEAGGEEEEEEEEGCAGNKAAPAKKRPRGSEGKHPTFRGVRMRAWGKWVSEIREPRKKSRIWLGTFPTAEMAARAHDVAALAIKGRAAHLNFPDLAGALPRAASAAPKDVQAAAALAAAFTSPSSEPGAGAHEEPAAKDGAAPEEAAADAQAPVPVALPPPAASRPGTPSSGVEDERQLFDLPDLLLDIRDGFGRFPPMWAPLTDVEDVVNAELRLEEPLLWE

SEQ ID NO: 13217 - protein, 112 aa, Xanthobacter autotrophicus
MKIVMAIIKPFKLEEVRDALTGIGVHGLTVTEVKGYGRQKGHTEIYRGAEYAVSFLPKLKIEVAVSADQVSKVVEAITASAKTGQIGDGKIFVLPIEHAVRIRTGETDADAL

SEQ ID NO: 13218 - protein, 251 aa, Magnetospirillum magnetotacticum
MCIGSDPMLEDGIMSDRRGGTGGLRGDLKQRVKTGRGRTLSQKRWLERQLNDPYVARAKREGYRSRAAFKLIEIDERFKLLKPGQRIVDLGAAPGGWSQVAAKIVGENGCIVGIDLLEIEPMAGATFITLDFLDESAPARLHELLGGKADLVLSDMAANTTGHKKTDHLRTIGLAETAAAFAAEILAPGGAFLAKVFQGGTEGELLADLKRDFAVVRHVKPAASRADSSELYVLATGFRGRAAGDAASDEA

SEQ ID NO: 13219 - protein, 116 aa, Pinus pinaster
TVFTVILYGSPLSVIRLVIHTKSVEFMPSFYFSLFAFLGSVLWMVYGALSGDILIMAPNFVGIPLGLSQMALYCIYWNNSPVRVEATKLEAGGELKSIEQNIKEDIELYTEDIEKA

SEQ ID NO: 13220 - protein, 412 aa, Rhodococcus erythropolis
MTSDIVVIGGGVAGVSAVQSLRSEGYDGRLFLIGKERELPYDRTSLSKAVLAGDLADPPPLAPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTALEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 13221 - protein, 534 aa, Streptomyces wedmorensis
MTIGSLGSTEFALHGKPAIRWGDLPQRVGKPETRRYQKVLLLNPSATLFRHDLPRCTYPLGLGYIAAVLEKYGYEVKILDVFAEGYYNAQPVDGDDQFLRYGLSDDDIVKVMKEFGPDVVGISSIFSNQADNVHHLLKLADLVTPEAVTAIGGAHARYFPKACLDDPNLDAVFLGEGEMTFLLWMEHLNGNVSDDEVHGIAWRDRDGKVQIKPELPLISSMRPEGPETGKSSPMLSMAGELDHIPFPAWHHYNMEKYFEIKAYQSPYTVGSRVGQLYTSRGCTAHCTFCTTTHFWGQKLRRRSVQDVVDEVLRLRDEYGIDEFHIQDDNITNDMDHARELFRAFKEVGLPWATPQGTALWRMDEELLDLMAESGAYQVTFAIESGVQRVLKELIKKPLNLERTSHLIKYARSLGMHVHGFFIIGMPPMCGNAGESIEEMQASYDYAEEAGFSSASFFAASPIVGSELLRECIRQGFVDPEESLYRMTYKQGIINVPGLWDGEEIAELAAKFNRDFNARRDRAYTPQKQWNANQY

SEQ ID NO: 13222 - protein, 313 aa, Zea mays
MSMLLQPQPHQQQQPPSPSSHSHPASMAAAAAYWLAEHPAIVGFRWSPTHLWFSTWAFLLGSLAAYVALCLALDVALALAAQRLRRRLAVPLGPVPAAHALLMAGASSAIFAGTLLSAVAEIRDTRWSWRGRSRSTPLRWLLCFPPGTRSSGRVFFWSYAYYLSRYLHAARGVLAVLRRRRSAAPRVFAHAASVAMAFLWLEFSQSFQVLAILASTLTHAVALGYRFWVGAGLPARGAAHVALACQLGLLGCNLACHVGVVWMHFGAVGGGCSGIGAWVFNTLLNAALLWVFFHCYGKRGVDEGSGAASTKDL

SEQ ID NO: 13223 - protein, 371 aa, Kluyveromyces thermotolerans
MSAADRLNQTHDILSESVQAVENPFKVTVIGSGNWGTTISKVVAENAALRPHLFVKRVDMWVFEETVDGQKLTEIINTKHQNVKYLPNIDLPENLVANPDLVSAVKDADILVFNIPHQFLPRIVSQLQGNIKKDARAISCLKGFDVSKDGVKLLSTYVTEKLGITCGALSGANLAPEVAKENWSETTVAYELPKDFKGEGKDVDHAVLKALFHRPYFHVNVIDDVAGISVAGALKNVVALGCGFVEGLGWGNNASAAIQRVGLGEIIKFGQMFFPDSRVETYYQESAGVADLITTCSGGRNVRVATHMAKTGKSAEECEKELLNGQSAQVFTHVRRSTSGWPSAVRPMNSFCSRPFTRLSTRTLLWTLCQT

SEQ ID NO: 13224 - protein, 1271 aa, Unknown
  Mycobacterium sp. JLS
MAVTRTACSYCGVGCGIEVHTGSEGGRPVIARVSGDRLHPTNSGRLCTKGATHAEMMNATDGRLTSALLRPTRHEEPVPAPVDDAVAEAGRRLRAIIDEHGADAVALYVSGQMSLESQYLATKLAKGFLRTKYLESNSRLCMASAATGYKQSLGADGPPGSYTDFDVTNLFFVIGSNMADCHPILHQRMVDRLKTGAKLIVVDPRRTATADRADLYLPIRPGTDVALLNGLLHLLVERGDIDEEFIAEHTEGWAHMPEFLADYAPARVAAITGLAEADLHRAAAMIAEAGDWVTCWAVGMNQSTHGTANTNAICNLHLATGAICRPGAGPMSLTGQPNAMGGREMGYMGPGLPGQRSILSAEDRAFVEQRWGLPPGTIRTDAGPGAVDMFERLAAGEIKACWIICTNPVATMPNRRTTIAGLEAAELVITQDVYRDTATNRYADIVLPATLWAESDQVMVNSDRTLTLLQQAVPPPGQTRPDWQLICRIAAELGFGADFTYTDSAQIFDEIREFSNRRTGFDLRGATYDRLRETPLQWPVPPDDGADRHPIRYLNDGVSQDLHVDASGHRPRLAFPTPSRRAVFYARPHVDAAELPDGDFPFVLNTGRLPHQWHTMTKTGRVRALVKLDGRPFVEVHPHDAAALDIVDGQSVELTSRRGRAVLPAVVSDRVMPGNCFAPFHFNDEHGEYLTVNALTNDAVDPDSLQPEFKVCAVALRPVQTVAAPTEERRTPAPEPVASDGPLVLWASQTGTAEDFATDVAARLPGAQLVTMDELPLLRLAEARDVVVITSTFGDGGPPDNGADFFDRLQGPDAPKLDHIRFAVLGIGDRSYSDFCGHARSLDGRLASLGATRMLDRVDCEAYDQDRMEHWAQQMTHLLNPDGVDSDGGGVTTRRRTTTVAEPFTRARPLLAPLARNTLLTPAESRKEVRHFGFDISEYDVTYAAGDSLGVYATNSAVAVDAWLAATGLDGSEKVDVDGAEHSLRDALTVSYDFCRVTPDLMRFVAEQCRDRSAAKRLRAARADLDAWLVDRNGLDVVREFEVRADPRQWQEVLVRLTPRQFSISSSPLVSPHEVQLTVSVVRYRGSDGGERGGVASTFLADRATAPLPVFLQRSPHFRPPRDGVTPMIMVGPGTGIAPFRAFLQERRALGHTGPNWLFFGDRHRDENFYYRDDLEDMVTDGFLRLDLAFSRDQPKPVYVQHRMLEHGAEVWRWLERGAHLYVCGDAARMAKDVDAALTTIIRKHGGLSESAAREYKKSLVAGKRYLRDVY

SEQ ID NO: 13225 - protein, 112 aa, Triticum aestivum
MIHWSSKAGYIASVYERSGILRYALGALRGSWGHSKGDVRIKVNGVEWRTPDRDSALRVAYAKVDRGDRKSSAPVDPCSSDPQDDNIQDFQAVSCLPDQHRPYGGPQVTVNS

SEQ ID NO: 13226 - protein, 143 aa, Pinus pinaster
MQHTGSPLLSFMAQQGSSHSPQAPTAGTIRLTKNFQRFSQHRWRAMAENPTVDYDSSAKSVFPAEACDTVGGEACEGEIGVEVTLKADSPSPSSPPAEGVDREYVEYASEKKTVFPGEACDDLGGDSASQNIRVALQREQPAK

SEQ ID NO: 13227 - protein, 559 aa, Legionella pneumophila
MCSIGEYLAKRLEELNISEYFAIPGDYNLILLDEVLKNEKLKMINCCNELNAGYAADGYARVKGVSALFVTYSVGGLSTVNAVAGAYAENLPILVISGGPNTNSIQDAEILHHTLATEDNLYVRDIFSRITAHVVCIRKPEQAAMQIDEAIAIAIAKKKPVYIEIACNIANYPISKPTQRAFNTYKISDSSSLAAAVEHAAEKLNSALKPSLIVGSKVRHCNAINSVSELAKCTGYAMAAMPDAKGFISEQHPNFIGIYWGPVSSSGCAEIIDSSDAYLLIGPNENDYTTVGYVWGINPHKSIKTTKGGVIIGETVYTNIFMNDFLRELSKKLKFNDASYKAYKRIAEETVVYPELDQPDAPLSSRYLFGQIQKMLSDKKALLAETGDSWFNCMRLSLPEGCPFEIQMQYGSIGWSVGALLGMQAALHNQKRVIACIGDGSFQMTAQEISTMIRYGYKPIIFLMNNACYTIEVQIHDGPYNVINNWRYAELVNVFRGEQSNAKSFVVKTNKELLTAIKQAEKTDALCFIEVFLDKDDCNKNLLEWGSRVANYNSRPPRR

SEQ ID NO: 13228 - protein, 219 aa, Methanococcoides burtonii
MASDILDKKAILQRDRESYAIVPHTPAGIISADELQCVVDVARKYGATIKFTSAQRVALIGLKENDLEDAWSELGMKPASSIGRCVRSIKVCPGITNCKRAQQDAMALGLKLDELYHGIELPSKFKMAVSGCMNSCSGPAVKDIGVMGTPRGFTLLAGGNAGIRPRIGDVIAEGLDEVEALEMVGRIIEFYMRSAKKYRLGRLIDDIGLDVFKNEVRIV

SEQ ID NO: 13229 - protein, 99 aa, Odontella sinensis
MATYKVTLLSEEHDIDATIDCNDDVFLLDAAEEQGIELPYSCRAGACSTCAGKVTEGDIDQSEQTFLDDDQVGAGFVLTCIAYPKSDCTVLVHQEDELY

SEQ ID NO: 13230 - protein, 256 aa, Novosphingobium aromaticivorans
MSNSSSRIGTVHLVGAGPGDADLLTLRAARLVMNARVLVHDGLVDPSILAMAPKGCRMISVAKSRSRHTMKQGEINALLVREALAGNDVVRLKGGDPFVFGRGGEEAEDCLAAGVPVQVVPGVSAAMGAAAAAMIPLTHRESASIVSFVAGQCKGLTDQNWAGLAGVGRTLVIYMGVATSEAIAEKLMADGLAPEMPVAVVENAARPQMRVLRGTLAGLGCLVADNKVRSPALIVIGEVAGRGDMMELRQVLEAAR

SEQ ID NO: 13231 - protein, 261 aa, Prochlorococcus marinus
MKDKQLGTVYLVGAGPGDPDLLTVRAHRLLSQCDVLVYDALVPDEILKLVKKDCKSIFVGKLRGHHSTSQLKTNALLLELVKKNKCVVRLKGGDPFVFGRGGEEAAYLHKNGIGVEVVPAITSGIAASAYFGIPLTHRIASSSVTFVTGHEGIDKRRPSVNWKALAKASNTLVIYMGVHNLSYIVKELLAAGLSPKIPSAVIQQATVNGQRCLRTSLDSLVKEVKEQEFISPSIIIIGETINFQIEACAPSPAKVTMPISF

SEQ ID NO: 13232 - protein, 207 aa, Unknown
  Azoarcus sp. EbN1
MKRTKTSKAWMQEHVNDPYVQRAKSEGYRSRAAFKLIELDDRDRLMRSGMVVVDLGAAPGSWSQVALRRVGREGRVFALDLLPLDPLGGVEFIQGDFQEEPVLAELESRLGGLPVDVVLSDMAPNMSGIDTTDQARSIYLGELALEFAGHHLKPGGGFVVKVFQGQGFMEYRNEAAKHFHALHVRKPKASRDRSAEVYLVGVGYRGS

SEQ ID NO: 13233 - protein, 414 aa, Burkholderia xenovorans
MNAPVPIEVLRQHLIDPEICIRCNTCEETCPIDAITHDDNNYVVKADVCNGCMACVSPCPTGAIDNWRTVLKADAYSIDEQFSWDELPAQNTTANAALDATAQANGDDETGETASGIEVDAARGSTVPPWSAAKPYVNLYTHKAPTTATVVGNYRLTDELADSDIHHIVLDFGTLPFPVLEGQSIGILPPGTTKDGKPHHARQYSLASPRDGERPRYNNVSLTVKRVTRDYQDNATDGVCSNYLCDLKKGDKVTVIGPFGSTFLMPNHPDSHLLMICTGTGSAPMRAMTEYRRRRRLKGATGKLMLFFGARTKEELPYFGPLTNLPKDFIDTNLAFSRTPGQPKRYVQDAMRERAVDIAQLLKSDGTYIYVCGLKGMEDGVLQALQEIAERNGLDWATLWPRLRREGRLHLETY

SEQ ID NO: 13234 - protein, 421 aa, Oryza sativa
MAAHRVGRCMLLQPPRLATCVLFLLLPLLLPCSASSSVITHLPGFHGRLPFHLETGYVGVDEETGTELFYYFVESERSPSTGPVILWLTGGPGCSGFSGVVFEVGPMKYVLEPYNGSLPRLVYNQYSWTQMASILFLDTPVGSGFSYAHDPKGYNVGDISSSLQVVTFLKKLQGYIVGNPITGSKIDDNFKIPYSHGVGIISDQLYEAAVANCNGDYVTTTNELCAKALNAIDNLMSEVDYGNILDDKCVRATPKPINEVSRSRSLQEDYIRLSEPTVRPTINCFSYRYYLSFLWMNNNLTREALKIKKGTVGEWIRCKTGLPYVQDVASSIKYHFDLTTGGYRALVFSGDHDLILPFLSTQAWIRSLNFSIVDEWRAWHVDGQAAGFTILYANNLTFATVKCPALHNSHTGFLKNPKQGL

SEQ ID NO: 13235 - protein, 120 aa, Hyacinthus orientalis
GSNYYACLSMLSLLILTPFAIAERAPSMWAVGWQNAMSQIGPNFIWWVAAQSIFYHLYNQVSYMSLDEISPLTFSIGNTMKRISVIVSSIIIFHTPVQPVNALGAAIAILGTFLYSQAKQ

SEQ ID NO: 13236 - protein, 609 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAALEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 13237 - protein, 551 aa, Colwellia psychrerythraea
MDIKKLSSLAHCAKTRSIVSLFDQKERANDFSLSTSHLYLDYSKQNITDVELEQLIEIAEDVGLSESITGQFNGDKINNTEGRSVLHTILRAPQVIKQQILGDTLANEVEAAELQMAKVVNDVQKGILTSHTGQRFTDVLAIGIGGSYYGVKVSLSALEHYRDLALSVHVIANVDGGALEEKLKTLNFETTLVVVISKTFTTQETMLNAKAVKQWMLSCASVKDLELNNVPLIIEKQWFAVSSNIEAAKEFGINIKHILPMWDWVGGRFSIWSTVGLPLALAIGNDNFNKLKQGAYEMDVHFKSTDFKNNMPVIMALLGIWNRNALEYPTLAILPYAHSLRALPGYLQQTDMESNGKSVSKSGDKLSWLTAPVVFGQEGTNGQHAFMQLMHQSDDIIPTDFIVALKGRSQYTENHKVLVANCFAQSEALMQGKTLTQVESELEMSALSTAEISLIAPHKTMKGNTPSNTLVMDLLTPETIGSLLALYEHKIFVQGVLWQVNSFDQWGVELGKQLGTRILSAIDGAEDDLLSASSQSLIARFRARSNVTPSV

SEQ ID NO: 13238 - protein, 145 aa, Triticum aestivum
  misc_feature (15)..(15): Xaa can be any naturally occurring amino acid
  misc_feature (89)..(89): Xaa can be any naturally occurring amino acid
MASSMISSPAVTTVXNRAGAGMVAPFTGLKSMAGFPTRKTNNDITSIASNGGRVQCMQVWPPVGKKKFETLSYLPDLDDAQLAKEVEYXLRKGWIPCLEFELEHGFVYREHNRSPGYYDGRYWTMWKLPMFGCTDASQVLKELQE

SEQ ID NO: 13239 - protein, 422 aa, Rhodococcus rhodochrous
MSAAEVVVIVGAGLAGARAAETLRGNGFAGSIVMFGDEPTAPYHRPPLSKSLLVDEPEMSTLLVHPEGWYHDHDVELRLGRKIARVDVSSRRLQDVLGHSHRFDKLILTTGAAARTFEGSRSDAQSRVLVLRTLSDAARLRTQLATAQSVVVVGGGFIGAEVASGAVGLGHSVTILETAEGPFLRSLGGAASKILSSFYRSEGIVLVTSVNIASVCESEDSVTVTATDGRRWDADLVVMGIGAVPADELAADSGLSTGNGVQVDAHGRTTVPFVFAAGDVANRFEPTLGRHIRPEHWQNAQNHAVAVARNVLGANEAFSEVPWFWSDQFSVNLQMAGVPYAVDEVVVRGVPDDRRFSIFYLSRSRVVAAFSMDNARDIGVAKRMIGRRIAVDAAALADEGTDLKSLLRVREEQVFASSKRRE

SEQ ID NO: 13240 - protein, 536 aa, Unknown
  Synechococcus sp. WH 7805
MHLVMSFPDFSATDTQIQWQRFCDLLWYHDDLGIWLDVSRMHLNSAALDELTPPLEKAFDAMKKLEGGAIANVDENRQVGHYWLRDPRLSPDPEVSQHIASEVNDIEQFGKAVISGEIKSPTGQPFTDILWIGIGGSGLGPLLMVRALQDNGQGLPFHFFDNVDPNGMSRVLGELGNNLLTTLVVTVSKSGGTPEPHLGMEQARHRLESLGGQWAAQAVAITMSQSLLDQQASKEKWLKRFDMFDWVGGRTSITSAVGLLPGALIGTDIRDFLAGAAQMDEATRLADVRRNPAALMAAAWYFAGEGKGKRDMVVLPYRDRLEVFSRYLQQLVMESLGKRLDRSGAIAHQGIAVYGNKGSTDQHAYVQQLRDGVDNFFVTFIEVLRDVEDIPEIKGERPGDFLDGFVQGTRSALTEGGRQSLSISMRTFDARRLGALIALFERAVGFYGELVNINAYHQPGVEAGKKAAAAILKLQKQVEDVLSDGTSRSVLEIQQAIGEGSDEAIFWILRHLTGNNRGYQAQGTWDSPASLRFVKG

SEQ ID NO: 13241 - protein, 972 aa, Ustilago maydis
MDWDHNVTFSAVRSLQATTAVAQATDNVVDLDRNRVDSRPGVLPTKNESSPHSSASLPPPSPHPPPPPAFTPSPSPSPSPSPQTATARSSVTDAAPAPKRSPRSPLHSNGSFPPVSDPISSIDSRDALDIDHESTAMLASSSSARKSKPKLQPQLINHLPLAQQAAMATFHEITFNDYHDKKLGRPPGKFDDYMICDCTPNSGNLDMACTDYSGCINRMTQIECSASKCRWGKQCRNQRFHRRQYVDVDIVQTEKKGFGLRACQDIPKETFIYEYVGEVMNQTTFLQRMQQYRIEGIRHFYFMMLQPNEYLDATKKGGKGRFINHSCNPNCAVSKWQVGKHLRMGIFAKRNIQKGEELTFNYNVDRYGNDAQECFCGEPNCVGTLGGKTQTDLSGMDDLFLDALGISDEVEQTEAKGSRRKRGKRLDLDFIPQMRAIQEHEATRVMTAARQAGPKREILEKLLRRMEMTTDVNVQKSLVKLHGFILMQFLLEQWWNDRDIVILIINVLARWPLIARNKVIDCGVEDQVRILAQTYRPRSPEDQKPSLDALRQVKQDDSAADRNDYTQVQPTLAPVRIGAPPAPDAEVSARAEHLLEAWKKLDMTYRIARKDALKPDADDHKDATAVTTWIDRRRMQDLDDPLDLEHAQAPNAVSSELGNALSGDQELREIKPSWQPPPAPPSMPNAPAKRMGGAVHHRSPPGSFTPTRLQSSGQSPLTPDQVTSVLSSSLVKSLSGLVSSLKQQGIQLQQQQQQQPPAQQQPSAQPAAPSAKSIEDIIREANEQEERARKEAEAAAKAARELEVNGGQTSGSSRKRPSSASRHSDKRAKHSSLSSSSQAASKLISSNGSAADSTSKAGSVESVAANERRLRKLVGELVVRQMSKYKDDLERESFKRHAKELTNAIVGKEMRNPKSWPPARGALTELSLDKRAKIKAFAKEYIDKLLARKGKGKGSSTPSNNEGAGSSNNGIV

SEQ ID NO: 13242 - protein, 403 aa, Listeria monocytogenes
MSSTKSIINKKTLLFGLISVFLCGMGFSIIMPVVPFLVTPYVTNASDQALMVTLLTSVYALCVFFAAPGLGALSDRFGRRPVLLICFIGSAIGYFIFGLGGALWVLFLGRIIEGITGGSISTLFAFFADITPQEERTKYFGWVSAAAGAGAALGPAFGGLLAHFGYAMPFFFGAAITFINFLFGYFYMPESLEEANRLKRIPLMRLNPFSQLLNILTIKNLGRLLIAAFFIWVPNGSLQAVMSQFAIDSFSWKPALIGMMFSIMGIQDILSQAFVMPKLLLKLTDKQIAILGMIAEIIGYLLIAASSIFTLAPLLVIGMFVFGFGDSIFGPSFNGMVSKSASASEQGRIQGGSQAIQSVARIIGPVIGGQLYITLGHAAPAVMGVLLITVAIFILYKKTSLAK

SEQ ID NO: 13243 - protein, 472 aa, Unknown
  Synechococcus sp. WH 5701
MSKAHFGLIGLGVMGENLVLNAERNGYSSVVFNRTYAKTEDFLKGRAAGLNIIGAHTLEEFVGALERPRRILMMIKAGSPIDAMIAQISPLLEDGDLLIDGGNSLYTDTERRVKELESQSFGYIGMGVSGGAKGALEGPSMMPGGTKAAYDAIEGLVRKMAAQVDDGPCVTYIGPGGAGHFVKTVHNGIEYGIEQILVEAYDLMKRCAGMDGLAMAQVFDGWNQLEELSSYLVEITEVCLRTRDPEDGGDLVEKILDVAGQKGTGLWTVVSALEMGVPVPTIYAALNARVMSSLHSERLAAASVIDAPAAAAAVSLGEPSKGMPALRDAITLACIASYAQGMALMVEASALHEYHLNLSSIAQIWKGGCIIRAKLLQRIQNAYDTNPDLANLMVDPWFAEQVNARLSGLRQVVAGAALAGIPVPCLSSTLDYIDSYRTARLPQNLLQAMRDCFGAHTYQRVDREGSFHTEWL

SEQ ID NO: 13244 - protein, 550 aa, Salmonella typhimurium
MFCVQCEQTIRTPAGNGCSYAQGMCGKTAETSDLQDLLIAALQGLSAWAVKAREYGIINHDVDNFAPRAFFSTLTNVNFDSPRIVGYAREAIALREALKAQCLSVDANAHCDNPMADLQLVSDDLGDLQRQAAEFTPNKDKAAIGENILGLRLLCLYGLKGAAAYMEHAHVLGQYDNDIYAQYHKIMAWLGTWPADMNALLECAMEIGQMNFKVMSILDAGETTKYGHPTPTQVNVKATEGKCILISGHDLKDLYNLLEQTEGTGVNVYTHGEMLPAHGYPELRKFKHLVGNYGSGWQNQQVEFARFPGPIVMTSNCIIDPTVGSYDDRIWTRSIVGWPGVSHLEGDDFGPVIAQAQQMAGFPYSEIPHIITVGFGRQTLLGAADTLIDLVSREKLRHIFLVGGCDGARGERNYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFFTPDLLAILNEKFGLRSVTTVEEDMKQLLSA

SEQ ID NO: 13245 - protein, 280 aa, Glycine max
THLPLIKEITTTPPPPPRDVVLKTREKIPCKLVSKTSISHDVRLFRLGLPSKDQLLGLPVGKHIFLCATINEKLCMRAYTPTSSVDEVGFFDLAIKVYFKGVHPKFPRGGLMSQHLDSLSIGSVLDVKGPLGHIEYTGRGNFLVHGKQRFAKRLAMLAGGTGITPIYQVAQAILKDPEDPTEMHVVYANKTEDDILLKEEMMCGEEQCDRFKVVVRVETAREGWEYSVGFITESIMREHLPETSTDALALTCGPPPMIQFAVQPNLEKMGYDIKADLLVF

SEQ ID NO: 13246 - protein, 200 aa, Prunus persica
DSYVLSESSLFVYPYKVIIKTCGTTKLLRSIPAILKLAETLSLAVKSVRYSRGSFIFPGAQPSPHRSFSEEVAVLDGHFGKLGLASRAYVMGSSDKTQKWHIYSASAELASLLWGARQSGPTYTLEMCMTGLNRNKASVFYKSKASSAAGMTEESGIRKILPQSEICDFEFDPCGYSMNSIEGNAISTIHVTPEDGFSYA

SEQ ID NO: 13247 - protein, 316 aa, Glycine max
MWWPFSRKEKEGSGFSSSSTAEEVTEGIDGTALTAIVTGASSGIGAETTRVLAMRGVHVIMGVKNMNAAKNIKETILKGIPSAKVDAMELDLSSMTSVRKFASEFISSSLPLNIFINNAGIFGTPFMLSEDNIELQFATNHIGHFLLTNLLLDTMKKTTHESKKQGRIVNVSSQGHQFTYREGILFDKLNDQSSYQAFRAYGQSKLANILHANELARRLKEDGVDITANSLHPGAIATNIHRYNSVLTGLPGVVKKLLSYVVKNGAATTCYVALHPQVRGISGEYFADSNIAQANSQGRDLDLAEKLWDFSMNLTK

SEQ ID NO: 13248 - protein, 245 aa, Methanocaldococcus jannaschii
MGRKDKRWVLQRKRDFYYKLAKKLKYRSRASFKLMQLNEKFNVIKPGKIVLDLGCAPGGWMQVAREIVGDKGFVIGIDLQPVKPFEYDNVVAIKGDFTLEENLNKIRELIPNDEKKVDVVISDASPNISGYWDIDHARSIDLVTTALQIATEMLKERGNFVAKVFYGDMIDDYVNLVKKYFEKVYITKPQASRKESAEVYVIAKRYTGKKWEEEDKIKRVKKVENEDNELLAKKIKEIRKLKSKK

SEQ ID NO: 13249 - protein, 410 aa, Skeletonema costatum
MKLAVTFLATIGPTGRFAPAANTVARTSALNMVQQLDLKTGQSQLDTSVVDRFSALPYPDDKVLAEYVWVDAKGECRSKTRTLPVARTEAVDKLPNWNFDGSSTDQAPGDDSEVILRPCRIFKDPFRPRAHGLDNNLVMCDTYTPAGEAIPTNTRAIAAKAFEGKEDEEVWFGLEQEFTPLQPRPTHSPRLAQEPVSQPRSGPYYSSAGPENSFGRAVTDAMYRCCLYAGLEISGTNGEVMPGQQEYQIGPCVGIDAGDQLFMSRYILQRVCEEFQVYCTLHPKPITDEDWNGAGMHTNDSTKSMREAGGLDIIKQAIYKLGAKHKEHIAIYGEGNELRLTGKFETASMDEFSFGVANRGASVRIGRDTEAEEMLGYFEDRKPQFPNADPYLVTGKRSWLPIIMEDIEVS

SEQ ID NO: 13250 - protein, 172 aa, Acidobacteria bacterium
MPNLKVLLSREQIQKRVAEIGAEISAEFQGQPVVLIGVLKGAAIFLSDLARNIALDATFDFIAVSSYGSEKQTSGEVKLNKDVDNSMEGKNVILVEDILDTGLTMSYLMKVFGAHHPKALKIAALLDKTERRKMPIRADYVGFEIPDKFVVGYGMDAAERYRNLPDICVVEE

SEQ ID NO: 13251 - protein, 369 aa, Unknown
  Synechococcus sp. WH 5701
MIKVGTSLLRGTAQRDTEAVIAGLAASLSRRRQLGEAIALVTSGAVGLGCHALGFGQRPEEVVALQAAAAVGQGRLMRLYETAFAQHDTSVAQVLLTRGDLASRRRYQNACRTLEQLLSWGVVPVVNENDTLATDELRFGDNDTLSALVAVAIGADELVLLTDVDRLYSGDPRSDASAQPIEEVRDLLELERLSGVAQGGGRWGTGGMTTKLAAARIATSSGIAVRLADGRDPAVLEALLAGERLGTLFRPSPSPLPDRKGWLAHALLPKGELLIDPGAERALIERGASLLAVGIRAVNGEFERRDAVRLLSLEGREIGRGLSALSSAEVAQVLGLSSQAAESTLEHGAGDAVVHRDHLVLTAPAAVPG

SEQ ID NO: 13252 - protein, 210 aa, Mycobacterium tuberculosis
MTTTQTAKASRRARIERRTRESDIVIELDLDGTGQVAVDTGVPFYDHMLTALGSHASFDLTVRATGDVEIEAHHTIEDTAIALGTALGQALGDKRGIRRFGDAFIPMDETLAHAAVDLSGRPYCVHTGEPDHLQHTTIAGSSVPYHTVINRHVFESLAANARIALHVRVLYGRDPHHITEAQYKAVARALRQAVEPDPRVSGVPSTKGAL

SEQ ID NO: 13253 - protein, 436 aa, Chlamydomonas reinhardtii
MRLSARTLAQRASLPARSTGVVSRRSLVAPAPARKANLATRVAAIEEQQTSFQGDEQPVEAALDPASILDVDPAAVEEMDLHELDQAQEDLLKWMMLDEATQEEDLDEMVDYDDFGDEEYADMYEEVEEMLEAVDYEFKVGDKVSGTVIEVDDDGAYVEIGAKAIAFCPVTECSFARLKTPLEALRPGMKRDFMVVEDEEEYGQVIVSLAAMEATTFWQRIRQLQEEDITVTVSVESVNKGGMLVKFGIYDGFIPVSQFGPSITPDNMESLVGFELQVKFLEVDEEAERLVFSHKRASSTVSNDIQGFKVGDVVAGVVQSVKPYGAFIDLGGVTGLLHVSQISHDRVLVLDKILQEGDKIKVMILSQDRERGRVTLSTKKLEPTPGDMLRDPQLVYEKAEEMAEQFRKRVEQAAQSAAEPQPDTLGAAPEGQPFVY

SEQ ID NO: 13254 - protein, 547 aa, Arabidopsis thaliana
MEVSNQTRKRKAIDAGHGSQPTAYRGSDGVDLSLLEALEKSSHNGVEALDLKTLKKLVLSFERRLRDNIAARLKYVENPEKFADSEVDLHDDLQKLKVLAGAPELYPDLVASNTVPSIVNLLSHENSDIANDVVQLLQDLTDEDALEDNDEPARVLVDALVENNVLELLVQNMNRLSEADPDEATAIYATLTVIENLVEVKPAVAQLVCERTKLLRWLLTKIKVREFEGIKQYASEILAILLQNSTANQKRLGQMNGVDAVLEGAAMYKSKDPKTPDEEEMLENLFDCLCCLLMPLENKERFVNAEGVELMIIIMKQKKYAYGSAIRALDFAMTNYPPACERFVDVMGLKTAFAAFMGKIPLNKRIKRERYKEELEERVISLIASLFAGILRGSRRDRLLSKFVENEFEKIDRLMELYLRYSDRVRSEAERLDQLELDDLELDEDEKYNRKLESGLYSLQLVAVILGHIWCSEHSGMRARVELLLKQQKLSKPMSSRFFRSITTTLEILMEQRRRNEDRREFSCSYQRCDLEKERKKLEIVQMAWYY

SEQ ID NO: 13255 - protein, 819 aa, Unknown
  Mycobacterium sp. JLS
MTRRRLVVIGNGMAGVRAIEEILARGGADMFEITVFGDEPYGNYNRILLSNVLSGSDDTSEIYLNPLDWYTGNGIDLRAGVRVVRIDRYARLVHADDGTALHYDELIVATGSRSFFPPITGLWADDKTLADGVFGFRTLDDCLGMIHEAEHRTKAVVIGGGLLGLEAARGLQNRGLTVDVVHAGATLMNAQLDDTAGAILRRSVERLGITVHMDKRTTEALLGEDGKLRGIGFSDGSTVDCDMLVVAAGIRPNVGLAQRAGLTVERAIVVDDHMRSIDDDHIHVVGECAQHRGQVYGLVAPLWEQAGVLAAHLTGTDPTAAYHGSRTATKLKVAGVDVAAMGLKAPELPDDEFVQYSEPRHGVYKTIVIRDGKLVGATLLGDVSKVSFLTQAFDTGLPLPEERVSLMFDIGTPDVEVGVAELADDAQVCNCNGVSKGTLVGCVRDGESSVAGVMAKTKAGKGCGSCKELVGQIVEWAAGGAVTEDPSASWYVPGVPYDKPTLMRHIRELRLHSVSSVFAALAPDGREDAGSKMALASLLEMMWADEFVDERDARFINDRVHANIQRDGTFSVVPQMKGGVANPWQLRRIADVADKYSIPMIKLTGGQRIDLLGVRKEDLPAVWADLDMPSGYAYGKSFRTVKTCVGSDFCRFGVGDSTALGIAIEDRYKGLASPAKMKLAVTGCPRNCAESLCKDLGVVAIDGGRWEIYVGGAAGAHIRKGDLLATVDSPDEVMTLTGRFLQYYRENANWLERTYAFVPRVGIEKIRDAIAEDAEGLDQRMQKSVDAYRDPWHDGRAPATEGQFRSSLPLLPLPQVPVR

SEQ ID NO: 13256 - protein, 419 aa, Prochlorococcus marinus
MHSFSLKKPKVPTLLCAFITLLNDRLGETIVFPLLPFLLERFTSSGSTIGLLAGTYAISQFTVAPLIGALSDRFGRKPIIIICVFGSVIGLSLFAITVSLNWENILPVSAASLPLIFLFIARIIDGISGGTATTATAILADISTPENRAKTFGLIGVAFGLGFLLGPGLGTTLAKYSVTLPVWAATAFAMLNLTLVTWLLPETHPVNARNQLPRKRELNPITQLSLIFTNPSLRRLCLGFFLFFMAFNGFTAILVLYLKQAFNWSPELASLTFVVVGLVAMVVQGGLIGPLVNRFGEWRLTMIGIGFVIIGCLLLPIANQGNAIPIVFTAVAILALGTGLVTPCLRALVSKRLNATNQGAILGSLQGLQSLGTFIGAAIAGISYDFLGVKSPFLGTSIVLIIVIILISNKRHIKSQRSI

SEQ ID NO: 13257 - protein, 492 aa, Fulvimarina pelagi
MARSKAPKSETADQETGPIVVWLRDDLRLDDNPALALAAETNRPIVPLVVLDEESDGVRALGGAHKWWLHHSLESFASSLRGKGSRLTLRRGKAKDQVLDVIEKTGASALFFNRRYDQASRAVDDAIGEALGDQVSVERFTANLLHDPENVETTSGGYYKVFTPFWRKVSESGPRDPIDPPDGLKQPDTFPQSDDLEDWELLPTKPDWSGGIADFWTPGEKAAHDRFETFCDDLLSDYHKGRERPYADDTSRMSPYLRWGEISPYRLWHTAQAYANRRKTVPDEAIRTFLQELVWRDFNYHLLFHFGPLADKNFNDRFDNFSWRSSKKDLKAWQNGLTGYPIVDAGMRQLWKTGWMHNRVRMIVGSFLTKDLLIDWRDGERWFWDTLVDGDIASNTAQWQWIGGAGADAQPFFRIFNPITQSERFDKNGAYIRQFVPELKEMPDKHIHAPWKADKDVLEKAGVKLGETYPEPLVDHSEARDRALSAYDEVKG

SEQ ID NO: 13258 - protein, 466 aa, Novosphingobium aromaticivorans
MDARRIGLLAGPLGFAATLLLAPPAGMPDNAWAAAGLVWWMAAWWMTEAMPLSATALLPFLVLPLTGVADANKTAGSYYSPIMFLFVGGAFLALAIERTGLHRRLAVFIMGLAGTKPSQLLLAVMAATATLSSFISNTSTALIMMPMALAMLAAGGVREGETRGMAGALPMGIAFAASIGGLATLIGTPTNAIAAGLIEKSLGTEITFLRWAMYGVPIVLIAVPLAAWIIARVQKLDEDSFDPLAAREAIGSATAWTTPERRLVPVALLAFLAWVAQPWLEGLFPKGGLTDGTIAAAAGLVLFFLPDGTGRPMLTWPEANRAPWDVVLMFGGGLAMAMGMTESGLTKWMGEMLLPLAGVPLPVVALVLVAFVILVTEFASNIAAASGIMPVVAALVAALGADPIMLALPAAFAATWGFMLPAGTGPNALAWATGHCSMRSMIKAGFALDVAGVFLLVGVVWTVTSL

SEQ ID NO: 13259 - protein, 251 aa, Pinus pinaster
  misc_feature (75)..(75): Xaa can be any naturally occurring amino acid
  misc_feature (109)..(109): Xaa can be any naturally occurring amino acid
  misc_feature (138)..(138): Xaa can be any naturally occurring amino acid
  misc_feature (171)..(171): Xaa can be any naturally occurring amino acid
MASVPTQAALGVSCPSVCRSGFLTGSSVSRLARRVRPGSNPAPARSFKVEAKGEWLPGLSSPSYLNGSLPGDNGXDPLGLAEDPESLKWYVQAELVNGRWAMLGVAGMXIPEVLTSIGLINVPKWYDAGKVEYFASSXTLFVIEFILFHYVELRRWQDIKYPGSVNQDPIXKSYSLPPNEVGYPGGIFNPLNFSPSMEAKEKELANGRLAMLAFLGFVVQHNVTGKGPFDNLLQHLSDPWHNTIIQTLQGK

SEQ ID NO: 13260 - protein, 550 aa, Arabidopsis thaliana
MNHVPSDQSFYIESEDEDDRKDYVEEDGGSHSDSSDDVYDENQAHIKPSSYTTAWPQSYRQSIDLYSSVPSPGIGFLGNNSMTRFGSSFLSSGLIRRHTPESLPTVTKPLLEEQADEQALPKHRLSSQGLLSPIPSRRGSMRKDEKSSMVSHEIPMSRNSSYGQAVLNGLNVLCGVGILSTPYAAKEGGWLGLMILFVYGLLSFYTGILLRYCLDSESDLETYPDIGQAAFGTTGRIFVSIVLYLELYACCVEYIILESDNLSSLYPNAALSIGGFQLDARHLFALLTTLAVLPTVWLRDLSVLSYISAGGVIASVLVVLCLFWIGLVDEVGIHSKGTTLNLSTLPVAIGLYGYCYSGHAVFPNIYTSMAKPSQYPAVLLTCFGICTLMYAGVAVMGYTMFGESTQSQFTLNLPQDLIATKIAVWTTVVNPFTKYALTISPVAMSLEELIPSRHIRSHWYAIGIRTLLVFSTLLVGLAIPFFGLVMSLIGSLLTMLVTLILPPACFLSIVRRKVTPTQMMLCVLIIIVGAISSVIGSYSALSKIVEKLTN

SEQ ID NO: 13261 - protein, 468 aa, Klebsiella pneumoniae
MSKQQIGVVGMAVMGRNLALNIESRGYTVSIFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGVFHTEWLE

SEQ ID NO: 13262 - protein, 457 aa, Pisum sativum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGI

SEQ ID NO: 13263 - protein, 443 aa, Unknown
  Rhizobium sp. NGR234
MSFLDLPEGLPERIIQCNSPYTVRFGVRLRGRMYSFIGWRSVREHCEPVKGDIRYASNADAEEVEALAALMTLKCSLVDVPFGGSKGALKIDPRGWTPQELEHITRRFTQEMNKRPDRARRQCVGSDIGTGEREMAWMMDEFRRANPTDVVTSGACVTGKPLSKGGIAGRAESTGRGVQFAIQSSLRDTRTPGLDGRRNLKGASTVIQGFGNVGYHAARFLSEEDDARVTVLAERDGYVANPEGLSIEALKQHQIRTGSILGFDGAKSIAGDMCGVEQPCDVLIPAAMENAIHAENAERMKAHLVVEAANGPVTFEADEILRSRGVTILPDLYVNAGGVVVSYFERVKNLTHIPFGLMERRRRERGNHTIATALERMTGKESPADMRDEFLEGGAEIDLVRSGLEDVMRSTWTRIADLMEQQPELGDYRTAAYVASIRQVADL

SEQ ID NO: 13264 - protein, 332 aa, Pennisetum glaucum
MQSLTDGVVVTSIRKKRPRRSRDGPTSVAAVIQRWAEHNKQLEHDSDGAKRPRKAPAKGSKKGCMKGKGGPENTHCGYRGVRQRTWGKWVAEIREPNRVNRLWLGTFPTAEDAARAYDEAARAMYGELARTNFPSQKAVASSQAARVPTPAQVAPAAVEGVVPSTSCESTTTSNHSDVASSSNKTEASDMSSSVKVECPEAVGAGSHRSEMVSGISHQHEDSHPSIQASTPNISDKEVFEPLEPIENLPEGDFDGFDIDEMLRMMEADPQNEGGAGAGAGAGGGMEQTFFFDGLDPNLLESMLQSEPEPYSLSEEQDMFLAGFESPGFFEGL

SEQ ID NO: 13265 - protein, 458 aa, Streptococcus mutans
MENHNFENEGQFKRKMTSRHLFMLSLGGVIGTGLFLSSGYTIAQAGPLGAVISYLVGAIVVYLVMLSLGELAVAMPVTGSFHTYATKFISPGTGFTIAWLYWICWTVALGTEFLGAGMLMGRWVPYVPTWVFAALFALLIFGLNALSVRSFAEAESFFSSIKVLAILVFIILGFGAMLGLVSFNGKHEVFLFSHLTAHGALPKGLPALMSVMLAVNYAFSGTELIGIAAGETNNPKEAVPKAIKTTIGRLVIFFVLTIVVLASFLPMKEAGVSSAPFVDVFDKMGIPFAADIMNFVILTAILSAGNSGLYASSRMLWSLANEGMISPRVVKINEHGVPMRALLLSMAGAVLSLFSSIYAADTVYLALMSIAGFAVVVVWLSIPMAQINFRKEWLKSHAQEDLFYKTPFTPILPYITIMLLLISIIGIAWDASQRAGLYFGIPFILLCYLYYYWRHKTL

SEQ ID NO: 13266 - protein, 296 aa, Listeria monocytogenes
MNTIKIALIQQKAVPNNKEANLKLAIKYIKEAHEKGADLVLFPEMWSNGYAPPFEDAFNHPLATDFDNERTKWLNEAITEDSAYFLTLKELAKELKIGICATYLSKTEQKPQNTAIIIDRKGEIILDYAKVHTCDFSLEILLQSGEEFKVCEFDGIKLGGMICYDREFPESARVLMLKGAEIILVPNACDMNPARLNQLNSRAFENMVGVAMANYPGEKWGRSTAFSPIVFDENGDYRDNTIIETDDVSEGIFIAEFNLDEIRTYRENETWGNAYRKPQTYTDLISLDVEAPFKRN

SEQ ID NO: 13267 - protein, 112 aa, Prunus persica
KVLVIGGGDGGVLREVARYSSIEQIDICEIDKMVVDVSKQFFPAVAVGYEDPRVKLHVGDGVAFLKAVPAGTYDAVIVDSSDPIGPAQELLEKPFFQTVANALRPGGVVTTQ

SEQ ID NO: 13268 - protein, 453 aa, Bordetella pertussis
MEKKIVLVKPYSAYERDKTPAENADLTRVEKGSPMGEYLRRFWQPVALSEELGELPTAVRMFGENLVLFRARNGKPGLLEKHCSHRGTSLEFGICEENGLRCCYHGWLFGVDGQILETPGDPPDSQLRFNVCHGAYPLHEYRGIIFGYFGPPADKPEFPVYDTYDIPGDRLVPYCITYPCNWLQVHENVMDPAHAVFLHTRISFTQFAEAWGELPEMDFVPTPTGMIYVTSRRWEDKVWVRSNDIVLPNLAQVGHIWEDGLTPKEFARVAITRWTTPIDDHTCRIIGWRHMHPDADPRGLADESLCGVETVDFFGQNGERPYADRQRMPGDYDAQISQRPIAVHAMENLTRCDRGVAMLRQLLRRESRKIANGEAPAISPLRANGATPTYAHDTVVSIPPADTDDAACVREIGKAITAIVVKGDHHEQADRPEQVRERIRAYAAEQASTATSE

SEQ ID NO: 13269 - protein, 103 aa, Prunus persica
ECAYQEMIALLPLCSIPSPKTVLVVGGGDGGVLREVSRHPSVEHIDICEIDKMVVDVSKKFFPQLAVGFQDPRVHLHIGDATEFLRHAPKGKYDAVIVDSSDP

SEQ ID NO: 13270 - protein, 159 aa, Acidobacteria bacterium
MGLYDLSATLNNGKEKKLSDYKGEVLLVVNTASECGFTPQYKGLQELYEKYKNQGFEILGFPCDQFGHQEPGSDKEIASFCEVNYGVTFPIFSKIEVNGANEHPVYKFLKSEKGGLLTNNIKWNFTKFLVDKQGNVVDRYAPQTIPARIAADVEKLLST

SEQ ID NO: 13271 - protein, 416 aa, Treponema pallidum
MFGCSLRRRCFRRPAFVPVSRAHPVFLCVRANVDKDSLDGVIVAKKDYYEVLGISKTASGEEIKKAYRRLAIQFHPDRNQGNKEAEERFKEATEAYEVLIDAQKRAAYDRYGFDGLKDMHGAHGFNSSAFQGFEDIFGGGFSDIFENIFGTSSRRGGSGNDGSGGSGRGANLRYDLQISFEEAVYGKKSELHYVRDETCITCKGAGSASGGRKMCPDCKGTGQIRRSTGFFSIAQSCARCGGEGTIIESPCARCAGSGIERKKQKIIVSIPAGVEEGRRITIPRQGNAGRAGGAYGDLYVFVFVRAHEYFEREGADLYCATSISVTQAILGAQVTVRALDGSAQQVRVPAGTQGGALLRVKGMGVPLARGAGDLYVKVLVRIPTTLSARSRALLAEISQEEGENAHPPLLELSSLK

SEQ ID NO: 13272 - protein, 199 aa, Kineococcus radiotolerans
MSRTARIERSTSESSVLVELDLDGTGRTSIDTTVPFYDHMLTALGKHSLMDLTVVAKGDTHIDVHHTVEDTAIVLGQAFRQALGDKAGIRRFADATVPLDEALAHVVVDVSGRPYCVHTGEPEGQEYHLIGGHFTGSLTRHLLESFAFHARIALHVRVLAGRDPHHVVEAQFKALARALRYAVEPDPRVQGIPSTKGAL

SEQ ID NO: 13273 - protein, 393 aa, Methanocaldococcus jannaschii
MILMVLEIKNGIYWVGVIDWEIRDFHGYGTPYGSTYNSYLIKDKKNVLIDTAKDYMFNELIYGISKFIDPKDLDYIIVNHVEKDHSGCVDKLVEISNATIITNEKGKEHLSLYYDTKDWDFIIVDTGDEINIGDRTLKFIRTPMLHWPDNMLTYCKEEKILFSNDAFGQHIASSERFDYEIGEGIFEHAKDYFANILMPYKMLIPDAIKAVKNLDIELICPSHGVIWKEYINEIIEKYNEWAMNKTKNKAVIVYDTMYNSTKKMAHAIAEGLMEKGVEVKIYRVCETSLSRIMTEILDAKYVLVGSPTVNRNLYPEVGKFLAYMDCIRPLDKIGVAFGSYGWMECATEKIKEIFKNLGFKIVDDECLTVRFAPKEEHLKKCYEFGKRLADIGF

SEQ ID NO: 13274 - protein, 457 aa, Saccharomyces cerevisiae
MTSEPEFQQAYDEIVSSVEDSKIFEKFPQYKKVLPIVSVPERIIQFRVTWENDNGEQEVAQGYRVQFNSAKGPYKGGLRFHPSVNLSILKFLGFEQIFKNALTGLDMGGGKGGLCVDLKGKSDNEIRRICYAFMRELSRHIGKDTDVPAGDIGVGGREIGYLFGAYRSYKNSWEGVLTGKGLNWGGSLIRPEATGFGLVYYTQAMIDYATNGKESFEGKRVTISGSGNVAQYAALKVIELGGIVVSLSDSKGCIISETGITSEQIHDIASAKIRFKSLEEIVDEYSTFSESKMKYVAGARPWTHVSNVDIALPCATQNEVSGDEAKALVASGVKFVAEGANMGSTPEAISVFETARSTATNAKDAVWFGPPKAANLGGVAVSGLEMAQNSQKVTWTAERVDQELKKIMINCFNDCIQAAQEYSTEKNTNTLPSLVKGANIASFVMVADAMLDQGDVF

SEQ ID NO: 13275 - protein, 422 aa, Rhodococcus erythropolis
MSAAEVVVIVGAGLAGARAAETLRGNGFAGSIVMFGDEPTAPYHRPPLSKSLLVDEPEMSTLLVHPEGWYHDHDVELRLGRKIARVDVSSRRLQDVLGHSHRFDKLILTTGAAARTFEGSRSDAQSRVLVLRTLSDAARLRTQLATAQSVVVVGGGFIGAEVASGAVGLGHSVTILETAEGPFLRSLGGAASKILSSFYRSEGIVLVTSVNIASVCESEDSVTVTATDGRRWDADLVVMGIGAVPADELAADSGLSTGNGVQVDAHGRTTVPFVFAAGDVANRFEPTLGRHIRPEHWQNAQNHAVAGARNVLGANEAFSEVPWFWSDQFSVNLQMAGVPYAVDEVVVRGVPDDRRFSIFYLSRSRVVAAFSMDNARDIGVAKRMIGRRIAVDAAALADEGTDLKSLLRVREEQVFASSKRTE

SEQ ID NO: 13276 - protein, 383 aa, Haemophilus somnus
MVTYGEIFQVKTTMETQKTNKTIVVKFGTSTLTQGSSKLNRPHMMEIVRQITQLHRAGFRIIIVTSGAMAAGRHYLNHPQLPPTIASKQLLAAVGQSQLIQTWEQLFAIYDIHIGQILLTRADIEDRERFMNARDTLHALLDNRIIPVINENDAVATAEIKVGDNDNLSALVAILAQAEQLYLLTDQRGLFDSDPRKNPQAKLISIVDKITDHIRSIAGGSGTTLGTGGMTTKISAADIATRSGVETIIAPGNLENVIVNLAYGKDIGTKFVVQTDRLESRKQWIFAAPVAGIVTIDEGAESAVLIQHKSLLPAGIISVEGCFSRGEVVKICGSNGKKIALGVPRYNSDSLIQIKGKKSQDIEQILGYEYGSGAIHRDDMVVY

SEQ ID NO: 13277 - protein, 80 aa, Methanocaldococcus jannaschii
MVELKIACKLDGSCEKPRYRKYKCKVCGWVYDPLKGDPSQNIPPKTPFEELPDTWICPVCRGKVGKESFEPLDEWVEFDE

SEQ ID NO: 13278 - protein, 506 aa, Pisum sativum
MALSLSLTTILLSLFSFFLLHTHANPFRSIHHHNHPHFATHNYRDALTKSILFFQGQRSGKLPSNQRISWRRDSGLSDGSALHVDLVGGYYDAGDNVKFGFPMAFTTTMLSWSVIEFGGLMKSELPNAKKAVRWATDYLLKATAHPNIIYVQVGDAKKDHACWERPEDMDTPRSVFKVDANAPGSEVAAETAAALAAASLVFRKSDPTYAKILVRRAIRVFQFADKHRRSYSNALKPFVCPFYCSYSGYQDGLLWGAAWLHKATKNPMYLKYIQTNGQILGAAEFDNTFGWDNKHVGARILLSKEFLVQNVKSLHDYKGHSDNFVCSLIPGAGSSSAQYTPGGLLFKMSDSNMQYVTSTTFLLVTYAKYLTKSHSVVNCGGTTVTPKRLRTLAKRQVDYLLGDNPLKMSYMVGYGPRYPQRIHHRGSSLPSMAVHPGKIQCSAGFGVMNSKSPNPNILMGAVVGGPDQHDRFPDQRSDYEQSEPATYVNAPLVGTLAYLAHSFGQL

SEQ ID NO: 13279 - protein, 414 aa, Schizosaccharomyces pombe
MGQTLSEPVTEKHSVNGSNEFVLYGLSSMQGWRISMEDAHSAILSMECSAVKDPVDFFAVYDGHGGDKVAKWCGSNLPQILEKNPDFQKGDFVNALKSSFLNADKAILDDDQFHTDPSGCTATVVLRVGNKLYCANAGDSRTVLGSKGIAKPLSADHKPSNEAEKARICAAGGFVDFGRVNGNLALSRAIGDFEFKNSNLEPEKQIVTALPDVVVHEITDDDEFVVLACDGIWDCKTSQQVIEFVRRGIVAGTSLEKIAENLMDNCIASDTETTGLGCDNMTVCIVALLQENDKSAWYKKIADRVAANDGPCAPPEYAENHGPGWRSGDNNKKVIVPPNFHQVKLNGSDGYDKDANENSKEDDSTNGSLAAGFRWKEHFFPHKAEEENSSSETDIVNSNKDVADDHKEAVSAAD

SEQ ID NO: 13280 - protein, 713 aa, Gloeobacter violaceus
MIEYRKSVTVHGREIGLSTGVLAQLAGGSVLVQSGETAVLVTATMASKPREGIDFFPLLVDYEERLYAAGRIPGSFVRREGRPPEKAILAARLIDRPLRPLFPKGFINDVQIVATVLALDMNVPPDILAILGASTATMLAGIPFDGPVAATRVGLMGDDFIINPTYKEIEEGELDLVVAGTKNGIMMVEAGANCLPEEDIIDAIDYGYEAVQAMLTAQEEFIRDLKIEPMAFVAPANDPVLVSFVEEKASEAVAEVLRSFELSKDERDAKLDAIEAELGTTFAGLGEEDPLREKAAANASKLPALFKSTTKKLMRKQILVEGKRVDGRSLDEVRPISSAVRVIPRVHGCGLFTRGTTQVLSVVTLGTASDAQELDDLHPDDSKRYMHHYNFPGFSVGEVKPLRGVGRREVGHGALAERAIVPILPEHEQFPYVIRVVSEVLSSNGSTSMGSVCASTLALMDAGVPIREPVSGVAMGLIKEGDEVRILTDIQGIEDFLGDMDFKVAGTRDGITALQMDIKIQGITLQILEAAIQQSKAGRLHILEKMLIAIDKPRVELSPYAPRLLTLKIPVDMIGLVIGPGGKTIKRIVEETGAKVDIEDDGTVVVSSIDGAKALAAKQIIEGMTRTVEVDKVYLGTVTRIIPNLGAFVEVMPGKEGLVHISQLAEHRVRKVEDELNVGDEVVVKVKEIDQKGRINLTRRGIHPSEVEEARGQ

SEQ ID NO: 13281 - protein, 226 aa, Brassica napus
  misc_feature (214)..(214): Xaa can be any naturally occurring amino acid
MRIISMASTIRPSLLGCVSASSPRFPVVSRNLSFSHVTQSKLLTLRRSVSCLGVAESGKASTAATEEDLLKWVKDDNRRMLHVVYRVGDLDRTIKFYTECLGMKLLRKRDIPEEKYTNAFLGYGPEDSHFVIELTYNYGVDKYDIGAGFGHFGIAVDDVAKTVELIKAKGGKVTREPGAVKGGKTVIAFIEDPDGYKFELLERGPTPEPLCQVXLRVGDLDRSSNS

SEQ ID NO: 13282 - protein, 359 aa, Glycine max
MAGSAIGFEGYEKRLEISFFENGVFADPGGLGLRALSKDQLDEILKPAECTIVASLSNDYVDSYVLSESSLFVYPYKIIIKTCGTTKLLLSIPVILKLADALDIAVKSVRYTRGSFIFPGAQSFPHRSFSEEVSVLDSYFSNLGSGSKAYVMGDPSKSQIWHIYSASAQTKGSSEAVYGLEMCMTGLEKESASVFFKENTSSAALMTENSGIRKILPQSDISDFEFDPCGYSMNGIEGGAISTIHVTPEDGFSYASFEAVGYDFDEMALGELVERVLACFRPAEFSVALHIDMHGEKLNKFPLDIKGYYCGERSYEELGVGGAVVYQSFVQGCDGSTSPRSILKCCWSEDENEDEVREI

SEQ ID NO: 13283 - protein, 292 aa, Brassica napus
  misc_feature (98)..(98): Xaa can be any naturally occurring amino acid
MSSMSSREKRRKRKREPSPESNPTPVSKPTPASTPQWSSPIPSLPYDLVLLCVARVSRLYYPTLSLVSKSFRSLVSSPELYKTRSLFGFTESCLYVCXQSLGGSADWYTLCRKPDKTLKSGSSGYALARVPVPNSPLWHCRNMVAVGSNIYNIAFPRSLNVLPRVSILDCKSHSWIEAPSLPVELHSFSASVVDHKIYVAGFDHRLMKNSFEVFDTQTRVWDSLSTSNTSAEREEMFIKKAISIDGKFHVVTDKEVLAYDPKLAKWDMVGRGMRELMYSKAYCVIRDVLYYA

SEQ ID NO: 13284 - protein, 118 aa, Arabidopsis thaliana
  misc_feature (33)..(33): Xaa can be any naturally occurring amino acid
MASSMLASAGVVTSPVSSHTWSSPFTGLKSSAXFAVTRKGNNDITSITRKGGRVSCMKVWPPIGKKKFENISYLPDLMEVELDKEVDYVLRNKGMPGVELELEHGLVYREQGSTPGYY

SEQ ID NO: 13285 - protein, 229 aa, Odontella sinensis
MADITLAQLLEAGVHFGHKAYRWNPKMFPYIYTERNNIHILDLVQSAQLLKEANSYLQSAAEKGQTFLFIGTKPQASALIAQEAKRCNSYYVNHRWLGGMLTNWVTLKSRIARLKTLEQEEADQVFNLLPKKEASLRRKELEKLRKNLNGIKDMEKLPDVAIVIDQKREMTAVIECRKLGIPIISILDTNCDPDLVDIPIPGNDDAVGSIKLVLQSLTDSINTGKLTTK

SEQ ID NO: 13286 - protein, 195 aa, Zea mays
  misc_feature (169)..(169): Xaa can be any naturally occurring amino acid
  misc_feature (184)..(184): Xaa can be any naturally occurring amino acid
MAENAELLEWPKKDKRRFLHVVYRVGDLDRTIQFYTECFGMKLLRKRDVPEEKYSNAFLGFGPETSNFVVELTYNYGVSSYDIGTGFGHFAISTQDVSKMVEAVRAKGGNVTREPGPVKGGGSVIAFVKDPDGYMFELIQRGPTPEPLCQVMLRVGDLDRAIKFYEKAXLGMRLLRRIERPEYXYTIGMMGYAEE

SEQ ID NO: 13287 - protein, 446 aa, Arabidopsis thaliana
MSKAWKLKLLLLLQLLLLSQHDVDSASVISYLPGFEGLLPFHLETGYIGVGEGEKVQLFYYFIKSENNPEEDPLIIWLTGGPACTALSALAFEIGPLTFKTEGYNGGLPSLVSTSYSWTKVASIIFLDQPVGTGYSYSTTPLSYKPSDTGEAKQTYEFLQKWLVENPQFVSNPIYVGGDSYAGIVVPAIVQQISIGNEHGYKPQINLKGYILGNPSTDLDSDHNSKIPYAHRMGLISDELYESLKRTCQGNYVKVDPTNTKCLKLMEDYGKCVSRINEGLILIALCDLASPNPYSGEHGGRSYLQTLVQSDLSLPTPDCYMYRYLLASHWANDEDVRRELHVVKGSIGKWMRCNWDLPYEKDIKSSVPYHRNNSIIGDYRSLVYSSDHDMMVPYIGTEAWIKSLNYSITDDWRPWFVNNQGGGHTAEYKPEESFMMFQRWISGRPL

SEQ ID NO: 13288 - protein, 168 aa, Glycine max
MIFSPSVTTVNRAGAGVVALFTGLMSMAGFPTENTNSDITYIASNCGRVQCVRVWPPFGKKKFETLFYLPDLDDAQLAREVIYLLRKGWIPCLEFELEHGFVYREHNRSPVLYYGLYWTMWKLSMCGCSDASHVLRDLLDAKSAYPCGFMRIIICHNVTQVHRISFIV

SEQ ID NO: 13289 - protein, 497 aa, Zea mays
MGDYYYRRRSPHLLPAAVLALLAVVVVVVASSSLPSAAAAGAGRNVITHIKGFEGPLPFHLETGYVEVDEEHGARLFYYFIESERNPAEDPLILWITGGPGCSALSGLLFEIGPLKFDVAGYTEGFPRLVYFEDSWTKVSNVIFLDAPVGTGFSYSREEAGLNVSLTESGRQHHVFLRKWVAEHPEFASNPLYIGGDSYSGYTVPVTAMDIATSSDDEEPPKLNLVGYLVGNAATDDRYDTGGKVPFMHGMGLISDELYEAAKQGCGGDFYVAPDPTNARCASAMMAINMVTFAVNPVHILEPFCGAAVRAGGGSIFQGYGGGARRSMLVRDDVRHPGFFAKQRLGLPVECRDNGYRLSYIWADDPEVREALGILEGSIGSWSRCTMLSHYRHDVTTVIPYHVNLTKAGYRALVYNGDHDLDMTFVGTQEWIRSIGYPIVSDWRPWFANRQVAGFTRTYAHNLTFATVKGGGHTAPEYRPKECQAMLDRWTSAAGQL

SEQ ID NO: 13290 - protein, 511 aa, Arabidopsis thaliana
MEEMTPAVAMTLSLAANTMCESSPVEITQLKNVTDAADLLSDSENPSFCNGGTECTMEDVSELEEVGEQDLLKTLSDTRSGSSNVFDEDDVLSVVEDNSAVISEGLLVVDAGSELSLSNTAMEIDNGRVLATAIIVGESSIEQVPTAEVLIAGVNQDTNTSEVVIRLPDENSNHLVKGRSVYELDCIPLWGTVSIQGNRSEMEDAFAVSPHFLKLPIKMLMGDHEGMSPSLTHLTGHFFGVYDGHGGHKVADYCRDRLHFALAEEIERIKDELCKRNTGEGRQVQWDKVFTSCFLTVDGEIEGKIGRAVVGSSDKVLEAVASETVGSTAVVALVCSSHIVVSNCGDSRAVLFRGKEAMPLSVDHKPDREDEYARIENAGGKVIQWQGARVFGVLAMSRSIGDRYLKPYVIPEPEVTFMPRSREDECLILASDGLWDVMNNQEVCEIARRRILMWHKKNGAPPLAERGKGIDPACQAAADYLSMLALQKGSKDNISIIVIDLKAQRKFKTRT

SEQ ID NO: 13291 - protein, 444 aa, Treponema pallidum
MDQHTRTRDLVSAFFGRFHFDVQGPSVRTVVDVLRADMVRGLEEEAQLPPRMGSALAMIPTWVAPPRVSPCNRRVIVIDAGGTNFRSCLVRFGDSGTPHIENLEKRPMPGTTREYSRTEFFGEIADNLARLKGAADCIGFCFSYPIRIRPDGDGEVIQFAKEIKAAEVIGTCVGAGLTEALSARNWPELRSLKMLNDATSALLAGFFAAPEGCSFSSYVGFILGTGMNSAYLEPDPIPKIPAHHTPQVVVCESGKSNKVPRSVFDELFTQTTAEPDIAHLEKMSSGTYLGPLASVVVRLAAQEGLFSHAVHAALSTVSFTLVDMDRFLFAPSVSTTTLGALLAPGTDTDREILFLLLDAVVARAARIAAGVIAASVLKSGAGYDPLRPVCVLAEGTTFQRTYRLRTRVTSHLQAFLTEERGVYFDIISLENAVTLGSALGGLSS

SEQ ID NO: 13292 - protein, 383 aa, Methanosarcina barkeri
MTDRNEFLNDINKIVIKIGTSSLTKQNCDSTKENCSIDPTFIENIAAQVSELRKLGKEVIVVSSGAIGVGLYELGIAPKPREIPIRQAAAAVGQSILMQYWSEAFSKHGIKVAQILLTYEFYSDRVSYLNLRNSISTLLEYGVVPIINENDCTCTNEIEAIFGDNDKLSAMVASKIDADLLIILSDIDGLFDKNPKIHEDARLISLVEKITPEIESYGGDPTSFKGVGGMRTKIKAAKICSMAGCYVLIANSEIEDVLLKVLSGKEIGTLFLAERHIQKNRARWIILSRASGTIRVDAGAKAAVLGKNSLLSAGVVDVEGNFDRGDVVRLECEGRVFAKGITDYTSEELMKIKGAHTDEIEGILGYNNYSNVIKKENIGIMEN

SEQ ID NO: 13293 - protein, 343 aa, Ostreococcus tauri
MSTKAVSKQLKTKGLQRLRWYCQLCEKQCRDENGFKCHSASPAHINRLAVFAQNQRKVVDGFSERFRSSFISELALNCCNSRVEANKFYNQLIANKGHVRMNGTIFDLINETFLTYRAATRWTSLTEFVRALAAEGVCEIDETDKGIFIRYSLPESNSTLRESSARKRMHADETADKKHQQVQRKYYTPQLLFLAFPTQVVRDQLKRTGAAAISQETRPTSLDGSSVKFKMDLNGKEVSGEPISDAYQLNHITEKRRGRFRGLAVFIQVCMIYSLFLRYMLPGSLYDLRQFKEEIRHHGTLERYRRATLPRFCGLFHSTNKGSSDGHPSTSIYYFMNEHRNFV

SEQ ID NO: 13294 - protein, 186 aa, Bdellovibrio bacteriovorus
MIRCPLLSQNEISSHTHAAPLRRFPMKKHLYDFTVKAANGQPVSLDQYRDKVVLVVNVASKCGYTPQYKGLEELYQQNKDNGLVILGFPCNQFGAQEPGSNEEIQQFCELNYGVSFPVMGKVDVNGGNADPLYQWLKEEAPGLLGTEMIKWNFTKFLVGKDGAVLKRFAPKDEPKDIADDIKKALA

SEQ ID NO: 13295 - protein, 233 aa, Brassica napus
  misc_feature (226)..(226): Xaa can be any naturally occurring amino acid
EVPNLDPIYANMRSVKEKRAELKILKATFVTRASEFLRSYFASLVDFMVSDKSYFSQRGQLKRPDHADLRYKCRTYARLLQHLESLDKNCLGPLRKAYCSSLNLLLRREARGFANELRASTKVSRNPTVWLEGSTGSSQNANTDTSAVSDAYAKMLTIFIPLLVDESSFFAHFMCFEVPALAPPGGAGSDKGPNNDDGNDDDDLGIMDIDESDKKTGKTSPDLTAXNESLQIT

SEQ ID NO: 13296 - protein, 55 aa, Methanocaldococcus jannaschii
MIEMARYQCMCGWVYDEDKGEPSQNIPPGTKFEDLPDTFRCPQCGLGKNAFRKID

SEQ ID NO: 13297 - protein, 2011 aa, Magnaporthe grisea
MATAEVLFSTSAGWTGDAADGWPSIWHGTRTIGSVERHAQQTRDDLRRRLRWIAQTWASEREQRRHVTTQKRSSFVPLITPDISPRWSHRLAQAGVISRDPNSDDDILPSTPTDLTETYQSVTRRLSDSAHLDSVPTANGQPASRRSRDRDMFADPSSTVDVDFSSGQGFREFAKKKKKAPAAPAPTNNNNDEKKDEPADNGGGDDKNNGNADSGAGGGDAGNGGDEKKDDKKDDNAGGADDPWGDLAAVGGKKKKGKKGAATEDKEEPPASSTFDAFQEIKLDEGPNLDLSFDSKSNEKAPSTFGAWGSSWSTGGLGASWGFGATKTNTPAEEEKKEEDNPWSLNRPKPKKKGATGFSFGDIGEVEEVIEPKKEEPVASDDWGGWGTAGKKKGKKAEPETEPEPEPPKPVDPPPEDIWGAVSSKKDKKKKKGAAEEVKEEPPKEPDPPPPPAEDIWGAAASKKDTKKKKGKASIWGEPAKEPEPEPEPVKEPEPEPEPEPEPEPEPEKKEEESSGWGIWGAATTKKDKKKKKVVEEPKVEEPPPPPPAPEPEPAPVESAWGWGTTTTTTKKKKGKNAVEEAPPPEPEPVKEPDPEPEPEKKVEEDIWGLSTSKKDKKKKKGAVEEVPEPPPEEKPAEDEKKDDFDFGFTATSSKKDKDKDKEKDKKKKTKSSSIWGEPVKDPEPEPEPEKPAEPEKKEEDDFWASIGGTSKKDKKKKGKTAEEPPPPPPAEPEPEPEPEKTEDFDFGWGAAATKKDKKKKGKTAEPDPEPEPEPEKKVEEDDFWASIGTGKKDKDKKKKKGDDALIDLETPKEEKKEEKDDFWSSFGTSSKKDKDKDKKKKDKEESSVKPDAIEEPSEDIWGVSSSKKKKDKSSSKNVPVEVVGDTDIASVQPDSIEEAKDDGGWFGTSSKSKDKDKEKKKEKEKEKEPKLSKKEQEKLDKEKEKERKKAEKAEKERAKQEAEEAARAEEEAARAAEEAAAREAEEAAQAAKEAEEAAAREAEEAAQAAKEAEEAEILKEEAELKALQAKKDKGRPKMTKKDTDRYNLLKSKADIRSEAAANKEAEEAAAREAEEAAAREAEEAAQAAKEAEEAAAREAEEAAAREAEEAAQAAKEAEEAAAREAEEQAQREREEAEAKKKSKSSSKDKEKSSSKSKSKDKDAKSSSKDKDKDKDKKSKDKDKDKEKDKEADKEADKDQDDFDKELEKDLLNLTPENVEELLNEEPPAEVEKPKEAPASDAFSFWGASKKGAKSATSEIKKAESSTIPEDATDGLGDNSADVSSGKATKSSKKVGSKVADRLKAFQASTTPPPEEEEEVIPDPVPPPPPPPPPAEPPAEESGKKKKKSKKAAAVAPEVVEVVPEVVPEVEAEAPPEVEIVEEPTPPRRKVRSHLPGSFPMDDEDEIVDIVDMSPEKKSSKKSKSRSKSGSVSVPPAAPPPPPPPPAVPDAPPAVPDAPPSTEEEKPSKKERAKISREGSASWGMWNAAPRKEEKRPSRSERKESGSSSKTREERPERIKEAPAKARVASVLASTPPLSRSASTREKKSSSRSRRSAEVNHGLASPPPEEAPEMTDKAARIFGLKSSGSRRSKTRSAPPEDEDIVMVGALDASPEKPSRRRSKVNIDLVQRQTRKWGRATDLTQREREQVPRDEDIVMVDNPDPTTPLKRSNSSAKKGLAGLFGGILSTPRSEARPDGRPELRRRGTYMTTDDEGMHGGPSGAATETEEARRAARRARRAERGGVDPRHADEARVEKDEARRERRRKHEDENAEARRQEEREARRAERRAQRARDEADRAAAEEQQQKDAERAERRRMRRERERQAAAASAPEDGHPEARPERHRRGHESEREDDEERRRRREARRAAREAEAGGGGKSSSRRHRGENPYPREADRRKDGWPHSGTSSWVKDHSDAPPPPEGEDEDARREARRAARRRSKYGGSGGGDDIDAAAAEDEHHRRRRHRDEARRAPTAGGSDGSDERRQSRRNSVFGDTAPAARSSWWKKLTGS

SEQ ID NO: 13298 - protein, 475 aa, Mesorhizobium loti
MEKAEIGLIGLGTMGSNLALNIAEHGHRIAVFNRTRARTDAFVENAGALKDMVVPCYSLEELAAAIRPPRPIIIMVLAGKPVDEQIEALRGVLSGNDIVIDAGNANFRDTMRRFSELSGSGLTFIGMGVSGGEEGARHGPSIMVGGTEDSWKRVEKVLTAISAKFKDEPCAAWLGTDGAGHFVKTIHNGIEYADMQMIAEIYGILRDGLGMGPKDIGTVFSNWNKGRLNSYLIEITAKVLAADDPKTGKPVVDIILDRAGQKGTGKWSVIEAQQLGIPATAIEAAVAARVLSSIKDERLAAEKAYGNIGVSKISGDKDALLKDLELALFAGKIAAYAQGFAVMSGASKEFNWNLPMPTIARIWRAGCIIRSQMLDTMAEAFSSGGASTNLLMAPAFISLMQEAHPSLRRIVAKASEAGAPVPALSSALAYFDSYRQGRGTSNLIQAQRDFFGAHGFERIDEQGAFHGPWGSGAAG

SEQ ID NO: 13299 - protein, 196 aa, Caulobacter crescentus
MRRLIVLFAAALAVLGATAPALAAPKTETAVFAGGCFWCMEHDMQGVPGVLKVESGYTGGHLKNPTYRDVTSETSGHYEAVRVTYDPAKLDYGFLLYRYWRLVDPTDDGGQFCDRGPSYRPAVFVTPAQRPIAEKSRTEAAKRLKTGTMKTQILPAQTFYLAEEYHRDYAKRNKLNYFAYRTGCGRDARLKQVWGG

SEQ ID NO: 13300 - protein, 246 aa, Zea mays
MDNNKQQPPPPPTSVYPPASAATAIPPPPPPSGSTPIIPGGGASYHHLLQQQLQQLQMFWSYQRKEIEQVNDFKNHQLPLARIKKIMKADEDVRMISAEAPILFAKACELFILELTIRSWLHAEENKRRTLQKNDIAAAITRTDIFDFLVDIVPREEIKEEEEAALGSMVAAPAVSGVPYYYPPMGHPAVPGGMMIGRPAMDPSGVYAQPPSQAWQSVWQNSAAGDDVSYGSGGSSGGHGNLDNQG

SEQ ID NO: 13301 - protein, 474 aa, Bacillus cereus
MAQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLFSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYVADGGKLEDLKFKTPLYPLVPMLGFGLYGIILISLIFIPEQRLGIYCTVPFIIFCYTYYHFKVKKRISTNTSSENKISETI

SEQ ID NO: 13302 - protein, 124 aa, Capsicum annuum
CSYAQGMNLLRAKSGEKGWNLNLGEMARIWKGGCIIRAVFLDRIKKAYQRNPNLANLMVDPEFAREMVQRQAAWRRVVGLAVQKGISVPGMSASLQYFDTYRRSRLPANLVQAQRDYFGAHTYE

SEQ ID NO: 13303 - protein, 820 aa, Sinorhizobium meliloti
MTETAREKLVIVGNGMAPGRMLEELFEKAPGRYAVTIFNAEPRVNYDRIMLSPVLSGEKEYEEIIIHGDGWYIKHGITLYKGHKIIAIDRDAKTVTSDHGVTESYDKLVIATGSVPFIIPVPGKELRGVITYRDLDDVQAMLLAAQSREKAVVIGGGLLGLEAAAGLQARGMDVTVLHVMPTLMERQLDPAAGYLLQKAVEERGIKVVTKANTKRILGEEKVEGIELDDGRIIPATLVVMAVGIRPNAGLAKEAGLAVNRGIVVDAGMQTSDGDIMALGECAEVGGMVYGLVAPLYEMARVAASHLAGDRRAAFAHSDTPTKLKVTGINLYSVGDFADADGREEIVLRDATAGIYKRLVLKDNRIIGTVLYGDTADGAWFNDLLKRGTDISEMRDTLIFGQAYQGGSPLDPTAAVAALPDDAEICGCNGVCKGKIVGAITSKGLTSLDDVRAHTKASASCGSCAGLVEQIMSLTLGDTYNPASVQPMCNCTDLGHDDVRRLIKAKKLKSIPAVMQELEWKTSCGCAKCRPALNYYLVCDWPDEYADDYQSRFINERVHANIQKDGTYSVVPRMWGGVTNSKELRAIADVVDKFNVPLVKVTGGQRIDLLGIEKEDLPAVWADLGQAGFVSGQAYAKGLRTVKTCVGSDWCRFGTQDSTGLGIRIEKFMWGSWTPAKLKMAVSGCPRNCAEATCKDVGVICVDSGFEIHFAGAAGLDIKGTEVLGLVRTEDEALEHIVALTQMYREQARYLERIYKWAKRVGLDEIRRQIMDDVEKRKAYFDRFVFSQKFAQVDPWSERVSGKDKHEFRPMATVGFNQAAE

SEQ ID NO: 13304 - protein, 416 aa, Methanocaldococcus jannaschii
MKKYESRRSKIADGVYWVGVLDWDIRMYHGYTLKGTTYNAYLVFGDEKVALIDNTYPGTSAQMWGRIKDAFEKEGREFKIDVIVQNHVEKDHSGALPEIHKKFPDAPIYCTEVAVEGLKKHYPSLKDAQFKVVHTGDTVDLGGKTLTFLEAPLLHWPDSMFTFYNEGGILFSNDAFGQHLCFPAHKRFDKDIPEYVLMDANQKFYANLITPLSKLVLKKFEEVIQLGLLEKIKMIAPSHGQIWTDPMKVIKAYQDFATGKAAKDKAVIVYDTMHYSTQKMAHAFAEGLMSEGIDVVMYFLHYDERSEIVKDILDAKAVLFGIPTIYDEPYPSIGDIIYYLRGLKFNRTGFKRLAVTFGSMGGEGGAVAKIAEDLAKCGFEVINQYELYYVPTEDELTNCYNMGKELAKRIKEMKIE

SEQ ID NO: 13305 - protein, 519 aa, Listeria monocytogenes
MTLTKFSEFGLDEKIVKSVNRMGFEEATPIQEKTIPLGLAGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGSGGGGNRDRRSGGGEQRSGGNKGNYSQKSK

SEQ ID NO: 13306 - protein, 498 aa, Ashbya gossypii
MRRDHILTASRGDIGLIGLAVMGQNLILNAADHGYTVVAYNRTVSKVDRFLEDEAKGKSIIGAHTVEELCANLKRPRRVILLVMAGSADDAFIEQLLPYMEQGDIIIVGGNSHFPVSNRRFEELKQKGIHFVGSGVSDGEEGARYGPSLMPGGAPEAWPHIKEIFQSIAAKSEGEACCDWVGPAGAGHYVKMVHNGIEYGDMQLICEAYDIMKRLGGFTDKEIGQVFSEWNKGILDSFLIEITRDILLYEDLDGTPLVEKILDSAGQKGTGKWTAINALDMGMPVTLIGEAVFARCLSSLKDERMRASALLSGPEIPKDAVKDRKQFVDDLEQALYASKIMSYAQGFMLMREAGKTFGWELNFPAIALMWRGGCIIRSVFLAQITKAYRENPYLENLLFNKFFADAVTKAQQGWRRTIGLATTYGIPTPAFSTALAFYDGYRSKRLPANLLQAQRDYFGAHTFRVLPEAASAHLPVDKDIHINWTGKGGNISASTYQA

SEQ ID NO: 13307 - protein, 885 aa, Sinorhizobium meliloti
MAQEVKTTCPYCGVGCGVIARVGDDGAVSVKGDPEHPANFGRLCSKGSALAETLDLDGRLLHPEIGGRRAGWSEALDLVAERFSRSIAEHGPDSVAFYVSGQLLTEDYYIANKLMKGFIGSANIDTNSRLCMSSSVAGHRRAFGSDTVPGAYEDLELAELVVLTGSNLAWCHPVLYQRLSAAKANRPEMKIVVIDPRRTMTADIADMHLAIAPDGDVALFNGLLAHLAASGAVDRNYISNYTSGFDEAVAAASRLDLPALSTATGLTVAQLRAFFRLFETTEKVVTCYSQGVNQSAAGTDKVNAIINCHLATGRIGRPGMGPFSLTGQPNAMGGREVGGLANMLAAHMDIEKSLHRDQVRRFWGAPSVASKPGLKAVDMFRAVADGRIKALWIMATNPVVSMPDADAVEAAIKACPFVVVSDIVRDTDTARHAHVLLPSLGWGEKDGTVTNSERRISRQRPFLAAPGEARPDWWQLAEVGRRMGFAAAFTHGSPAVIFAEHAALSGFENEGRRDFDISAHAEIDGPAYDGLRPFQWPQPQGSAPQKKRFFAEGAFYHPDGRARLVAVEVPRPRSANDAFPFTLNTGRVRDHWHTMTRTGKSARLSGHLAEPFVEIHPRDAQGAGISDADLVTLESPHGAAIVRALVTDRQAEGNLFVPMHWNDQFASKARIDALVAPVTDPVSGQPASKNMPVRASRFAAAAYGFAVSARKPRELDAAYWALARAEGGWRVELAFAETNADWLDWCRKTFAIAAGIEPIGYTDRTSGELRLAFFEGDRLLATLFLSPRPVAVARSWAVSQLGASHHNLAKRFAVTAGRPGADTPDPGATVCSCFSVGVNQITAAVRDGCHSVEAVGERLSAGTNCGSCRAEIRGIINGCLTLAAE

SEQ ID NO: 13308 - protein, 396 aa, Caulobacter crescentus
MSEPAHSNRALAVLLLVVFINLVGFGVIIPLLPFYARSMDAAPRQVTTMFAAYSLGQFFGEPFWGRLSDRIGRRPVLIVTIIANTLAYLALAFAPNIWVAMLIRLFGGFGSGNISTIQGYMADVTPPEKRAGRMGLLGAAFGAGFVIGPGLVMVMQPGAGALGYQLPLFLAAAMAGTAALGVILFVKESRAPSAPGAPQAHRLEALSQAAAHPVLSRVLLVTLISTAAFAGMEAVFGLYADTRFGWTASQVAACFALIGVIASIGQGVLTGRLARRFGEARVLTAGLSIIATSLLITPFISKPALAVVAVAFTAFGQSLVFPCVGALISRATPPDRQGQMLGLNMAAGSLARIGGPLLAGPLFGLAIGGPYWFGAALMVPAIGFALVIVRRTKVAA

SEQ ID NO: 13309 - protein, 143 aa, Oryza sativa
MVHGTLEVLLVGAKGLENTDYLCNMDPYAILKCRSQEQRSSIASGKGSNPEWNENFVFTVSDKATELLIKLLDSDTGSADDFVGEATIPLEAVYTEGSIPPTLYNVVKDEHYCGEIKVGLTFTPEDVRQRGLPEDFGGWKQSR

SEQ ID NO: 13310 - protein, 391 aa, Nicotiana plumbaginifolia
MEEDRLVFETSKGVEPIASFAEMGIKDDLLRGVYQYGFEKPSAIQQRAVLPIISGRDVIAQAQSGTGKTSMIALTVCQIVDTKSSEVQALILSPTRELAAQTEKVILAIGDYINVQAHACIGGKSVGEDIRKLEHGVQVVSGTPGRVCDMIKRRTLRTRGIKLLILDESDEMLSRGFKDQIYDVYRYLPPELQVVLISATLPNEILEITSKFMTDPVRILVKRDELTLEGIKQFFVAVEKEEWKFDTLCDLYDTLTITQAVIFCNTKRKVDWLTSKMRENNFTVSSMHGDMPQKERDAIMAEFRGGTTRVLITTDVWARGLDVQQVSLVINYDLPNNRELYIHRIGRSGRFGRKGVAINFVKSDDIKILRDIEQYYSTQIDEMPMNVADLI

SEQ ID NO: 13311 - protein, 458 aa, Prochlorococcus marinus
MENKEKNSNLENVVIIGSGPAGYTAAIYAARANLQPLLVTGFNSGGIPGGQLMTTTFVENYPGFPDGVLGPELMDLMKAQAERWGTNLYESDVVSINTDLHPFELKTLDGTIKANSIIIATGASANRLGVINEDKFWSKGISACAICDGATPQFRDEELAVIGGGDSACEEAAYLTKYGSKVHLIVRSEKLRASAAMVDRVKANPKIHIHWETKVEKANGSEWLEKIETIHSQEGKGEINIKGLFYAIGHTPNTKFLDKKIDLDNKGYIACKPGRPETSVEGIFAAGDVVDSEWRQGVTAAGTGCMAALATERWLAEKNLAKTIIRETPEPDKKLNSSDFNEDEVNEDTFDSNSEWQKGSYALRKLYHESKKPLLVIFSSPSCGPCHVLKPQLKRIIKELNGAVLGVEIDIDKDQDIAKQAGINGTPTVQLFKDKLLKKQWQGVKQRSEFKEAIKNII

SEQ ID NO: 13312 - protein, 319 aa, Erwinia carotovora
MGTVKHHKLLILGSGPAGYTAAVYAARANLQPVLITGMEKGGQLTTTTEVENWPGDADDLTGPLLMERMHAHATKFNTEVIFDHIERVDLQNRPFRLFGDSAEYTCDALIIATGASARYLGLPSEDAFKGKGVSACATCDGFFYRNQKVAVVGGGNTAVEEALYLSNIAAEVHLIHRRETFRSEKILIDRLMEKVKNGNIILHTNRTLDDVLGDDMGVTGVRIRDTQSDAAEELELAGVFIAIGHSPNTAVFGGQLALKNGYIKVQSGIHGNATQTSIPGVFAAGDVMDHIYRQAITSAGTGCMAALDAERYLDGLTVK

SEQ ID NO: 13313 - protein, 178 aa, Clostridium tetani
MEVAMEEKARNILITKEEIQQKVEAMGKKISKDYEGKNLYVLSLLRGSFMFTSDLVRYITVPTRIGFMTTSSYGHGEVSTGKVKVVNDIPDDIKGMDVLIVDDIVDTGITMDFVKNHVKSLGANSVKSCVLLDKPERRKLDLVPEYCCFSIPDVFVVGYGLNYGDFYRNIPYIFNWEE

SEQ ID NO: 13314 - protein, 153 aa, Lupinus luteus
GVLTDVQVALVKSSFEEFNANIPKNTHRFFTLVLEIAPGAKDLFSFLKGSSEVPQNNPDLQAHAGKVFKLTYEAAIQLEVNGAVASDATLKSLGSVHVSKGVVDAHFPVVKEAILKTIKEVVGDKWSEELNTAWTIAYDELAIIIKKEMKDAA

SEQ ID NO: 13315 - protein, 153 aa, Lupinus luteus
GALTESQAALVKSSWEEFNANIPKHTHRFFILVLEIAPAAKDLFSFLKGTSEVPQNNPELQAHAGKVFKLVYEAAIQLEVTGVVVSDATLKNLGSVHVSKGVADAHFPVVKEAILKTIKEVVGAKWSEELNSAWTIAYDELAIVIKKEMDDAA

SEQ ID NO: 13316 - protein, 181 aa, Triticum aestivum
  misc_feature (128)..(128): Xaa can be any naturally occurring amino acid
  misc_feature (157)..(157): Xaa can be any naturally occurring amino acid
EPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENXESAPPPMKKDYKLANLLCWEEEAIHGGEXGVLDSKRLWVIARVVIYSPILVWY

SEQ ID NO: 13317 - protein, 131 aa, Arabidopsis thaliana
  misc_feature (84)..(84): Xaa can be any naturally occurring amino acid
  misc_feature (115)..(115): Xaa can be any naturally occurring amino acid
PRPKWAFSVLLEPIFLASPSKAIIKIGGPTKLLLFIQPLLRLVGGLFLGVKFGKTTRGSFLCPGGQPISNRSFFEESSVFEGHXTKLGLTRVAFLLGNVDEPKKVDVIAAFAKDXSTCTTIVYTFKMGLTG

SEQ ID NO: 13318 - protein, 207 aa, Alteromonadales bacterium
MVLIFAAVDYDDAKSAFINSFKFFIHFIKDHRMSHYDESPEQIAQATEGYVMQQTMLRIKDPKPSLAFYQNVLGMKLLGKYDFPEMKFTLYFLGYEPTQPEGDDKTKAKWVFGRPALIELTHNWGTENDDSFKGYHSGNDEPKGFGHIGISVPDVYAASERFAKYDVEFVKKPDDGSMKGLAFIKDPDGYWIEILSPDGITDIIFGK

SEQ ID NO: 13319 - protein, 591 aa, Oryza sativa
MEIGAVENGGVVGGEVVAGKRGKTPQATETFEKVATIGVVANLTVYLVKRFNIGQIEAANITNIFFGTLNFAPLLGAFISDVYLGRFKTLAYGCFASLLGMLGMTLYASLPALKPPICHEKTRLGGGCNSPSTLQLSVLYLSLGFLIIGGGAIRPCSLPFGVDQFDKTDEEGRKGLNSYYNWYYGTSTAALVLSMIVIIYIQNNVSWPIGFGIPTLLMFLAIIMLFLGTNLYVHVQPEGSIFAGIAQVLVASFKKRNLKLPCPHDINQQGLMLYNPPSKGNRVFRLPLTSQFRFLNKGAIVMGDDINVDGSARNSWELCNVQQIEEVKCLIRIVPVCISGVLCFVALAQQFTYIILQTFTMDCHFGTHFEIPAGSVVSISLIALTLFIPIYDRILVPIARGFTGVESGITLLQRQGIGLAISPISMVVAGLVERKRRNSALSNGGISPMSVLWLAPQLVLMGIAEAFNAVGQIEFYNKQFPENMQTLAGSLFFCTIAGANYLSTALANIMRKVTTRDGHSSWLTDNINLGKLDYYFYFIALMGVLNLIYFLICSHFYQYKVMSLHSEESIKIPTKEEEATEIDIDTDAPSK

SEQ ID NO: 13320 - protein, 457 aa, Salmonella typhimurium
  misc_feature (128)..(128): Xaa can be any naturally occurring amino acid
MDHLPIFCQLRDRDCLIVGGGDVAERKARLLLEAGARLTVNALTFIPQFTVWANEGMLTLVEGPFDETLLDSCWLAIAATDDDTVNQRVSDAAESRRIFCNVVDAPKAASFIMPSIIDRSPLMVAVSXGGTSPVLARLLREKLESLLPQHLGQVARYAGQLRARVKKQFATMGERRRFWEKFFVNDRLAQSLANADEKAVNATTERLFSEPLDHRGEVVLVGAGPGDAGLLTLKGLQQIQQADIVVYDRLVSDDIMNLVRRDADRVFVGKRAGYHCVPQEEINQILLREAQKGKRVVRLKGGDPFIFGRGGEELETLCHAGIPFSVVPGITAASGCSAYSGIPLTHRDYAQSVRLVTGHLKTGGELDWENLAAEKQTLVFYMGLNQAATIQEKLIAFGMQADMPVALVENGTSVKQRVVHGVLTQLGELAQQVESPALIIVGRVVALRDKLNWFSNH

SEQ ID NO: 13321 - protein, 85 aa, Novosphingobium aromaticivorans
MAKEDLLTLEGVIDEILPDGRFGVMLENGHRIIAYTAGKMRKFRIRSIVGDSVRVEMTPYDLTKGRIVYREKVGGGGPGGVRRRR

SEQ ID NO: 13322 - protein, 489 aa, Unknown
  uncultured bacterium 106
MAKEIIINHTSHETRVAVIEGGELSELYHEREKTIRLVDNIYKGKVLNVLPGMESAFVDIGSEKAAFLHIDDILPEHEIFGEPSNNNGEQQKIGQLIQEGQDVLVQVSKGPIGTKGARITSHVSIPGRNLVYLPATKTLGVSRQINQEKERERLKEIVDRIRPENAGFIIRTVAEGHSEEDLHSDINYLVSIWDDILEKYKTLPAPSLLHSDLNVIFRTIRDLFSADIRKLVVDDKSQFNKVRQFVRSYLPRYGSVIENYTKAEPVFDHYGIENEIDRALGNKVWLRSGGHLVIDQTEALTAVDVNTGRFVGKESHEKTILRTNIEAAEEIVYQLQLRNIGGIIIIDFIDMETQQHRQMVYQTLKDKLRSDKARSKILQISEMGLVEMTRKRDRENLNRYLCDPCPYCDGTGQIKSPSTVCYEAFREVRRSCRRNTKGSVAIFLHSDVFKYIQEEEQEAVKFLEDEMGRSITIKLSDELHREQFELYEY

SEQ ID NO: 13323 - protein, 448 aa, Arabidopsis thaliana
MGIHFVDKADLWKSALLFNLKLRDRFRIAVDDHRGRATVFSPDGCFSSTIHRWVTRFRNFRRESLPSPPAFYRRRVSKDLTAEEESALFRMLQTVAVPLIGNACHVFMNGFNRVQVYGLEKLHDALLNRPKNKPLVTVSNHVASVDDPFVIASLLPPKFLLDARNLRWTLCATDRCFKNPVTSAFSRSVKVLPISRGEGIYQQGMDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 13324 - protein, 97 aa, Listeria monocytogenes
MHIALIAHDEKKDLMVGFATAYKHLLEPHQLYATGTTGLRIIEATGLTVHRFKSGPLGGDQQIGARISENKMDLVIFLRDPLTAQPHEPDVTALIRL

SEQ ID NO: 13325 - protein, 274 aa, Kalanchoe fedtschenkoi
MSEALSRVYEVCEEIGRGQFGRVFRCLNLSTNELFACKSIDKRVLADSIDRECVEKEPKTMLCLSSHPNIVSIHEAYEDDSHLHLIMDLCEPGLDLYQLLSGGAVPEQEASVIAASLMEGIAHCHRRGVCHRDVKPENVLFDSVGRLKLADFGSAEWFGDGRGMSGVVGTPYYVAPEVLQGREYNEKVDVWSAGVILYTMLAGFPPFYGETAQDIFEAVMRGNLRFPFRAFRNVSAGAKDLLRRMLCRDVSRRFSAEQVLRHSWILSAGDDTNF

SEQ ID NO: 13326 - protein, 372 aa, Pseudomonas fluorescens
MRSKVTGAQRWVVKIGSALLTADGKGLDRTAMGVWVEQMVALHEAGVELVLVSSGAVAAGMSRLGWTARPSAMHELQAAAAIGQMGLVQAWESSFAEHGRHTAQILLTHDDLSDRKRYLNARSTLRALVELKVIPVINENDTVVTDEIRFGDNDTLAALVANLVEADLLVILTDRDGMFDADPRSNPDAQLIYEARADDPTLDAVAGGTGGALGRGGMQTKLRAARLAARSGAHTIIVGGRLERVLDRLKAGERIGTLLSPERGMLAARKQWLAGHLQTRGTLVLDDGAVSALSQGNKSLLPVGVKLVQGSFRRGEMVVCVAPDGREIARGLANYSALEAQKIIGQSSDAIVGLLGYMAEPELVHRDNLILV

SEQ ID NO: 13327 - protein, 483 aa, Zea mays
MEWQRGKCIGKGAFGTVHLAVYTATGRAFAVKSVDSKSAPAAAMACLESEIRILRRLSSPHVVAYLGDDGATATTRNLHMELVPGGSATEAAAALGGLGERGARGVLRRVAAALRYLHEDAGVVHGDVKGRNVLLGCRDGDAAQCCGAKLADFGAARLVSDAAPARGPRGTPAWMAPEVARGGAATPASDVWALGCTALELLTGSRPWSELGGAAADVGELLLLVGFGGQRPAIPAWLPDACRDFLDKCLRRDAGQRWSCAQLLRHPFLSADAGETWPSPSPSPRAVLDWAPSDSDSEPMSSAEAESMHEVMARAKGRLAELASNGPRTSWDWHWDEVEWGSGPTRAADTWAPPPSYEAQRNGDASAPVPSTAAFSGGRDRDVLVLGSGSGSGLPCGHGRPGYHSHCCRYKCGFGRQWPRGRIEGDDADAREGSGDRCEKGSWGGSSAPTDSIQRRWSSGSFPNPRLAEPWALAFHVLKVARG

SEQ ID NO: 13328 - protein, 415 aa, Bacillus cereus
MNEVLAKGKKAKEIARELVLKSTEQKNEALSAIADQLILETAYILEENKKDIEEGKAKGFSDSLLDRLMLNEQRIVDMTEGIKQLIELRDPVGDCVSAWERPNGLSIQEMRVPLGVVGMIYEARPNVTVDAATICLKTGNAVILRGSSSAIHSNKAIVAVIHRALKQTSLPQESVQLIEDTTRDSAKQLFTMNDYLDVLIPRGGKQLIDTVVREASVPVLETGAGNCHVFIDETADKQMAFDIIINAKTQRPSVCNAIETIVLHEKWAEQYGSELFSSLKKRGVELRGDQKALAMDSSIVLASEEDWGTEFLSLTLAVKLVSSIEEAIHHINTYGSMHSEAIISENEENVSKFFVSVDAAALYHNASTRFTDGYEFGFGAEIGISTQKLHVRGPMGLPALTSIKYVIRGNGQIRK

SEQ ID NO: 13329 - protein, 360 aa, Sinorhizobium meliloti
MTALATLPLFWPLNGKQAVVAGGSDAAAWKAELLAACGAEVHVYAPRASLSDVFLDLLARGPAHEHGRLIHHDQAWHVGDFRDAAIAVADCDEQSDAEAFFLAGRSAGVPVNVIDKPAFCAFQFGSIVNRSPVVVAISTDGAAPILAQAIRRRIEALLPPALKHWATVAQAIRDRVNARLKPGSARRAFWERFVDRVFLDAPEEGVETRLMAEVDRLVTRPSAIGRVTIVGAGPGDAELLTLKAVRALQAADVILFDEWIPDDVLELARREARRVPVTPSAKGRSRDIAALVGEGKRVVRLRSGNPMALAGAVEEIAALEGLGVPVEIVPGVEAAPCRSDVIQVVFRRREVSQPGLRAAH

SEQ ID NO: 13330 - protein, 318 aa, Trichodesmium erythraeum
METYEFDVVIIGGGPAGCSCALYTSRADLKTVILDKNPAVGALAITHKIANYPGVAGNISGNALLDEMREQAISFGTKYQRAQVFGIDVEGSLKKVYTPEGTFLGRSLVLATGAMGRKSSLRGESEFLGRGVSYCATCDGAFFRQKEVAVYGVNQEAVEEAQFLTKFVSTVHWLTNKEPQHEDAHVQVLLSQPNVKHWNFTRLTSIQGNESGVTNILMKTRGEPEVASLQVDGVFVYQSGSRPITDYISPDIILIDNGGVKVDEMMATNVEGVWAIGDIRNTPFQQAVVAASDGCIAAMAIDRFLNKRKGIKRDWDHS

SEQ ID NO: 13331 - protein, 978 aa, Oryza sativa
MTPAPAAASYRALVALLLVAVAVADDGSTLLEIKKSFRNVDNVLYDWAGGDYCSWRGVLCDNVTFAVAALNLSGLNLGGEISPAVGRLKGIVSIDLKSNGLSGQIPDEIGDCSSLKTLDLSFNSLDGDIPFSVSKLKHIESLILKNNQLIGVIPSTLSQLPNLKILDLAQNKLSGEIPRLIYWNEVLQYLGLRGNNLEGSISPDICQLTGLWYFDVKNNSLTGPIPETIGNCTSFQVLDLSYNKLSGSIPFNIGFLQVATLSLQGNMFTGPIPSVIGLMQALAVLDLSYNQLSGPIPSILGNLTYTEKLYMQGNKLTGPIPPELGNMSTLHYLELNDNQLSGFIPPEFGKLTGLFDLNLANNNFEGPIPDNISSCVNLNSFNAYGNRLNGTIPPSLHKLESMTYLNLSSNFLSGSIPIELSRINNLDTLDLSCNMITGPIPSTIGSLEHLLRLNLSNNGLVGFIPAEIGNLRSIMEIDMSNNHLGGLIPQELGMLQNLMLLNLKNNNITGDVSSLMNCFSLNILNVSYNNLAGVVPTDNNFSRFSPDSFLGNPGLCGYWLGSSCRSSGHQQKPLISKAAILGIAVGGLVILLMILVAVCRPHSPPVFKDVSVSKPVSNVPPKLVILHMNLSLLVYEDIMTMTENLSEKYIIGYGASSTVYKCVSKNRKPVAVKKLYAHYPQSFKEFETELETVGSIKHRNLVSLQGYSLSPVGNLLFYDYMENGSLWDVLHEGPTKKKKLDWETRLRIALGAAQGLAYLHHDCSPRIIHRDVKSKNILLDKDYEAHLTDFGIAKSLCVSKTHTSTYVMGTIGYIDPEYARTSRLNEKSDVYSYGIVLLELLTGKKPVDNECNLHHLILSKTANNAVMETVDPDIADTCKDLGEVKKVFQLALLCTKRQPSDRPTMHEVVRVLDCLVRPDPPPKSAQQLAMPQRPAVPSYINEYVSLRGTSVLSCANSSCTSDAELFLKFGEVISQNTE

SEQ ID NO: 13332 - protein, 227 aa, Ostreococcus tauri
MVEKHVLSSKRSLGRFERYARAHCLNSADTSCSSLGVLSAKFMKLLSETENGILDLNHAATSLSAQKRRVYDITNVLEGIGLVSKLSKSKVALRRVDEDFVETTSGQHKEHKSLSRTVNIESSQTLPLASEDDASLHIETIRSFIRSVFTDSQLETGIFISQADIIEQHALSSDMLIAVRAPTGAALLLPSPFTQERSPPHYRLFLRSNENSSAGVEVFVLATDGST

SEQ ID NO: 13333 - protein, 413 aa, Nicotiana tabacum
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDDVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLSDIQKFYNVVIEELPANVADLL

SEQ ID NO: 13334 - protein, 139 aa, Rubrobacter xylanophilus
MPAAFIHTCYRITDPERTIDFYVNKLGMKKVGEMHFSDATNYFFAMEEDPSSPMLELTHNHDRTGPYEKGEGYSHIAFTVDDLEGTVARLAEQGVKVAVEPKTLTVDGHDYRIAFVEDPDGYRVELVQRGTMKVGDMLQ

SEQ ID NO: 13335 - protein, 695 aa, Ashbya gossypii
MAQLEDPKERAGKVGESQHGQHHNTAFIHKLYSMLEDDNMKDLIWWSASQNSFLIKPNEKFSKALATFFKHTNVASFVRQLNMYGFHKVSDHKPSSAKGTSQDEDEAINLWEFRHSMGCFRKGDKESLKSIKRRSSKNQVLLSRNNSAQSLASQYNSQQDLGPGGSSIAGHVHPIEPADKYYSTTVYQPPYTDAPPLHSQSQIQAYPDMRFPQEQKPHTSSVITLPHLPNSAIEDLRATNLDMMKLLDLVQKAMHISSPPSANELGGSVCSTSGGSGLSSNQLGSASGSANDVTSPSSFARSPTGTRERTLEYLHQEIAAFRTTILMKLQRHAELQLHMLPPTPSQRHSHPQNSYAVSAPPSTGTNFLPYNGSGSIGMPTGYDAYPTNKPALAIPGAISHGFHGSPYLMLDPYAKGSSSSISRKRHMSVLVDPLAPAPMSAPAAMQVPSLAQPTSTSSSPVHAPEGNMPHANAAGANSPFHASCPVSRIDSRQDLHHHQTSNPSASEDKRPFSPSRKDSPPSQLLPLLTTNARGSGDGNSLLLAPQSPATLPPTASQHRLPAPTPQNNAGRGPAQVSITYKPYFPYGTIPPQPVLSSQYILPLFQSGSGSFTSGSSVTAAHAPLRSTTAIPETSSCNNSEIPSFPKPTTDEQQAPATVNQSATNSHRQSIVNQDTCSSPATSKSRGLYALLNHDT

SEQ ID NO: 13336 - protein, 149 aa, Bacillus cereus
MGYIEELRKVFGSRPLNLAGVAVAVFNEQGQILLQQRRNGIWGVPGGFVELGESTEEAGRREVFEETGIEIGTLQLISVFSGKEFFVKLPNGDEFYPITIAYLCKDIKGGLLKADGIESLSVQFFDFDKLPENISPFIKKLIEQNLVSI

SEQ ID NO: 13337 - protein, 178 aa, Brassica napus
MENMGTRVIEPLIVGRVVGDVLDNFTPTIKMNVSYNKKQVSNGHELFPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 13338 - protein, 390 aa, Mycoplasma pneumoniae
MAAGKRDYYEVLGVSRSATAQDIKRAFRKLAMQYHPDRHKGEGETVQKQNEEKFKEVNEAYEVLSDTEKRGMYDRFGHEGLNASGFHETGFNPFDIFNSVFGEGFSFDMDGGSPFDFIFSRGKKSRQNRVVLPYDLEIAVGVDISFFEMTNGCTRTIEYTKRVTCSACDGFGAEGGETGMVSCNSCEGNGFILKNQRSIFGTVQSQMLCQSCGGQGKQAKHKCKTCKGSKYKKVPTTKEIQIPAGIYHGDALVDDHGGNEFGGHVGKLVVHVGVLPSKIFKRVDHNVVANVLVDPMIAITGGKIELPTLEGIKEFNLRAGTKSGEQIVIPGGGIKFTKNFRKKAGDLIIIISYARPSEYSAPELRKLKEFIKPNQEVKQYLNALKNEYKS

SEQ ID NO: 13339 - protein, 447 aa, Zea mays
TFPHLTRFQVKKKQFFRNFMTITLFGAVGTMISFFTISLGAIAIFSRMNIGTLDVGDFLAIGVIFFATDSVCGLQGLHQDETPFLYSLVFGEGVVNDATSVVLFNALQNFDLNHIDVAVVLNFLGNFCYLFVSSTLLGVFTGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDSPGKSIGISSILLGLVLVGRAAFVFPLSFLSNLTKKSPLEKITFRQQIVIWWAGLMRGAVSIALAYNKFTRSGHTELHGNAIMITSTITVVLFSTMVFGMMTKPLIRLLLPACSNTATSEPSSPKSLHSPLLTSMQGSDIETGSAQIVRPSSLRMLLSKPTHTVHYYWRKFDDALMRPMFGGRGFVPFSPGSPTEQSVHDGR

SEQ ID NO: 13340 - protein, 481 aa, Mycobacterium tuberculosis
MPSPTVTSPQVAVNDIGSSEDFLAAIDKTIKYFNDGDIVEGTIVKVDRDEVLLDIGYKTEGVIPARELSIKHDVDPNEVVSVGDEVEALVLTKEDKEGRLILSKKRAQYERAWGTIEALKEKDEAVKGTVIEVVKGGLILDIGLRGFLPASLVEMRRVRDLQPYIGKEIEAKIIELDKNRNNVVLSRRAWLEQTQSEVRSEFLNNLQKGTIRKGVVSSIVNFGAFVDLGGVDGLVHVSELSWKHIDHPSEVVQVGDEVTVEVLDVDMDRERVSLSLKATQEDPWRHFARTHAIGQIVPGKVTKLVPFGAFVRVEEGIEGLVHISELAERHVEVPDQVVAVGDDAMVKVIDIDLERRRISLSLKQANEDYTEEFDPAKYGMADSYDEQGNYIFPEGFDAETNEWLEGFEKQRAEWEARYAEAERRHKMHTAQMEKFAAAEAAGRGADDQSSASSAPSEKTAGGSLASDAQLAALREKLAGSA

SEQ ID NO: 13341 - protein, 281 aa, Clostridium tetani
MDLWLKEGQISDAVMTYKIKETLVRKKTEYQDLAIVDTYALGRMLVLDGIVQTSIKDEYVYHEMITHIPLYTHPNPKKVLVVGGGDGGTIREILKHPSVEKAVLCEIDEEVVKECKKHLPEISNNALEDSRCEVFIGDGIKYVNEHKNEFDVVIIDSTDPFGAAEGLFGGSFYGKISECLTEDGIFVAQTETPFYLPEIVKRVYDDSKAVFPVTKLFMAAIPTYPSGYWSFTIGSKKHDPEKAPVPEVLPFETKYYTPRLHSASFVLPKFVENLIFANISE

SEQ ID NO: 13342 - protein, 457 aa, Salmonella typhimurium
MDHLPIFCQLRDRDCLIVGGGDVAERKARLLLEAGARLTVNALTFIPQFTVWANEGMLTLVEGPFDETLLDSCWLAIAATDDDTVNQRVSDAAESRRIFCNVVDAPKAASFIMPSIIDRSPLMVAVSAGGTSPVLARLLREKLESLLPQHLGQVARYAGQLRARVKKQFATMGERRRFWEKFFVNDRLAQSLANADEKAVNATTERLFSEPLDHRGEVVLVGAGPGDAGLLTLKGLQQIQQADIVVYDRLVSDDIMNLVRRDADRVFVGKRAGYHCVPQEEINQILLREAQKGKRVVRLKGGDPFIFGRGGEELETLCHAGIPFSVVPGITAASGCSAYSGIPLTHRDYAQSVRLVTGHLKTGGELDWENLAAEKQTLVFYMGLNQAATIQEKLIAFGMQADMPVALVENGTSVKQRVVHGVLTQLGELAQQVESPALIIVGRVVALRDKLNWFSNH

SEQ ID NO: 13343 - protein, 550 aa, Erwinia carotovora
MFCVQCEQTIRTPVGNGCSYAQGMCGKTAETSDLQDLLVAVLQGLSAWALKARELDIIDHDVDNFAPRAFFSTLTNVNFDSQRIIGYAQEAITLRESLAVRCRLHDATATVDHPMAALQLAGNDIPTLLQQAEDFALDSDKAIVGDDVHGLRMLNLYGLKGAAAYMEHAHVLGQYDNAIYAEYHAFMAWLGTQPTDVDTLLNNAMGIGKMNFNVMAILDHGETDAYGHPQPTSVNVRPIAGKAILISGHDLKDLRMLLEQTEGTGVNIYTHGEMLPAHGYPELKKFKHLAGNYGSGWQNQQTEFAKFPGAIVMTSNCIIDPNVGNYGDRIWTRSIVGWPGVNHLEGDDFSSVIEQAQGLAGFPYSEIEHMITVGFGRETLLSAADTVIDLVAQKKLRHVFLVGGCDGSREERSYFTDFTLSVPQDCLIMTLACGKYRFNKLDFGTLEGLPRLLDVGQCNDAYAAIILAVKLAEKLGCGVNDLPLSLVLSWFEQKAIVILLTLLSLGVKNIYTGPTAPGFLTDNLLAILNDKFGMRAITTVEQDMNTILAA

SEQ ID NO: 13344 - protein, 200 aa, Zea mays
  misc_feature (11)..(11): Xaa can be any naturally occurring amino acid
  misc_feature (45)..(45): Xaa can be any naturally occurring amino acid
  misc_feature (108)..(108): Xaa can be any naturally occurring amino acid
  misc_feature (112)..(112): Xaa can be any naturally occurring amino acid
  misc_feature (124)..(124): Xaa can be any naturally occurring amino acid
  misc_feature (151)..(151): Xaa can be any naturally occurring amino acid
  misc_feature (174)..(174): Xaa can be any naturally occurring amino acid
  misc_feature (186)..(186): Xaa can be any naturally occurring amino acid
MWKRSARCYRXINNKPYSKSMFCRGVPDPKIRIYDVGMKRKAVDXELPYCVHLVSWEKENVSCEGLEDARIACNNYMTTTACNDAFHLRIRTQPFHVLRINKMLSCAXADRXSRRGMRGAFGKXYGTCATMDIADVLLTVPCKYNNAAHAXSEALSPSKFKFPGRQKIIDTQRXGFIYCSLADYLXDNSDGRIVPDGVYG

SEQ ID NO: 13345 - protein, 533 aa, Glycine max
MLAIQLSLQCPCILLFCPCSLDAFYNLWDTQISIFCNFTQTRKLTMAQPASLTRIGLAGLAVMGQNLALNIAEKGFPISVYNRTASKVDETVERAKQEGNLPVYGYHNPKFFVQSIQKPRVIIMLVKAGAPVDQTIKTLSAHLEKGDCIIDGGNEWYENTERREKAMSELGLLYLGMGVSGGEEGARHGPSLMPGGSFEAYKYIEDILLKVAAQVPDSGPCVTYIGKGGSGNFVKMIHNGIEYGDMQLIAEAYDVLKSVGKLSNEELQSAFSEWNKGELLSFLIEITADIFGIKDDKGEGHLVDKVLDKTGMKGTGKWTVQQAAELSIAAPTIEASLDARFLSGLKEERVEASKVFKSSGFDEILSDQHVDKKQLIDDVRKALYAAKICSYAQGMNLIRAKSIEKGWDLKLGELARIWKGGCIIRAIFLDRIKKAYDRNPNLANLLVDPEFAKEIVDRQSAWRRVVCLAINYGTSTPGMAASLAYFDTYRRERVPANLVQAQRDYFGAHTYERIDMEGSFHTEWFKLAKQSRT

SEQ ID NO: 13346 - protein, 316 aa, Glycine max
  misc_feature (272)..(272): Xaa can be any naturally occurring amino acid
  misc_feature (290)..(290): Xaa can be any naturally occurring amino acid
MWWLGRKGPSGFSASSTAEEVTQGIDGSDLTAIVTGATSGIGVETARALALRGVHVVMGIRNMTAGGEIKETILRYNPIAKIDMMELDLSSMESVRTFASQFNSRGLPLNILVNNAGIMATPFKLSKDKIELQFATNHIGHFLLTNLLLETMKRTAIEQRKEGRVVNVSSRRHKLSYPEGIRFDKINDKSGYNSLSAYGQSKLANVLHTNELARRLKQEEGTNITANSVSPGPIATNLFRYHSLMEVFVGILGKYAMKNIQQGAATTCYVAXLHPQVKGLTGCYFADSNXAEASSQASDPEVARKLWEYSSDLVKF

SEQ ID NO: 13347 - protein, 325 aa, Anaplasma marginale
MTEPQQQAKAPVKVLVMGSGAAGCTAAIYAGRANLEPLLVTGMQPGGQLTITTDVENYPGFSLVQGPELMEHMKQQALHCGATEIMDEITQIDANVYPFKCTSMFGEEYYAYSIIVATGAQAKWLGMDSEQFFMGKGVSACATCDGSFFKGEVVAVIGGGNTAVEEAIYLTRSASKVFLVHRRDKLRAEAVMQNRLFENSKIEVVWNSVVKEILGDKENKKVGALLLESTLDGSTRTLETAGVFIAIGHKPNTQVLADMPGRHVELDPDGYVITSPDSTATSCPGIFAAGDVRDKVYRQAVVAAGTGCMAALDAEKFLSERGITS

SEQ ID NO: 13348 - protein, 182 aa, Gossypium hirsutum
MASSMISSATIATVNCSSPAQANMVAPFTGLKSASAFPVTRKANNDITSLASNGGRVQCMQVWPPLGKKKFETLSYLPDLTPVQLAKEVDYLLRSKWIPCLEFELEEGFVHRKYSSLPTYYDGRYWTMWKLPMFGCTDSAQVLEELENCKKEYPNAFIRIIGFDNVRQVQCISFIAYKPKGY

SEQ ID NO: 13349 - protein, 352 aa, Legionella pneumophila
MKKILFIDRDGTLVEEPFDFQVDSLDKIKLTSGVIPALLQLQKAGFTFIMVSNQNGIGTVAFPEEDFAVCHEFILDLFSSQGILFDEIFICPHTPEDNCICRKPKTGLLEPYLKETAFAKHYSWVIGDRDTDKEFADNLGVNFLPISKTHTWEMVVSAIINDARKASVQRKTKETAIDLSVQLDSDQTSVIDTPIPFFTHMLEQVAKHGGFDLRLQASGDLEVDEHHLIEDTAIALGEAIRTALGDKWGINRYGYTLPMDESLACVAIDISGRSFCDFKGQFTREFVGGMATEMVPHFFQSLSSALGATIHIEVTGTNHHHMIEACFKVLGRALRQACSRTNNYLPSTKGVL

SEQ ID NO: 13350 - protein, 175 aa, Xylella fastidiosa
MHPQNFQHQLKTMPQPPDETRDFVFNHTMLRVKDINASLDFYARILGFRLIDQRDFPEAQFSLYFLALLPQTVHISDNDAERRLWMSGIPGVLELTHNYGTETQEGQIYHDGNNEPRGFGHICISVPDLYSACARFDTLQVPYQKRLTDGRMKNIAFIKDPDGYWVEIISNTPLP

SEQ ID NO: 13351 - protein, 778 aa, Rickettsiella grylli
MHNEKNRILINANQPGEIRVALLEANKLSDLDMEYTGQEQKKSNIYKGKISRIEQSLEAAFISYGAERHGFLPFKEIAPSYLKGKNYDLQSIKHSLKVGQELMVQIEKEERGDKGAALTTYITLPGSYLVLMPNNPGAGGISRRIEGDERREMQDLMHDLIEQTELSKNMGLILRTAGVGREFSELKNDLNLLIQQWNAIQKAYHERPAPFLIFQEGDLITRSVRDYLRRDIDEIIVDDKKIHEKIKQYIEQIRPDFVSRISLYQNHIPLFMYFDIEEAVESAFKRKIELPSGATIVIDRTEALVSIDINSGRSTKNEDIEETAVATNLEAAKEIAHQLRVRDLGGLIVIDFIDMNSEENQRKVENCFRLAVKKDRARIQIGRISTFGLLEMSRQRLRHSLGKANETLCSRCNGQGTVRTIESFALFLLRSIEKETLKKSTQHIRVELPVDIATYLFNEKRLALQHIEHQYNVNLLLIPNPYWQSPQYKITSFSKTNNLKTNDAASYQMLDKSHLESSLLHHSPSAKVVEIPAVKPLTFINNKNKTVGLLGRLLGMLKDFGKIKTDLNKKQPSKNKITTPYSHEAHKYTSGRRYSKTRHNHNRVRHRRDEKEKLNNDSGGNEQHASSHSFKSSHHRYNRYPTQRYESPSAVKPTPAITTEKKSSIHKRKQPLSTKKQDNKINHQQSPQRLEKSIVSSPDLNSRKTAASSQHVVKKSTPAFEEKGSSDPIAQAVISHSNTALSTRSSTNSPRRNTRRYGGEPKLRHRAYSHYERQKTKN

SEQ ID NO: 13352 - protein, 356 aa, Nicotiana tabacum
MSPLSDLISLNLSDSTQKIIAEYIWIGGSGMDLRSKARTLSGPVTDPSELPKWNYDGSSTGQAPGEDSEVILYPQVYFKDPFRRGNNILVMCDAYTPAGEPIPTNKRHAAAKIFSNPDVVAEEPWYGIEQEYTLLQRDINWPLAWPIGGFPGPQGPYYCGTGADKAFGRDIVDSHYKACLYAGFNISGINGEVMPGQWEFQVGPSVGISAGDEVWVARYILERIAEIAGVVVSFDPKPIPGDWNGAGAHTNYSTKSMREDGGYEVILKAIEKLGLKHKVHIAAYGEGNERRLTGKHETANISTFKWGVANRGASVRVGRDTYKAGKGYFEDRRTASNMDPYAVTAMIADTNHICKS

SEQ ID NO: 13353 - protein, 648 aa, Listeria monocytogenes
MDDTDKRVHKYIEKHDLIRSDDKLLVAVSGGPDSLALLHFLWNSNLVPKEAISVAHLNHHLRENAANEQNVVETFCESQGIPFYIEEVDVKSRAESLQKGIEETARIVRYDFFEKVMAEKKINKLALAHHADDQIETILMRLVRGSASIGWSGIQPKRELKGGQAIRPFLPITKAEIIDYAQKHELAYEIDESNTSQEYTRNRYRAQLLPFLKQENPAVYSHFERFSEETSEDFQFLEALASDLLKKNLIKNGKRTTLLLTNFKNEANPLQRRAIHLLLRYLYNEDASFITVNHIYQIIQMIQSDNPSSSIDLPNKLVANRAYDKLHFQFGEREAPSEFYHQLELNDRIELDNKASIRLKLKSSVVQTNGLNGMLLDAEEITLPLIVRNRVNGDRMTMKGQAGSKKLKDIFIDAKIPRQERDKLPVITDYTGKILWVPGVKKSAYDREFSRSKKQYIIRYTRNIGGNESMHNDIQKVLISEDELQEKIRELGRELTTEYEGRNPLVVGVLKGATPFMTDLLKRVDTYLEMDFMDVSSYGNGTVSSGEVKIIKDLNASVEGRDVLVIEDIIDSGRTLSYLVDLIKYRKAKSVKLVTLLDKPAGRNVEIEADYVGFVVPNEFVVGYGLDYAERYRNLPYIGILKPEIYSE

SEQ ID NO: 13354 - protein, 356 aa, Nicotiana tabacum
MAHLSDLVNLNLSDSTQKIIAEYIWIGGSGMDVRSKARTLSGPVDDPSKLPKWNYDGSSTGQAPGEDSEEILYPQAIFKDPFRRGNNILVICDCYTPAGEPIPTNKRHSAAKIFSHPDVVVEEPWYGLEQEYTLLQKDINWPLGWPLGGFPGPQGPYYCGIGAGKVFGRDIVDSHYKACLYAGINISGINGEVMPGQWEFQVGPSVGISAADELWAARYILERITEIAGVVVSFDPKPIPGDWNGAGAHTNYSTKSMRNEGGYEVIKKAIENLGLRHKEHIAAYGEGNERRLTGRHETADINTFKWGVANRGASIRVGRDTEREGKGYFEDRRPASNMDPFVVTSMIAETTILSEP

SEQ ID NO: 13355 - protein, 330 aa, Ustilago maydis
MSKLGDYAAVKKDILAVLKQPEYDDGSAGPVLVRLAWHASGTYCARTDTGGSNGAGMRYEAEGGDPANAGLQHARVFLEPIKEKHSWITYADLWTLAGVVAIEAMGGPSIQWKPGRTDFADDSRLPPRGRLPDGAQGADHLRFIFNRMGFNDQEIVALSGAHNLGRCHSDRSGFEGPWVNSPTRFSNQYYKLLLKLKWQPKKWDGPFQYVAKAPGADDDDEQLMMLPTDYALIQDEKMRPWVEKYAEDRDAFFNDFAKVFAKLIELGVYRDESGIARADKMKQFKGEYKSAPQKSPVPGAPGAGKDGEANPLARQNERAHGQAQHALAKL

SEQ ID NO: 13356 - protein, 502 aa, Alonsoa meridionalis
MEVGNEAKSTALPPAQAAPVKNIIVVAAIAAGVQFGWALQLSLLTPYVQLLGVPHVWAAFIWLCGPISGLLVQPIVGYYSDNCTSRFGRRRPFIAAGAGLVAVAVFLIGFAADLGHMGGDSLGKGTKPRAVAVFVVGFWILDVANNMLQGPCRALLADMSAGNAKKMSSANSMFSFFMAVGNVLGYAAGSYTRLYKVFPFSKTEACAVYCANLKSCFFISVALLLTVTIIALCIVRETPYTAPPEEAGTVKKHTVPVFGELFGALKDLPRPMWMLLLVTALNWVAWFPFLLFDTDWMGKEVYGGKVGEGSLYDKGVRVGALGLMLNSVVLGVASLGVQVTARGLGGVKRLWGSVNLLLAICLAMTVLITKMAQHHREYASVGGAAPTLQPPVHGVKIGALALFSVLGIPLAATFSIPFALASIYSSNSGAGQGLSLGVLNLAIVIPQMFVSVASGPWDALFGGGNLPAFVVGAVAATVSGIIALTALPSPPSDVKILATGGH

SEQ ID NO: 13357 - protein, 323 aa, Caulobacter crescentus
MSGRITSAFGAKSTAREVVAGHDLSGRVAIVTGAATGIGVETARALALAGAEVIIAARKPELGEEVANAINEEAGSKRVSFGMLDLSSLEAIRHFVNVWGDRRIDILINNAAVMASPLMRTADGFEMQFGTNHLGHFLLSVLLAPNLIAGAKASGKPSRLVSLSSIGHRRSGIHFDDPNYTTRPYEKWEAYGQAKTANSLFAVGFDKRFKDQGVHANAVMPGGILTPLQRHLPIEEQRALGWLDENDQPREGFKTTEQGAATSVWAAVGSELEGVGGLYLEDCNQALPWSKENPWTGVMPHALDPEAADRLWDLSVDIVGAGA

SEQ ID NO: 13358 - protein, 228 aa, Hordeum vulgare
SASSPRFLGDSGRVGLAKSTRRDVAVQAKGSWLPGLQSPAYLDGSLAGDNGFDPLALAEDPEDLRWFVQAELVNGRWAMLGVAGMLIPEVLTKAGLLNAPEWYDAGKETYFASSSTLFVIEFILFHYVEIRRWQDIKNPGSVNQDPIFKSYSLPPHECGYPGSVFNPLNFAPTLENKEKELANGRLAMLAFLGFLVQHNVTGKGPFENLQQHLADPWHNTIIQTISGQ

SEQ ID NO: 13359 - protein, 106 aa, Kluyveromyces lactis
MLIPKEDRKKIYQHLFQEGVLVAKKDFNQPKHEEIDTKNLFVIKALQSLTSKGFVKTQFSWQYYYYTLTEEGVVYLREYLNLPEHIFPATYLAGQSGDQRPQGKKY

SEQ ID NO: 13360 - protein, 308 aa, Listeria monocytogenes
MTIANSITDLIGKTPIVKLNRLPEAGSADVYVKLEFQNPGGSVKDRIANAMIESAEKSGALKPGDTIIEPTSGNTGIGLAMVAAAKGYQAIFVMPETMSLERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATVKAALDLAKELGAGKKVLAIVASNGERYLSTPLYNFED

SEQ ID NO: 13361 - protein, 91 aa, Oryza sativa
MSSRSRSRASSAARITDEQIGDLVSKLQALLPEARLRSNDRVPSARVLQETCSYIRSLHREVDDLSERLAELLAAADVSTAQAAVIRGLLM

SEQ ID NO: 13362 - protein, 548 aa, Methanocaldococcus jannaschii
MKFEPRPTKMFCFQCQEAAKNEGCTIKGVCGKDDVVANLQDLLIYTIKGLCYVCDKGNYLDDEVMDYIPKALFVTITNVNFDDKDVINWIKKGVALREKIIEKNNLNKEELPYCATWAYETDEDLINLANTKEVSVLAEDNEDIRSLKELITYGIKGIGAYLSHAMHLGYNNEDIHKFIIKAFTKIVDSKDADELFNLAMETGKYAVETLALLDKANTETYGHPEITEVNLGVRDRPGILISGHDLKDLEQLLEQSKDAGVDIYTHCEMLPAHYYPFFKKYEHFVGNYGGSWPFQREEFEKFNGPIVMTTNCLVPPKDSYKDRVYVTNEVGYPGLKRIPVKEDGTKDFSEVIEHAKKCKPPTPLENGKIVGGFAHNQVLALADKVIEAVKSGKIRKFVVMAGCDGRHKTREYYTEFAKKLPKDTVILTCGCAKYRFIKLDLGDIDGIPRVLDAGQCNDSYSLVKIALALKDAFGLNDVNELPIAYNISWYEQKAVTVLLALLYLGVKNIVLGPTLPAFLSPNVTKVLVEKFGISTISTVDEDIKRLVG

SEQ ID NO: 13363 - protein, 629 aa, Arabidopsis thaliana
  misc_feature (594)..(594): Xaa can be any naturally occurring amino acid
MDTKIGSIDDCKPTNGDVCSPTNGTVATIHNSVPSSAITINYCDATLGRHLARRLVQAGVTDVFSVPGDFNLTLLDHLMAEPDLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLDDAHEQIDKAISTALKESKPVYISVSCNLAAIPHHTFSRDPVPFSLAPRLSNKMGLEAAVEATLEFLNKAVKPVMVGGPKLRVAKACDAFVELADASGYALAMMPSAKGFVPEHHPHFIGTYWGAVSTPFCSEIVESADAYIFAGPIFNDYSSVGYSLLLKKEKAIVVQPDRITVANGPTFGCILMSDFFRELSKRVKRNETAYENYHRIFVPEGKPLKCESREPLRVNTMFQHIQKMLSSETAVIAETGDSWFNCQKLKLPKGCGYEFQMQYGSIGWSVGATLGYAQASPEKRVLAFIGDGSFQVTVQDISTMLRNGQKTIIFLINNGGYTIEVEIHDGPYNVIKNWNYTGLVDAIHNGEGNCWTAKVRYEEELVEAITTATTEKKDCLCFIEVILHKDDTSKELLEWGXHASLLLTAVLPILSRRSNTESSMLLTNLVTFSDKC

SEQ ID NO: 13364 - protein, 490 aa, Unknown
  Synechocystis sp. PCC 6803
MVTSPPTSSPSQRSYSPQDWLRGYQSQPQEWDYWVEDVEGSIPPDLQGTLYRNGPGLLEIGDRPLKHPFDGDGMVTAFKFPGDGRVHFQSKFVRTQGYVEEQKAGKMIYRGVFGSQPAGGWLKTIFDLRLKNIANTNITYWGDRLLALWEGGQPHRLEPSNLATIGLDDLGGILAEGQPLSAHPRIDPASTFDGGQPCYVTFSIKSSLSSTLTLLELDPQGKLLRQKTETFPGFAFIHDFAITPHYAIFLQNNVTLNGLPYLFGLRGAGECVQFHPDKPAQIILVPRDGGEIKRIPVQAGFVFHHANAFEENGKIILDSICYNSLPQVDTDGDFRSTNFDNLDPGQLWRFTIDPAAATVEKQLMVSRCCEFPVVHPQQVGRPYRYVYMGAAHHSTGNAPLQAILKVDLESGTETLRSFAPHGFAGEPIFVPRPGGVAEDDGWLLCLIYKADLHRSELVILDAQDITAPAIATLKLKHHIPYPLHGSWAQT

SEQ ID NO: 13365 - protein, 519 aa, Oryza sativa
MVSALAGLQDHLKLARDYALEGLYDTSIIFFDGAIAQINKHLTTLDDALIRTKWLNCKKAICDEVEIVKQLDAQLKAFKEAPGARRSSSPPIRSNNKSFVFQPLDEYPTSSPAPFDDPDVWAPPRDTPNRRPTRGQSSTRKSSQDGAWARGPSKTGTPSRGAKPNGSKGNSGARSSTASSTGGRKGKSSSSKADSVSSDAEEGKSKKGQYEGPDMDLAAMLERDVLDSTPGVRWDDVAGLSEAKRLLEEAVVLPLWMPEYFQGIRRPWKGVLMFGPPGTGKTLLAKAVATECGTTFFNVSSATLASKWRGESERMVRCLFDLARFYAPSTIFIDEIDSLCTSRGASGEHESSRRVKSELLVQIDGVNNSSTTEDGQPKIVMVLAATNFPWDIDEALRRRLEKRIYIPLPNFESRKALININLKTVEVATDVDIDEVARRTEGYSGDDLTNVCRDASMNGMRRKIAGKTRDEIKNMSKDEISKDPVAMCDFEEALAKVQKSVSPADIEKHEKWQAEFGSA

SEQ ID NO: 13366 - protein, 155 aa, Triticum turgidum
LNKVTDGCVGRVAAKLESMEPCSSVKDRIGYSMITDAEEKRFIVPGKSVLIEPTSGNTGIGLAFMAAAKGYRLVLTMPASMSTERRIILKAFGAELILTDPLLGMKGAVQKAEELAAKTPNSYILQQFENAANPKIHYETTGPEIWKGTGGKIDG

SEQ ID NO: 13367 - protein, 984 aa, Unknown
  Rhodococcus sp. RHA1
MSGAVRTQRNRSHLVPAEPRTAIRGVPLTSDFPSRHIGPDAAASRRMLDALGYDSLANLIDSAVPDQIRSSQPLNLPAARSEQQVLADLRALSERNETRVQMIGLGYSDTITPAVLRRNMLESPAWYTAYTPYQPEISQGRLEALLTFQTVIEDLTALPLAGASLLDEATAVMEAVLLMRRANKSKSATNRVVLDADCLPQTLAVVRGRAKAVGIEVVVAELSGELPDGDMFGVVFQAPGASGAVRDLAPMIAAAKARGALTTVAADLLSLTILTPPGEQGADIAVGSAQRFGVPLFFGGPHAGYMAVRSGLERMLPGRLVGVSVDVDGKTAYRLALQTREQHIRRDKATSNICTAQALLANVAAMYAAYHGPEGLRAIANRVHTHATTIAGSLRAAGHTIVHDSFFDTVLVRVPAGAGAIVESADRDGINLRLVDSDHVAIACDECTTDDIVRRVVAVFGAQPTTVAVPELPSALARTSNYLQHPVFHDHRSETAMLRFLRTLSDKDLALDRTMIPLGSCTMKLNSAVEMEPISWPGFASIHPYAPVAQTAGYLELVADLERWLGEITGYDRVSLQPNAGSQGELAGLLAIHGYHESRGDFERNVCLIPQSAHGTNAASAVLAGMKVVVVATAENGNIDVGDLRAKIAAHEGAIAAIMLTYPSTHGVYENDVRTVCDLVHEAGGQVYVDGANLNALVGLAQPGKFGGDVSHLNLHKTFCIPHGGGGPGVGPVAVRKHLAPFLPGNPLGGDDLGTPVSAANYGSAGILPITWAYIALMGPDGLTSATETAVLAANYVAQSLDRHFPVLYTGPSGLVAHECILDLRHVTKATGVTAEDVAKRLIDYGFHAPTLSFPVNGTLMVEPTESEDLAELDRFIEAMVSIRREIDLVGDGVWPLERSPLRQAPHTAEQVTADEWDLPYPRHLAAYPVASLRAAKYWPPVRRIDGVHGDRNLVCSCPAPEAFENTTDIDTSAIAETPEEAFA

SEQ ID NO: 13368 - protein, 177 aa, Glycine max
TILGVYSPPSAGSSPGEADAFMGPVVQFLARTGAPLMANIYPYLAWAYNPSAMDMSYALFTASGTVVQDGSYGYQNLFDTTVDAFYTAMAKHGGSNVKLVVSESGWPSGGGTAATPANARIYNQYLINHVGRGTPRHPGAIETYVFSMFNENQKDSGVEQNWGLFYPNMQHVYPISF

SEQ ID NO: 13369 - protein, 139 aa, Ralstonia eutropha
MNTEPESTGQAGTEVTAFDLVGGEARVRELVDRFYDLMDLEPEFAGLRALHPASLDGSRDKLFWFLCGWLGGPNHFIERFGHPRLRARHMPFEIGISERDQWMRCMALAMQDVGLSEDLQMRLMQAFFQTADWMRNVAR

SEQ ID NO: 13370 - protein, 434 aa, Rubrobacter xylanophilus
MGARASSFRGGADARRIPRSGGGAERMMIGPYTEVVDAEVQEALDGELERQRTTIELIASENFASPAVLAAQGSVMTNKYAEGYPGRRYYGGCEFMDRVELLAINRAKELFGAEHVNVQPHSGSQANEAAYATLIEPGDKVLSMDLAHGGHLTHGMKINFSGRTYEFVHYGVGEDGFIDYDRVREIALRERPRLILAGASAYPRVLHFDRFREIADEVGAYFMADMAHVAGLVAGGVHPSPVPHCEVVTTTTHKTLRGARGGMVLCREEFASRLGSRVFPGLQGGPLMHAIAGKAVALGEALRPEFKDYARRIVENARALAEGLMEGGLKLVSGGTDNHMMLVDLRGSGITGKELEQRLESVGVTCNKNMVPGDPEPPTVTSGVRLGTPAMTTRGMGPGEMREIADIIVRAARGETDGLRRRVLALTEAFPLYA

SEQ ID NO: 13371 - protein, 422 aa, Unknown
  Rhodococcus sp. RHA1
MSVLNRDLADFDPDVAALIGKELERQRTGLEMIASENHAPLSVMQAQGSVLTNKYAEGYPGRRYYGGCEHVDTIEQLAIDRVKALFAAEYANVQPHSGATANASVMHALIEPGDTILGMSLADGGHLTHGMRLNFSGKLYNVAAYGVSEQDYLIDMDEVAKAAREHRPQLIIAGWSAYPRHLDFARFREIADEVGAYLMVDMAHFAGLVATGFHPSPVPHAHVVTSTTHKTLGGPRGGIILTGDAAIAKKINSAVFPGQQGGPLEHVIAGKATAFKMAAEPEFAERQERCLDGAKVLAERLSRPDVKEAGISVLTGGTDVHLVLVDLRDAAIDGQQAEDRLDAIGITVNRNAVPFDPRPPMVTSGLRIGTPALAARGFGRDDFATVADLIAQALVAPADADTSGLAAQVRALADKYPLYPGL

SEQ ID NO: 13372 - protein, 259 aa, Brassica napus
  misc_feature (228)..(228): Xaa can be any naturally occurring amino acid
MSNYEEQPRAKKTKREAFRLSCLPDDLVLNCLARVSRPDLAALSMVSKRYHSLVASPDLYKIRSLIGRTETYVYVCLRIPTPVPSVRWYILRRRKTLDASDLIQIPSLPSQPLEASSVVVLDCSIYVIGGLIKGEQRSSDVWSLDCRTHVWHPVPSMGAARAYGAAGVVDGKIYVFGGCDVDDNYGEVFDPEIQTWNPLPPMPKRKKHIHSSMVRDQKVYALDEKREXFYYSPREGKWGTGNRGQLVGYRRDWCMVDNL

SEQ ID NO: 13373 - protein, 510 aa, Triticum aestivum
  misc_feature (62)..(62): Xaa can be any naturally occurring amino acid
APLSGIDLLSRIVAADECKNIPVISIAMVMSSQDSIGTVLKCMQNGAVDFLVKPVRKNELRXRNLWQHVWRRHSMNSQLNASENNAASNHISVNSGSGSKTGENSDEESDAQSSGSKRETEIQIVEKLPEIKNVHSKYLHGITSAKVAGQIMDNAMRIADASSCRPSDPGKDLMATAQPTSSKKCKSPVTKNNAVKPVMENTLHENSKGAAIGHPQPCPSHSLDVNLGKQQRSDGHVNQELRDKDNFNHSNSSAFSRYGNKRIEPSAKQLCTVGPAIPSSSSAREDAGTSSSSPRKDNFGHPPYGFIPVPLSVAAAIPYQYSAIMPPIYYTQPPFMQCDPSGINQMGIQHAYHSSYHQNLGKPSEIDEHRQLEENQRLHHSRQILQESGEPIDLLRAHAERNNQTASCSQDIRGWTVSGETDTNTNAIIAPESGNESGIQNFGYNGLDSDRSRREAALMKFRMKRKDRCFEKKVRYHSRKKLAEQRPRIKGQFVSQKLKSATTTEDAETD

SEQ ID NO: 13374 - protein, 136 aa, Oryza sativa
MRRSLTTPPPPLSSPPARAPPPPPPAISPSPRRPPWQSQRLKSGWKEMPSIQKALPPELADNVIRLYRECLRRARFIGHQKHNTGLIVSMVREQFKKNMHETDPEKIQKMKDDAARGLINHILYESEKMTGRKFSS

SEQ ID NO: 13375 - protein, 569 aa, Clarkia epilobioides
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSSICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLQATSDVPADPSTLLPNI

SEQ ID NO: 13376 - protein, 173 aa, Triticum aestivum
MAMRALALSPSQSSSFGLHQSMPSFKPSSASPARPVRAYAKADEQEEEKKKVPKQSLFGNITEALDFSQVRSEKDAELLYEARDSIKDEGRMTREQYAALRRKIGGTYKDFFKSYVEVDGEYVEEGWVDKTCKVCKKDTRGEPRQVDNLGRYMHVACAENSKPTNFFSKLFSR

SEQ ID NO: 13377 - protein, 209 aa, Vibrio vulnificus
MLNKQIMVDADNALAGRQEAMAVEPIHFVNGSDITAPATQGQQEILLGMGCFWGAERLFWQLDGVVSTSVGYSGGFTLNPTYQEVCSGQTGHTEVVRVIFDPQVLPLEQLLEKFWERHDPTQGMRQGNDLGTQYRSAIYTFSDQQLDIALASQQAYQAALANQQHNTITTEIRPAGPYFYAETYHQQYLAKNPEGYCGLGGTGVCFPPA

SEQ ID NO: 13378 - protein, 569 aa, Clarkia epilobioides
MATPALISETEAWKDLKAHLEGIKRTHLRELMGDTERSQSMMVEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLGIYEHRVAVQGFVWGINSFDQWGVELGKSLATQVRKQLHASRVKGEPVEEGFNFSTKTLLTRYLQATSDVPADPSTLLPNI

SEQ ID NO: 13379 - protein, 633 aa, Unknown
  Phalaenopsis hybrid cultivar
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDKEMGLIRTQEETGRHVRMLTHEIRSTLDRHTILRTTLVELGRTLDLAECALWMPSRTGLNLQLSHTLNNQIPVGSVVSINLPVVNQVFNSSRAVRIPHTCQLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVSLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNLMKGHIWLESEVLGKGCTTIFIVKVGISEDPAHRYQHKLLPPIRAGQSEADAFGSKRTPTDLIPLKNRYQRSL

SEQ ID NO: 13380 - protein, 476 aa, Clarkia delicata
MATPALISETEAWKDLKAHLEGIKRTHLRELMGDTERSQSMMVEFDNIFLDYSRQQASPDTINKLYKLAEAAHLKQKIDRMNNGDHINSTENRSVLHVALRAPRNSVICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYSFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKLLGIYEHRVAVQG

SEQ ID NO: 13381 - protein, 160 aa, Rhodobacter capsulatus
MLIFYVSAYAATAHVAQAIHDGAAESPDVRVSLFDLEGGEITPFLDLIEEADGIALGTPTINGDAVRTIWEMLAALVDIETRGKLGAAFGSYGWSGEAVRLVETRLQGLKMRLPEPGLRVKLHPSAAELEEGRAFGRRLADHLTGRAAPREVDFAEIAAR

SEQ ID NO: 13382 - protein, 82 aa, Saccharomyces cerevisiae
MVNNSQHPYIKDGWFREINDKSFPGQAFTMTVDSILYEARSEFQDILIFRNKVYGTVLVLDGIVQCTEFDEFAYQEMITHIA

SEQ ID NO: 13383 - protein, 221 aa, Arabidopsis thaliana
  misc_feature (215)..(215): Xaa can be any naturally occurring amino acid
MAPPSAVSPPARSAELATSNKAPVNLSKTAMNTTVEEMIGQWDSFKFAPIRESQVSRAMTRRYFEDLDRYAEFRHCQSSVPGSCGLSAAYVLGKKRPDLKIAIIEASVSPGGGAWLGGQLFSAMVMRKPADAFLREVGVPYEDEGHYVVVKHAALFTSTIMSKVLSLPNVKLFNAPCVEDLITRPSEEGVRNRGVVTNWTLGSMHHDDQSCMDPXTINAPL

SEQ ID NO: 13384 - protein, 520 aa, Burkholderia thailandensis
MSPHPNSDNSTAQSNPPQLRRSLKARHLTMIAIGGSIGTGLFVASGASISQAGPGGAVLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVLAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLVPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSNLYPYGPIFAFALCIVIALGQDYQAFLANKIDWVGVLATYVGIPLFLVVWLGYRLVHKTRFVGYEDMDIASWVAEHERAAAHEAREAAAIRVPSSPEAAS

SEQ ID NO: 13385 - protein, 490 aa, Oryza sativa
MALKSPVDFAGSITSGQKDPCCFGVPGCNPRCVRYNKKSRTCRLVTRAISVDRPQLDFSNSDWKKQFQEDFDSRFSLPHLKDVIDVEPRPTTFSLKSRTPLENVNGSMQGSWNGYVNDDDRALLKVIKFASPTSAGADCIDPDCSWVEQWVHRAGPRKQIYFEPQYVKAGIVTCGGLCPGLNDVIRQIVLTLEKYGVKNIVGIQHGFRGFFEDHLAEVPARRLDMLFVLGGNGTHAGANLIHEECRKRKLKVSIVGVPKTIDNDILLMDKTFGFDTAVEAAQRAINSAYIEAHSAFHGIGLVKLMGRSSGFITMHASLSSGQVDICLIPEVPFTLDGPNGVLQHLEHLIETKGFALICVAEGAGQEHLQQSNATDASGNMILGDIGVHLHQKIKAHFKEIGVHSDVKYIDPTYMVRAVRANASDAILCTVLGQNAVHGAFAGFSGITTGICNTHNVYLPISEVIKSTRFVDPNSRMWHRCLTSTGQPDFH

SEQ ID NO: 13386 - protein, 220 aa, Brassica napus
MGRRPARCYRQIKGKPYPKSRYCRGVPDPKIRIYDVGMKKKGFDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDGHGHHAQEALRRAKFKFPGRQKIIVSRKWGFTKFNRAYFTKLRQEKRVVPDGVNAKFLSCHGPLANRQPGSAFLPATY

SEQ ID NO: 13387 - protein, 260 aa, Methanosarcina mazei
MELDEVIITRAIFEEYSKTFLEYTDIDVALVGGGPANLVAAKYLAEAGAKVAIYEQKLSLGGGMWAGGMMFPRIVVQEEACRVLDDFGIRYKEYEPGYFVANSVESVGKLIAGATSAGAEVFNLVSFEDIMIRENDRVTGIVINWGPVTTQRLHVDPLMIRTKLVIDGTGHDAVVCNTILRKIPNAKIGEFGILGEKPMWSEVGERLAVDATQEIYPGLIVAGMAANAATRAPRMGPVFGGMLLSGEKAAKLALDRLKKI

SEQ ID NO: 13388 - protein, 712 aa, Rickettsiella grylli
MSTLSHSIFSKSIKKVVQFGSEEIILETGKIARQATASVLVSVGGVTVLVTVVGNKRQTDENRDFFPLTVQYQERTYAAGRIPGGYFKREGRPSEKEILTSRLIDRPIRPLFPEGFYNEVQVVATVLSSTPDINPDIPALIGASAALALSGLPFKEPIAAVRVGYADGQYILNPSMKELETSDLDLVVAATEKAVLMVESQAAELSEEIMLKAILFGHQQMQGVIQSIKELAIEASKPAWDIKTLVSMDAHVEQAIIQSIDTSLTEAYQIPEKFMRKFKLDEIRENTMAQWLDEEKGITAKAIQFVLEKREEKIVRSRILSGQSRIDGRDKKAVRPITIEPGFLPRTHGSALFTRGETQALVVTTLGTDRDAQTVEALDGEGRETFMLHYNFPPYSVGETGQIGSPKRREIGHGNLAKRALRAVLPSESDFPYVLRVVSEITESNGSSSMATVCGASVALMDAGVPLKKHVAGIAMGLIKEGEQFAVLTDILGDEDHLGDMDFKVAGTVDGVTALQMDIKIEGITEEILKVALNQAREGRLHILSIMKEALAEPRIEVSPYAPRITTLKINPEKIRDLIGKGGATIRAITEETGTLIDISDDGMVRISTSDSQACQNAIERIRKVTAEVEVGCIYEGAIVKLTDFGAFVNVLPGRDGLVHISQISKERVEQVSDVLSEGQIVKVKVLEIDRQGRIRLTMKDIEVEMENEVHS

SEQ ID NO: 13389 - protein, 556 aa, Acidithiobacillus ferrooxidans
MMFCYQCEQTTRSPAGIGCTSEPGTCGKDEATAVLQDILTHLMKGIASMRAGRAMGVADRRTDDFIFYGLFTTLTNVNFTATRFVHLIQEASKRRERIKLLYEEAAREQGKTPEILSGPALFQPADSLEQLLRQAPSVAINADVEHLGSDVIGARALILYGMKGVALIAQHARVLGYQSDEVMPQAEEILDYLASNPTDLDEMLEESLEVGRLNLKVMELLDVANTDSFGAQEITSVRISPIQGKAILVSGHDLHDLKQILEQTKDQGINVYTHGEMLPANAYPLLKAYPHLAGNLGGAWQDQQREFADFPGPIVMTSNCIIEPGRSYKNRIFTLGPVGWPGVRHIDNGDFTPVIQAAKALPGFTADAKEQRITIGFGHHTLLGVADKIVDAVKHGDIRHFFLVGGCDGVSPARNYFTEVADNAPADSVVMTLGCGKYRFNKHEFGDIGGIPRLLDIGQCNDAHSAIRVAGALAEAFNCGVNDLPLSIMLSWFEQKATAIHLSLLALGIKGIKLGPTLPAYLTPTLVQKLQSRFDLDLDLIGEAQADLQAALAHTA

SEQ ID NO: 13390 - protein, 533 aa, Trichodesmium erythraeum
MRVLLIYPLFPKSFWSFEKILELINRKVMLPPLGLVTVAAILPQEWEYKLVDRNVRSVTEAEWEWADLVILSAMIVQKEDLHDQIREAKRRHKLVACGGPYPTALPQEQLDSGVDFLILDEGEITLPMFVDAIKNGETKGIFRADGNKPDVTTTPLPRFDLLEMKYYESMSVQFSRGCPFQCEFCDIIVLYGRKPRTKTPAQLLAELDCLYDLGWRGSLFMVDDNFIGNKRNVKLLLKELKVWQAEHQYPFKITTEASVNLAEDPELMQLMVDSNLRAVFLGIETPDEDSLELTHKYQNNRNPLNEAVEKIIKSGIRVMAGFIIGFDGEKPGAGDRIVKFVEETTIPTAMFSMLQVLPNTALWHRLKKEGRLLDKGANINQVTLTNFIPTRPIEDIAREYVEAFWQLYDHEKFLDRTYRHFLIMGSPTAKSIAKMPSWMELRALLIICWRQGIKRKTRWKFWHHLWSIRKHNPSILPRYISTCAHIEHFYEYRNIVRENIEVQLAEYLAKNKQLNIIKEKVNTQNQKTTEEVA

SEQ ID NO: 13391 - protein, 123 aa, Unknown
  Marinobacter sp. ELB17
MLLPGLVAIALMPLVIYLMYPPEIKATPNAVDFVRERLGKLGKLSRDEGIMLDVFVVLLLLWAGVPAWIFGDTFKLNSTTTAFVGLSILPVTGVLNWKDVLGEKSAWDTLVWFGALVMMANPA

SEQ ID NO: 13392 - protein, 190 aa, Bifidobacterium longum
MVRMRIADVEEDIDHELVSKEQIDAKIHEMAALASEDYRDKNPLLVAVLKGAVNTLVAFTQAMSIPVQIDFMSLSSYGSGTVSSGEVTVRQDLSADVRGRHILIVEDIVDSGHTLAWLVAELKRRGAASVEVFALLSKPSRREVDVDVKYAGYEIPDEFVVGFGLDFDERYRNLDSIAVLKPSVYQGVQA

SEQ ID NO: 13393 - protein, 386 aa, Triticum aestivum
  misc_feature (202)..(202): Xaa can be any naturally occurring amino acid
  misc_feature (226)..(226): Xaa can be any naturally occurring amino acid
  misc_feature (229)..(229): Xaa can be any naturally occurring amino acid
  misc_feature (263)..(263): Xaa can be any naturally occurring amino acid
  misc_feature (279)..(279): Xaa can be any naturally occurring amino acid
  misc_feature (291)..(291): Xaa can be any naturally occurring amino acid
  misc_feature (322)..(322): Xaa can be any naturally occurring amino acid
TCSCDEGLSQVTSLNKFVQKSRLVPVRNSRDIVDPRVRNGALDDVPAGVVGKEERPLAEGQQEEEEQEEGGATVFRGTNYSLPRTIAALALWLGGIHFNVLLILASLFLFPLRLAALVVALQLVFMFIPLNDEDKLGRKIGRFICKYAMGYFPISLHVEDYNAFDSSRAYVFGYEPHSVLPIGVAALANHVGFMPLPKLKVXLASSAVFHTPFLRAIWTWIGLIAXTRXSSTPNLPAGYSCVGGPAGIQGVPHMDHDSEGGFXLNSRKGFVRIAMRGGXPLIPFIGFGENXSYRWWRPGGKLFVNIARALKFTPIIIWGRKXYGTSIALSAPMHVVVGRPIELKKNPLPTIDEINEVHGQFVGALQELFEKYKTKAGYPGLHLRVL

SEQ ID NO: 13394 - protein, 347 aa, Oryza sativa
MDVDSVECLSLPDSSSSSGAGAGGGGGGGGGGGVGAMDAADDVGLALHAHGALLAAAAAARAAACSKGGGGGGAAAGSGVHELLECPVCTNSMYPPIHQCQNGHTLCSTCKARVHNRCPTCRQELGDIRCLALEKVAESLELPCKYCSLGCPEIFPYYSKIKHEAQCMFRPYNCPYAGSECAVVGDIPYLVAHLRDDHKVDMHSGCTFNHRYVKSNPREVENATWMLTVFHCFGQYFCLHFEAFQLGMAPVYMAFLRFMGDENEARNYSYSLEVGANGRKMVWEGTPRSVRDSHRKVRDSHDGLIIQRNMALFFSGGDRKELKLRITGRIWKEQQTPDGACIPNLCS

SEQ ID NO: 13395 - protein, 805 aa, Anaplasma marginale
MFDITRKCVEWGDRLLVIESGKIARQADGAVVVDYGGTSVLSTVVSQKSKEPVDFLPLTVQFLAKSYAIGRIPGGFFKREGKPSDRETLISRLVDRSIRPLFPTGFCDEIVIVCNLLSYDQVSPPETVALIGAAAALAISGIPFPTPIAGAKIGYIREEERYILNPSAEELARSELDMFYSGTKSSVVMVESEASELSEEEMLGAVTFGHENCAQVLDLIEEFAEAAGPKDVVEFVPHDIGKVVSDISSGYSEKFSVAYSDHNKKTRVLQLDAAREGLYSDLCRKHVEESGEYTEQEVLLAIKTFERSLVRARVLDTLKRVDGRGFDQIRNIEIEVDLIPRSHGSALFTRGDTQALVITALGTPQDEQVVDGFDGDRRERFLLHYNFPSYAVGEAAALRPPGRREIGHGKLAWRAIHPVLPTKADFPYTIRVVSEITESDGSSSMATVCGASLALMDTGVPLKSSVAGIAMGLIKEGDRYAVLSDIIGDEDYLGDMDFKVAGTKDGITALQMDMKIRGIGFDIIEKSLQQAKDGRLFIIGKMDKVIKESREGVRDHVPRMESMIIDKNKIKNVIGTGGKNVREICEKTGVKIEISQDGTVMIYAVSRDAVEEAKNMIMCIVSEPEVGKVFSGVISEIAKYGAFVSFLGGRRGLVHISEIKNEHIGSVSDVLAVDDKVKVLVIGIDKDHVQLSMRRVDQDSGDLLEHESYSSSKKNGPQSGDASGGASGFRDYASGPARERRRSGGSGGRPVRRRSAGSSGSGSGGYYSVPQHVGTPDPVNGNDRRRGSGPQHASGGGGNKKPRFF

SEQ ID NO: 13396 - protein, 236 aa, Triticum aestivum
MTRRYWNINLKEMIEAGVHFGHGIKKWNPKMAPYISAKRKGTHIINLARTARFLSEACDLVFDAASQGTSFLIVGTKKRATDLVASAAIRARCHYVNKKWFSGMLTNWSITKTRLSQFRDLRAEEKMGKFHHLPKRDVAILKRKLSTLQRYLGGIKYMTRLPDIVIVLDQQKEYIALRECAILGIPTISLVDTNCDPDLANISIPANDDTMTSIRLILNKLVFSICEGRSLYIRNR

SEQ ID NO: 13397 - protein, 176 aa, Thermoplasma acidophilum
MVTKPARMYSRITGPAYTRKEFMGGVPYPKITTFVQGNQKKDFPIEMRLVAEEPCQIRHTALEAARVSVNRRMTEAAGLDYFYLKVVPYPHHVLREHKMATGAGADRISSGMRAAFGRPVGTAARVYPDDVIMIARTDEAHAKELKTALRKAAIKLPTPCKVVITKGKEIAGSLGI

SEQ ID NO: 13398 - protein, 125 aa, Brassica napus
MAKYNEIAKKKREAKADRKRAIHGDPLTNKLKSRAPVVSVSGKRQKKLLRKWRREQKEMVEKGLVTMEDVEMASADGASEEESKKPPRKFSVKKTLKLNKLKNKAGKKNKSQKAVGQVSAEQMLE

SEQ ID NO: 13399 - protein, 237 aa, Epifagus virginiana
MTRRYWNIDLEEMIGAGVSFGHGTRKWNPKMAPYISVKHKGIHFTNLTKTARFLSEACDLVFYAASRGKQFLIVDTKNKAADSAAWAAIKARCHCVNKKWPGGMLTNWSTTETRLHKLRDLIMEQKAGRLNRLKKKDEAAVKRQLARLQTYLGGIKYMTRLPDIVIIVDQHEEYKALHECITIGIPTIGLIDTNCDPDLADISIPANDDAISSIRLILNKLVFAICEGRSGYIIKNI

SEQ ID NO: 13400 - protein, 186 aa, Bordetella pertussis
MSSSQPAGAATEAAVLGGGCFWCVEAVFKDLRGVTGIEPGYAGGHVEHPTYEQVCGKDTGHIEVARVEFDPAVLSYGDLLRVFFATHDPTTPGRQGNDVGPQYESAIFWQDERQREQAQAVMDELRAQQVFDAPIVTRLLAPAKFWPAEDYHRDYYALHPEQGYCQFVIAPKVAKFRKQFQDRLAR

SEQ ID NO: 13401 - protein, 526 aa, Oryza sativa
MASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGFDIPSGWKILPVLAPCIWTRPCTRTPALQSLEMEGKENTGTSADVAVGQCLSIISEGDHSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 13402 - protein, 478 aa, Salix gilgiana
VFSSSSRAIMGPGSAIHVFIFALLISISGKFAGAEISSEVGINYGRLGNDLPSPSKSVELIKSLKAKRVKIYDANPDILKSLKNTDIQVSIMVPNALIPNMSTSQHFSDQWVETNVVPYYPDVKIRYLLVGNEILTNPDTGTWFNLVPAMRRIKISLTRRNFRKIKVGTPSAINVLESSSPPSNGTFRSDVSGPVIKPMLQFLNRTKSFFFIDFYPFFAWSENAPNISLDYALSNAQNVTYTDPGTNLTYTNLFDQMFDAVVFAMKRLGYPGIRVFIAETGWPNGGDFEQFGANTYNSATYNRNVVKKLTTIPAIGTPARPGVAIPAFIFSLYNENQKPGPGTERHFGLYYPNGTEVFEIDLSGKTPLSGYKKPLPLPTNNEPYKGKLWCVVAKEANRSAVKDALAWACSQGNKTCDEIQPGKECYKPVSLFRHASYAFSSYWAEFKKIGGVCSFNGLATTTFKDPSFGQCKFPSVTL

SEQ ID NO: 13403 - protein, 549 aa, Escherichia coli
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTNIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSVQEENLERRFRLAALRSERAELYHLRATREISNETLQKLLHDLDLLEALLIEENQ

SEQ ID NO: 13404 - protein, 547 aa, Magnaporthe grisea
MSVRPRPEGLLEPRRPGGNGEYRKTTDAEDVTTAEPLSDGGYRDFSDIDPDSGVKRGLKTRHLSMMALAGIIGPGLLIGSGGALASGGPAALIIGFGVIGIVAFSIMQSLGELTTLYPTGGAFTSLSSRFVDKAFGVAVGWNYYIIWWAVLSNEYNVICSIFNLWGSQVPIWGYFLIFWLLGVESFGEAEFWLALLKLIGLVAYFIFSLVYVGGGIPGAPALGSRYWHDPGAFANGFKGVATVFVFCSTFYAGVESVAVAATETKNPRTAIPLAIRQVFWRIVFVYMGSAIFFGLTCPWDADGLVSGENRALRSPMTVAIQNAGWQSGVHLINAFIFVTCLSAINSSIYIASRTILFMAQSQMAPKFLGWTDRRGVPIPAILFANACGSLSMMNISTGAATAYSYIVNLSGVSTFLVWGSISFTHIRFRTAWQAQGFDPQSLPFRSMLYPWNAYFGLGANVFLALVQGWSTLAPFDAPTFVDAYILIPLFAVIYVAYKFAFKTRFWRAEEIDLLSGRRRDLEEDREIQNRTPSGAPLSAWQRLWKNF

SEQ ID NO: 13405 - protein, 298 aa, Alkaliphilus metalliredigenes
MEIGLIGLGKMGYNLALNMRDHGHRVVAYNRTPDKTQMIEKEGIKGVYSLEALYDSLEGKRILWMMIPSGEAVDNMIDELLTFLRSGDILIDGGNSFYQDTLRRYEKLKDIGIDYIDVGTSGGIEGARTGACMMVGGEPHVVEQISSLFQDISIENGYSFMGTPGSGHYVKMVHNAIEYGMMQAIGEGFELLNAGPFSLDFENVAKVWSHGSIIEGLLMRCVLSSFEKSEKLEEIQGIVDASGEGQWAVEEALRLKVSMPVISNALFARYKSTDSTKFSEKVVAAMRKEFGGHAIHQK

SEQ ID NO: 13406 - protein, 588 aa, Daucus carota
MAASATSASTWAKPNIYSSQRDSPRKTNVNCAIQSSPSILHFPKQSKQKYQTPSIPTTIVQPKHQDSSSSATPKWNFLQKAASMALDAVENIIISQEQSHPLPKTADPQVQISGNFAPVQEQPVQHHLPVTGKIPECISGVYVRNGANPHFEPTGGHHFFDGDGMVHAVKFKDGEASYACRYTETERLIQERNLGRTVFPKAIGELHGHSGIARLALFYARGLFGLVDHSQGTGVANAGLVYFNNRLLAMSEDDLPYHVQITPKGDLRTVERYSFDGQLDSTMIAHPKIDPETNELIALTYNVIQKPYLKYFRVSPDGVKSSDVDIELADPTMMHDFAITENFVVIPDQQVVFKISEMIQGGSPVVYDKEKVSRFGVLDKYAKDGSGIKWVEVPDCFCFHLWNAWEDKESDEIVVIGSCMTPADSIFNECDEGLESVLSEIRLNLKTGKSTRRAIISPEDQVNLEAGMVNINKLGRKTQFAYLAIAEPWPKVSGFAKVDLFNGEIKKFFYGDNKYGGEPLFLPRNPNSENEDDGYILAFVHDEKAWKSELQIVNAMTLELEATVKLPSRVPYGFHGTFISEKDLEKQA

SEQ ID NO: 13407 - protein, 335 aa, Geobacter metallireducens
MGEKIGVIGAGSWGTTLANLLAKKGLDVTLWAYEPELVAEMRATRVNTLFLPGTELAAGLAFTNSLEEAAAGKDVLVLVSPSQVMRSVLTQLAPLLKPGVTLVNASKGIELDTLMTMDQVCGAVLPPAVAGRFCVLSGPSFAREVAQEMPTAVVAASADLEAAAQVQRLFTAPYFRVYTNSDVVGVEIGGALKNVIALAAGISDGLGLGHNTRAALITRGLAEMNRLGRAMGADPATFAGLAGMGDLVLTCTGDLSRNRTVGMKLGQGMRLAEILGEMRMVAEGVKTAESAWRLASQMGVDMPITEKVYQVLYEDKPARQAVLELMTRDPKAERG

SEQ ID NO: 13408 - protein, 621 aa, Zea mays
MGAALLASWPWDNLGLYKYVLYGPLVGKAVASRAWEAASPDRWILLLLLLFGLRALTYQLWSSFSNMLFATRRRRVVRDGVDFDQIDKEWDWDNFLILHALMAAAALCAFPSLRHLPAWDGRGFAVALVAHAAATEPLSYLAHRALHGSSGRLYARYHSLHHSSRVPQPFTAGLATPLEHVALGALMSLPLAAARAAGCASVALAFAYVLAFDSLRAMGHCNVEVVPASLFRAIPALRYVLYTPTYHAIHHTKKEANFCLFMPLFDLLGGTIDRRSWDMQRKMSAGVDEVPDFVFLAHVVDVMQSLHVPFVMRTFASTPFSVQLFLLPMWPFAFLVMLAMWVWSKTFVISCYNLRGRLHQIWAVPRYGFQYFLPFAKDGINRQIELAILRADKMGVKVLSLAALNKNEALNGGGTLFVNKHPDLRVRVVHGNTLTAAVILNEIPKGTAEVFLTGATSKLGRAIALYLCKKRVRVMMMTLSTERFQKIQKEAPAEFQQYLVQVTKYRSAQHCRTWIVGKWLSPREQRWAPPGTHFHQFVVPPIIGFRRDCTYGKLAAMRLPKDVRGLGACEYSLERGLVHACHAGGVVHFLEGYTHHEVGAIDVDRIDVVWEAALKHGLRPA

SEQ ID NO: 13409 - protein, 340 aa, Unknown
  Frankia sp. EAN1pec
MQLGMIGLGRMGANLVRRLMRDGHECVVYDVNPETVKSLAAEGAVGVNSLADFAAALSTPRAAWVMVPAGLTGQTVFELAEHFEAGDIIIDGGNSYYRDDVDRAAKLAERGLHYVDVGTSGGVFGLERGYCLMIGGEPEVAARLEPLFETIAPGVDTAPRTPGRTGEIAQAEKGYLYCGPNGAGHFVKMIHNGIEYGMMAAFAEGMGILEKAGIGRSEAALHDAETAPLAHPEYYQYDFDIASVAEVWRRGSVVSSWLLDLTATALAEDPRLSEFGGRVSDSGEGRWTVLAAVEEGVPAHVLTASLYERFSSRGESLFADKLLSAMRKQFGGHAEKKAEG

SEQ ID NO: 13410 - protein, 110 aa, Rubrobacter xylanophilus
MPEPVAVTVDSFEREVLESEVPVLVDFWAEWCPPCRQLEPVIEELAREYAGRVKVAKVDVDAESSLAGRFGISSIPTIAFFEPGERPKAVMGAMPKEMIESAFGLERFSG

SEQ ID NO: 13411 - protein, 984 aa, Staphylococcus aureus
MQEHLVVTLDGKDYLVEPGTNLLEFIKSQDTFVPSICYNESMGPIQTCDTCTVEIDGKIERSCSTVIDRPMTVNTVNNDVKDAQKEALDRILEKHMLYCTVCDYNNGDCEIHNTMDAWGLQHQTYEYKEKPYEKDYGPFYRYDPNQCILCGRCVEACQDIEVNETIRIDWDREHPRVIWDNDVPINESSCVSCGQCATVCPCNAMMEVNMEGNAGYMTDTEPGSLAAMIDLTKKAEPGYGPLFAISDSEAEMRKERIKKTKTVCTYCGVGCSFEVWTKDREILKVQPSHDSPANKIVTCVKGKFSWGHINSDQRLTKPLVRKNGEFHEVEWDEALNVIADNFTSIKEKYGPDALSFISSSKATNEESYLMQKLARQVIGTNNVDNCSRYCQAPATKGLFRTVGHGGDSGSIEDLEKAAMSVLIGTNTAEAHPVIASRMKRAQKLFGQKIHVFDIRKHEMAERADRFYQPKPGTDLAWLSAVTKYIIDHDLHDKAFIDEWVDDFDEYYKSLETFTMAFAEEATGIPESELIKFAEECAKAESVVICWAMGITQQDIGSDSSTAISNLLLVTGNYRRPGTGAYPLRGHNNVQGCSDMGSMPDKITGYQSIEADDIRAKFEKEYGVKLNPKAGKDNHEMVEGIHDGEVHSLYLYGEDTGIVDSNINFVQAAFEKLDFMVVQDEFLTFTATYADVVLPASPSLEKDGTFTNTERRIQRLYQALEPLGDSKPDWKIFQAIANRLGFDWNYKHPSEIMDEVARLTPLYAGVSYDRLEGFNSLQWPVQPDGTDEPILYLEGFNFDNGKAKLFPLSFDNYFKQDEIYDIHVNNGRLLEHFHEGNMTYQTPMIKYKVPRAFVEISPELAEDRGIHEGAEVKLISETGEAVLQVHVTDRVKGKEIYIPLNNDAMENGDLGAINLLTNSDVDQYTDTPSYKRTSCRLEVITKRGKSPLNPNNFRVNKKRHPQYSVQVQKKWERSDYVFPGNQVDK

SEQ ID NO: 13412 - protein, 721 aa, Prochlorococcus marinus
MEGQNKSITFDGREIRLTTGLYAPQANGSVMIECGDTSLLVTATKTTKKEVADFLPLICDYEEKLYAAGRIPGGFMRREGRPPERATLISRLIDRPMRPLFPSWMRDEIQIVASCLSLDERVPADVLAVTGASIATLLGEIPFHGPMAAVRVGLIGDDFILNPSYREIEKGDLDIVVAGSPDGIVMIEAGANQLSEQDTIEAIDFGYESVTELIKSQVDLLKDLGIKQVKSSAPEEDNTLPSYLEKNCTKGIELVLKKFDQSKDERDLELEKIKVDTQAKIESLKDDNELKVLLSENDKLLSSDFKKLTKKLMRSQIINDGKRVDGRELDEVRKISASAGILPKRVHGSALFQRGLTQVLSTTTLGTPSDAQEMDDLNPSTEKTYLHHYNFPPFSVGETRPMRTPGRREIGHGALAERAIIPVLPGKETFPYVLRVVSEVLSSNGSTSMGSVCGSTLSLLDAGVPLKALVSGTAMGLIKEGKEIRILTDIQGIEDFLGDMDFKVAGTEKGITALQMDMKITGLSVSVISDAIKKARPARLHILEKMQEAIDKPQESLSPHAPRLLSFRIDPELIGTVIGPGGRTIKGITERTNTKIDIEDGGIVTIASHDGAAAEEAQKIIEGLTRKVHEGEIFTGVVTRIIPIGAFVEILPGKEGMVHISQLSEARVERVEDVVRQGDEVTVRVREIDSRGRINLTLRGVSQNSGMSYPEPTPTPVAPLN

SEQ ID NO: 13413 - protein, 172 aa, Brassica napus
MAATSLSPSTILSLNRKGSSTVSAFTPRSISAVKFQFPLRRIRTGDLNLSSLSSSTRSTPRPIEAKKQTYDSFDDLLVNSDKPVLVDFYATWCGPCQFMVPILSEVSETLKDKIQVVKIDTEKYPSIANKYKIEALPTLILFKDGEPCDRFEGALAANQLVQWIEDSLEVKT

SEQ ID NO: 13414 - protein, 77 aa, Epifagus virginiana
MKEQKWIHEGLITESLTNGMFWVRLDNKDLIIGYVSGNIRHSFIRILPGDKVKIEVSRYNSTRGRIIYRLRNKYYKD

SEQ ID NO: 13415 - protein, 193 aa, Zea mays
  misc_feature (20)..(20): Xaa can be any naturally occurring amino acid
MIPTIRKEAYLKIEEAVLSXKISNIEYHLKGAKIFDKKAKTLITREAVNGTSTDSKTTITLKYSVIKGKLWDSSKSMKLGVTTTIEAGVPVVLPATIEVQSEFNSTYSWGESIIEKEEYSNAYEVVVPAYSVVTVSVLATQGICQVPFSYTQEDVLTTGERKVFKFDDGIFRGVNSFGFKSEVTERKLSKDDD

SEQ ID NO: 13416 - protein, 414 aa, Methanococcoides burtonii
MSYISEIDPEIANALSLEAQRQDFKLNLIASENYTSRAVMEAQGSIMTNKYAEGYSGKRYYGGCEFVDMAEDLAISRAKQIFGAEHVNVQPHSGSGANMAVYFSVIKPGDKIMSMDLSHGGHLSHGSPVSFSGQLYNIVPYGVSQDTEMLDYNELMEIAKKEKPQMIVVGASAYSRIIDFKAFREIADEVGAYLLADVAHIAGLIAAGVHPNPFPYADFVTTTTHKTLRGPRGGMVMCKEEYAKAINKSVFPGIQGGPLMHIIAAKAVAFKEALSDSFKKDQEQTVKNAKALCAALQDREFDIVSDGTDNHLMLINLNKYDLTGKDAEVIMSKAGIVINKNTIPFETRGPFITSGLRAGTPACTTRGMKESAMDEIADFFKTIIDNRENNAVLETVNADVQELCSRFPIYEHLR

SEQ ID NO: 13417 - protein, 99 aa, Phaeodactylum tricornutum
MVTYKVTLLSEEHDINTTIDCNDDVFVLDAAEEQGIELPYSCRAGACSTCAGKVTAGEIDQSEQTFLDDDQVEAGFVLTCIAYPKSDCTISVHQEDELY

SEQ ID NO: 13418 - protein, 456 aa, Photobacterium profundum
MTALTLTLKNWLLNRNSMIFIGNILLFSIMLNTLPFEKDVVIGLCILTFVAILWLTEAVHVSITAILVPVLAVGFGIFQTPQALTNFSNPIIFLFLGGFALAAALHKQELDKAIADKVLILAKGKMSVAVFMLFGVTAGLSMWISNTATTAMMLPLVLGVLNKVNAKSERSTYVFVLLGIAYCASIGGIATVVGSPPNAIAAAEVGLSFTEWMEFGVPIAMILLPITVALLYFIVKPNLSHTFELDHTPVKWDNGKLITLAIFALTVSLWVFSKPINAFLGGFSKFDTLVALFAIILLGVSRVVEWKDIEKSTDWGVLILFGGGICLSNVLKETGTSVFLAHSLSGFLEQAGLFFTILVIVSFVVFLTEFASNTASAALLVPVFATVAEALGVSPIILSALIAVAASCAFMLPVATPPNAIVFGSGHIKQSEMMKVGIYLNLACIIALTVFAWMFW

SEQ ID NO: 13419 - protein, 63 aa, Lithospermum erythrorhizon
EFGLLGLKHKEHIAAYGEGNERRLTGKHETADINTFKWGVANRGASIRVGRDTEKEGKGLVRI

SEQ ID NO: 13420 - protein, 640 aa, Corynebacterium glutamicum
MCGLLGILTANGNAEAFVPALERALPCMRHRGPDDAGTWHDADAAFGFNRLSIIDIAHSHQPLRWGPADEPDRYAMTFNGEIYNYVELRKELSDLGYTFNTSGDGEPIVVGFHHWGESVVEHLRGMFGIAIWDTKEKSLFLARDQFGIKPLFYATTEHGTVFSSEKKTILEMAEEMNLDLGLDKRTIEHYVDLQYVPEPDTLHAQISRLESGCTATVRPGGKLEQKRYFKPQFPVQKVVKGKEQDLFDRIAQVLEDSVEKHMRADVTVGSFLSGGIDSTAIAPLAKRHNPDLLTFTTGFEREGYSEVDVAAESAAAIGAEHIVKIVSPEEYANAIPKIMWYLDDPVADPSLVPLYFVAAEARKHVKVVLSGEGADELFGGYTIYKEPLSLAPFEKIPSPLRKGLGKLSKVLPDGMKGKSLLERGSMTMEERYYGNARSFNFEQMQRVIPWAKREWDHREVTAPIYAQSRNFDPVARMQHLDLFTWMRGDILVKADKINMANSLELRVPFLDKEVFKVAETIPYDLKIANGTTKYALRRALEQIVPPHVLHRKKLGFPVPMRHWLAGDELFGWAQDTIKESGTEDIFNKQAVLDMLNEHRDGVSDHSRRLWTVLSFMVWHGIFVENRIDPQIEDRSYPVEL

SEQ ID NO: 13421 - protein, 356 aa, Unknown
  Rhodococcus sp. RHA1
MSTIARNQWYVAAYGREVGRELFSRTICEEPILFWRTEAGEAVAMSDRCVHRRYPLSEAPSRLDGDKVVCGYHGFTYGSDGGCVFVPGQARVPRTARLRSYQVVEQDSFVWVWIADPQNPQQGDPTRIPRAPWMDSPDYTVVSGMEPIDCNYGLLVDNLMDLSHETYLHGGYIGTPEVAETPITTEIDEDRNVIYVSRHMDDAECPPFYSKSTGIEGRITRWQDIEYTPPCLYLLHSRIAPIGAPLPGDDGSDPHAFHSEIVYAITPSTENSTLDFWAVARDFALGDDAVTTFLAENNRTVVMQDVVALNILHKALDTEKDGYQELSINIDAGGLGARRILKKLVDAPQAVTAAVG

SEQ ID NO: 13422 - protein, 478 aa, Arabidopsis thaliana
MESQKPIFDLEKLDDEFVQKLVYDALVWSSLHGLGVGDKTYQKSGNVPGVGLMHAPIALLPTGFPEAYWKQACDVTPLFNELIDRVSLDGKFLQDSLSRTKKVDVFTSRLLDIHSKMLERNKKEDIRLGLHRFDYMLDEETNSLLQIEMNTISCSFPGLSRLVSQLHQSLLRSYGDQIGIDSERVPINTSTIQFADALAKAWLEYSNPRAVVMVIVQPEERNMYDQHLLSSILREKHNIVVIRKTLAEVEKEGSVQEDETLIVGGQAVAVVYFRSGYTPNDHPSESEWNARLLIEESSAVKCPSIAYHLTGSKKIQQELAKPGVLERFLDNKEDIAKLRKCFAGLWSLDDSEIVKQAIEKPGLFVMKPQREGGGNNIYGDDVRENLLRLQKEGEEGNAAYILMQRIFPKVSNMFLVREGVYHKHQAISELGVYGAYLRSKDKVIVNEQSGYLMRTKIASSDEGGVAAGFGVLDSIYLN

SEQ ID NO: 13423 - protein, 466 aa, Pseudomonas fluorescens
MDQTLKQGELKRGLKNRHIQLIALGGAIGTGLFLGSAGVLKSAGPSMILGYAIAGFIAFLIMRQLGEMIVEEPVAGSFSHFAHKYWGGYFGFLAGWNYWVLYVLVGMAELTAVGKYVQFWWPEIPTWVSAAVFFVLVNLINMMNVKFFGEAEFWFAIIKVVAIVGMIVLGCYMLFSGSGGSQASVSNLWSHGGFFPNGGTGLLMAMAFIMFSFGGLELVGITAAEAAEPRKVIPKAINQVVYRVLIFYVGALAVLLSLYPWDELLVSLNAGGDAYSSSPFVKIFSLIGSDAAAQILNFVVLTAALSVYNSGVYCNSRMLYGLAEQGDAPKALMKLNKQGVPILALGISALITLLCVLVNYLAPHEALELLFALVVAALMINWALISLTHLRFRKAMAEQGVVPSFKAFWSPLSNYLCLAFMVMIVGVMWMIPGIRASVYAIPVWVLVIWGFYLLSRAKKASQPALR

SEQ ID NO: 13424 - protein, 136 aa, Unknown
  Polaromonas sp. JS666
MRLLHTMLRVGNLQRSIDFYTQVLGMKLLRTSENPEYKYSLAFVGYEGNPAQAEIELTYNWGTESYELGTAYGHIALGVPDAYAACEKIKAAGGNVTREAGPVKGGKTVIAFVTDPDGYKIELIQRAEDGGGAGLR

SEQ ID NO: 13425 - protein, 414 aa, Campylobacter coli
MSLEQFDKEIFDLTNQELVRQCEGLEMIASENFTLPEVMEVMGSVLTNKYAEGYPGKRYYGGCEFVDEIENLAIERCKKLFNCSFANVQPNSGSQANQGVYAALLNPGDKILGMDLSHGGHLTHGAKVSSSGKMYESFFYGVELDGRINYEKVREIAHIVKPKLIVCGASAYARIIDFSKFREIADEVGAYLFADIAHIAGLVVAGEHPSPFPHAHVVSSTTHKTLRGPRGGIIMTNDEELAKKINSAIFPGIQGGPLMHVIAAKAVGFKFNLSEEWKIYAKQVRSNAQALAKVLMDRKYKLVSDGTDNHLVLMSFLEREFSGKDADLALGNAGITANKNTVPGETRSPFVTSGLRLGTPALTARGFKENEIQIVANYIADILDDIQNTHLQKEIKEKLKTLASNFIIYEKAMF

SEQ ID NO: 13426 - protein, 713 aa, Hyphomonas neptunium
MFNKQSVSLEWAGRTLTIETGQVARQADGAVMVQYGDTIVLATAVFAKEAKPGQDFFPLTVNYQEKYFASGRIPGGFFKREGRPTEKETLTSRLIDRPIRPLFVDGFKHEVQVVVTTLSYDLENDADIIALVGASAALVLSGAPFMGPIGAARVGYKDGQYIINPTIAELEESELDLVVAGTTDAVMMVESQAAELSEDVMLGAVVAGHDAMQPVIDAIIALAEKAAKEPFAYEPPDHSAALKSVIDTVGADLSKAYKITAKGERYAAIGAAKDKAKAALLGTDEAPGVMTPEVFKTVFKEAEASVVRGDILKTGQRIDGRKLDQIRPIVAEAGFLPRTHGSSLFTRGETQAICVATLGTSDDEQYIDGLDGTKKEKFMLHYNFPPYSVGETGRMGGAGRREIGHGKLAWRALKAVLPKHEDFPYTIRMVSEITESNGSSSMATVCGCSLAMMDAGVPLTRPVSGIAMGLILEGSEFAVLSDILGDEDHLGDMDFKVAGTENGVTSLQMDIKVAGITKDIMGKALEQAKGGRMHILGEMGKALTASRGQLSENAPQMEIIKVPTDKIRDVIGSGGKVIRGIVDETGAKVNIDDDGTVQISAMDRKSIDAAIKMIKGITAEAEVGEIYEGKVVSMKDFGIFVNFFGPKDGLVHVSQMANKRIGHPKEMVKEGDKVWVKLMGFDERGKVRLSMKVVDQETGKELAEEAGDDASED

SEQ ID NO: 13427 - protein, 297 aa, Unknown
  Synechococcus sp. CC9605
MNRNALIEILQQEGNLKHCFSHDEIERLAEHLSIETVQAETVLMKKGEPSCSMVFILDGLVQVIDGDRQLAIEKPGSIVGESLFSDEATRTADTRTIEQTTVGRFSVHDFEDLLNKNQPLALKFREYFRTITRARQQQKAAENYTDTRKYLALIAHNNMKESLMEFCGMHSRKLEKFPLMATGTTGSMLYKKTGLVLSKKVASGPLGGDQAVGTLISTRNIIGVIFFRDPLSPHPHHADIEALGRLCDVYQVPFATNPQSGEAILDYLLSGKSERESIPNHVLQTYIQGQTKVVEAG

SEQ ID NO: 13428 - protein, 330 aa, Burkholderia thailandensis
MNTVAQIRFDSIARWMPVALSEQVSGRAALAVICMEQPLVLFRDASGAVCAMEDRCAHRRAPLSLGRVTPDGRLQCAYHGWTYDGATGACVAIPNLSASERVPAHYAAHAYKTLERDGFIWACARDAPPPAEAIARDARSARRFAGSVTVAIARDEYVAALADGPHLTMRIAGLYITDYVIADATPHDGDIATERGVTWLAHIVDRHFGVRHPWTLRVTSPRDGVLASVELASRDGATALWASIAITPAARGATNVLWRGGVAADASGFGAKLFRTWARLHAVPFAMLAHVDGRALSTLDALYSRAWRGPIPEGIAHTRPMPADYRTRSR

SEQ ID NO: 13429 - protein, 971 aa, Unknown
  Nocardioides sp. JS614
MSDHHPLADLDDALPFVDRHIGLRPGDVETMLARLGFDSLDALMAAAVPGGIRAADELDLPAPLSEEATARELRAIAQANRPGEAMIGLGYHATTTPPVIRRNVLEDPSWYTAYTPYQPEISQGRLEALLNFQTVVGDLTGLPIANASLLDEGTAAAEAMTLVRRAHRNAVGPFVVDADALPQSIEVVRTRAAGLGIDVVVADLTDGLPADVLEGGLCGVLVQYPGASGRVLDPRRVIEQAHEQDALAVVAADLLALTLLESPGELGADVVVGSSQRFGVPLFYGGPHAGFMSVAAGLERHLPGRLVGVSVDAEGRPAYRLALQTREQHIRRDKATSNICTAQVLLAVVASMYAVYHGPEGLRAIATRAHRYAAVLAAALGQGGFPVRHESYFDTLVVQATGRAAAVVAAARALGVQLRLVDADHVGISTSECTTRSTVASVLKAFGLATGPADGSVDLDAVDAATGDALPEALRRTTPYLTHEVFTSYHSETAMLRYLRRLSARDYALDRGMIPLGSCTMKLNATTEMEPISLPGFADLHPFAPAEDAQGYRQLVTELEGWLAEVTGYDSVSIQPNAGSQGELAGLLAIRGYHRANGDEARNVVLIPSSAHGTNAASAVLAGMRVVVVKSGPGGEVDLDDLRAQCAAHADDLAAIMVTYPSTHGAYEETITELCEIVHAHGGQVYVDGANLNALLGYAKPGEFGGDVSHLNLHKTFCIPHGGGGPGVGPVAVRAHLAPYLPSHGMHPDETKRTGIGPVSAAPYGSAGILPISWAYIRLMGAAGLTRATAAAVLSANYVAARLGEHYPVLYRGHGGLVAHECILDLRGLTKESGVTVDDVAKRLIDYGFHAPTMSFPVAGTLMVEPTESEDLGEIDRFIDAMIAIRGEIDRVGAGEWTPEDSPLRGAPHTSRALVGEWDRPYSRELAVFPTGLTGPNGVADKYWPPVARIDQAYGDRHLVCSCPPVEAFAE

SEQ ID NO: 13430 - protein, 466 aa, Arabidopsis thaliana
MEGRRIIANPRPCSGSRRVIAKKRSRPDGFVNSVKKLQRREISSRMDRAFSISTAQERFRNMRLVEQYDTHDPKGYCLVSLPNLLKRSKVIEIVAARDIVFALTLSGVCASFSRETNKKVCFLNVSPDEVIRSLFYNKNNDSLITVSVYASDNYSSLKCRSTRIEYILRGQADAGFPLFESESLKWPGFVEFDDVNGKVLTYSAQDSVYKVFDLKNYALLYSISDKNVQEIKISPGIMLLIFKRAASHVPLKILSIEDGTLLKSFHHLLHRNKKVDFIEQFNEKLLVKQENENLQILDVRNAELIEVSRTDFMTPSAFIFLYENQLFLTFRNRNVSVWNFRGELVTSFEDHLLWHPDCNTNNIYITSDQDLIISYCKADTEDQWIEGNAGSINISNILTGKCLAKIKANNGPPKEEDCSSSDLGNSSRRRSAVAEALEDITALFYDEERNEIYTGNRHGLLHVWSN

SEQ ID NO: 13431 - protein, 99 aa, Arabidopsis thaliana
MIRCQRASGGRGGANRSKPAKPQVKEGSNKTVIEGLVTESLPNGMFRVDLENGDNILGYICGKIRKNFIRILPGDKVKVEMSVYDSTKGRIIFRMSSRD

SEQ ID NO: 13432 - protein, 728 aa, Ralstonia eutropha
MSMFNKVVKQFQWGQHTVRMETGEIARQAGGAVIVDVEDTVVLATVVAAKSPKPGQDFFPLTVDYIEKTYAAGKIPGGFFKREGRPSENETLTSRLIDRPLRPLFPEGFYNDVQVVVHVVSLNPEIPADIPALIGASAALAVSGIPFNGPVGAARIGYKDGQYLLNPTRSQMATSDLDLVVAGTERAVLMVESEANQLSEDVMLGAVVYGHEQMQIAINAIHDLVREGGKPEWDWAPAPKNEALIAKVTEVALPLLQEAYQLRQKSARSQKLKEVSANVTAALAEAGVDADKVEVGNIMFDLEAKIVRGQILGGEPRIDGRDTRTVRPIEIRSSVLPRAHGSALFTRGETQALVVATLGTKSDEQIIDALAGEYRDRFMLHYNMPPFATGETGRVGSPKRREIGHGRLAKRALIPVLPKDDEFAYTIRLVSEITESNGSSSMASVCGGCLALMDAGVPVKAHVAGVAMGLILEGNKFAVLTDILGDEDHLGDMDFKVAGTDNGITALQMDIKVQGITKEIMQVALAQAKEGRLHILGAMQGAMGHARTELSAHAPRMITMKIHPDKIREVIGKGGSTIQALTKETGTTIDIQEDGTITIASTSTDGMAEAKRRIEGITAEAEVGKIYNGTVLKLLDFGAIVNILPGKDGLLHISEIVNERVKDIKDWLKEGQQLRVKLIQADEKGRLRLSLKAALAEEGGSISPVNAGEAAPAPAPAAAPATPSDQQQ

SEQ ID NO: 13433 - protein, 363 aa, Ashbya gossypii
MSEVSVKEYISQQEALERQAREAMPGDPTKCTYSMGPLRQPIFACRTCGDIGVCYSCSIQCHTECDLVELFEKRQFSCDCGTERQKSAEKTCKLRENSTADIPDYSNRYGQNFKGLFCWCAREYSPEKDAVMVQCLLGLECNEDWYHDHCIMGVRDDPDSADAERELPGFPALDTFAAFICWNCVHKYEMQFKRLLAHELADQLIADTVDWIPTDTPAERAALSDADRAMPGAAGSKRKAADQIYSIFLKEGYSAVLERVRDSLPPGDKLRIFLTDIAPFLIHEDPVYEPPEDSDPVSSYEAASRALDMVSHERALNGILAYQAFKTKLSEFLQPFADTGKVVKEEDIKSFFQAQKEPPEDSS

SEQ ID NO: 13434 - protein, 413 aa, Unknown
  Synechocystis sp. PCC 6803
MYSPGYVATSSRQSDAGNRLFVYEVIGLSQSTMTDGLDYPIRRSGSTFITVPLKRMNQEMRRITRMGGKIVSIKPLEGDSPLPHTEGIAKPSQSEGSGSEAVANPAPESNKTMTTTPKEKKADDIPVNIYRPKTPYIGKVLENYPLVREGAIGTVQHLTFDLSAGDLRYLEGQSIGIIPPGEDDKGKPHKLRLYSIASTRHGDFGDDKTVSLCVRQLEYQNEAGETVQGVCSTYLCNIKEGDDIAITGPVGKEMLLPPDEDANIVMLATGTGIAPFRAFLWRMFKEQHEDYKFKGLAWLIFGIPKSENILYKDDLEKMAAEFPDNFRLTYAISREQQNAEGGRMYIQHRVAENAEELWNLMQNPKTHTYMCGLKGMEPGIDEAFTALAEQNGKEWTTFQREMKKEHRWHVETY

SEQ ID NO: 13435 - protein, 491 aa, Haemophilus influenzae
MDAVELLMNVTPNETRIALVETGMLREVHIERQAKRGIVGNIYKGRVTRVLPGMQSAFVDIGLEKAAFLHAADIVSHTECVDENEQKQFKVKSISELVREGQDIVVQVVKDPLGTKGARLTTDITLPSRYLVFMPENSHVGVSQRIESEEERARLKALVEPFCDELGGFIIRTATEGASEEELRQDAEFLKRLWRKVLERKSKYPTKSKIYGEPALPQRILRDFIGTNLEKIRIDSKLCFGEVKEFTDEFMPELSDKLVLYSGNQPIFDVYGVENAIQTALDKRVNLKSGGYLIIEQTEAMTTIDINTGAFVGHRNLEETIFNTNIEATKAIAQQLQLRNLGGIIIIDFIDMQTDEHRNRVLQSLCDALSKDRMKTNVNGFTQLGLVEMTRKRTRESLEHVLCDECPTCHGRGRVKTVETVCYEIMREIIRVYHLFSSEQFVVYASPAVSEYLINEESHGLLPEVEMFIGKRVKVKTEQFYNQEQFDVVVM

SEQ ID NO: 13436 - protein, 231 aa, Glycine max
MELAGLSFLKLSFLLSLLSGGSDLLNPISEPSLLGKFPPTCNRIECPNYEVVHAGNGYEIRRYDTTVWISTEPIQDISLKDATRTAFFQLFAYIQGKNEYHQKIEMTAPVISQVSPSDGPLCESSFTVSFYVPKKNQPDPAPAENLHIQKWTPRHVAVRQFSGFVSDYNVGEEAAALSASLEGTAWANAIEKSKEDGGVGADSAYTVAQYNSPFEFIGRVNEIWLPFQMDD

SEQ ID NO: 13437 - protein, 154 aa, Zea mays
MAPKAGKKPAEKKPAAAAAPAAEKPAEEVAEKAPAEKKPKAGKKLPKEAIGATDKKKKRSKKSIETYKIYIFKVLKQVHPDIGISSKAMGIMNSFINDIFEKLAQEASKLARYNKKPTITSREIQTAVRLVLPGELAKHAVSEGTKGVTKFTSS

SEQ ID NO: 13438 - protein, 515 aa, Methanocaldococcus jannaschii
MCGINGIIRFGKEVIKEEINKMNKAIKHRGPDDEGIFIYNFKNYSIGLGHVRLAILDLSEKGHQPMGYNVDEDKIIYRDDELDRADIIIVYNGEIYNYLELKEKFNLETETGTDTEVILKLYNKLGFDCVKEFNGMWAFCIFDKKKGLIFCSRDRLGVKPFYYYWDGNEFIFSSELKGILAVKEINKKENINKDAVELYFALGFIPSPYSIYKNTFKLEARQNLIFDLDKREIRKYYYWELPDYKPIYDKKKLIEEGKKLLYDAVKIRMRSDVPVGAFLSGGLDSSTVVGVMREFTDLSKLHTFSIGFEGKYDETPYIKIVVDYFKTQHHHYYFKERDFEELIDKYSWIYDEPFGDYSGFPTYKVSEMARKFVTVVLSGDGGDEVFGGYMTHLNGYRMDFIRKLPKFLRVVGSKLPVKKDLNGIANLYLLKEAFRLSLINPEEFYAESIKEDAIRPEIYKKWTIEKLRYCLNKGDNKLGEALRIFDLLFNTLCDNFLVKVDRASMLTLWKLEVHF

SEQ ID NO: 13439 - protein, 659 aa, Haemophilus influenzae
MFTIYNNSNPIPMGYSQAVENNVQITNFALFSAAASGVELCLFDEQNQETRLPMVRTGNVWHLAVTGVKTGTEYGFRIHGEFANPQKLILDPYAKAVNGKPDLSSEESRSWFLLSDNRDNAHLAPRAVIISEEFDWEDDTSPNTSWAKTIVYELHVKGFSQLNEKIPAALRGTYTGLAHPVNLAYLKELGVTAVELLPVNFHINEPHLQARGLQNYWGYNPLAMFAVEPKYAATNNPLAEFKAMVKAFHNAGIEVILDVVFNHSAESEQTYPTFCQRGIDDQTYYWRNDQGRYINWTGCGNMLNLSSDVGRKWVVDCLRYWVEQCHIDGFRFDLATVLGRDTPDFNSSAQLFTDIKNEPSLQNIKLIAEPWDIGHYGYQVGNFPSYFAEWNDRFRDDLCRFWLWKSGEIGAFAERFAGSSDLFKKNDRLPHTTLNFITAHDGFTLKDLVSYNQKHNETNGEENRDGRNENYSYNHGVEGSTESLSEPQKSAVENNRTFAQSGLLMSLLLANGTPILLAGDEFGNTQYGNNNAYCQDNEITWLKWANFNEELFELTKQTIALRQQIGSLNKDQWWSDENVQWLNIVGEPMTVEDWQNQQTKALQVVLDNRWLLLINAKAEGQMFHLPNRKWKPQIGTHNVTLEAQQAELSSMGFCMLNDE

SEQ ID NO: 13440 - protein, 318 aa, Nocardia farcinica
MSARETPAVRSVLVVANRLSGQGRGHDTAAAAVARLAARGVEVTEVRADSAAESVRLVRDALADPQARPGAVVCVGGDGLVCVLLDALAHAGVPLGLVPSGTGNDLARALGVPTDDTAAAVDLLLRGRTAVMDLGQITAPGAAPMWFATVAGTGFDARVTLRANRMRWPRGPLRYTVAALAEITGGIGLPYRIELAGIAPGALDNPAADGAFDTDAVMVAVGNTRTYGGGMLICPDAEPDDGLLDVTVVGAVSRLEMLRFLPALSAGKRVDHPAVRQYRAAEVTLSSPGAPATADGEPAGTLPITARAVPRALTVLVP

SEQ ID NO: 13441 - protein, 480 aa, Unknown
  Synechocystis sp. PCC 6803
MTATLSRAAWASNFSQNAVEFDRTGLELISGQIPAELKGSLYRNGPGRLSRGSEKVGHWFDGDGAILAVHFGEGQAQGLYRYVQTQGYAEEEKAGRYLYGNYGMVDPQGVWHYWKSLLTQTDVLKNASNTSVMALPDRLWTLWEAGHPYALDLENLATLGTEDFGGAFQPGQPFSAHPLRDPVTGEIFSIGVDFQFNLNLYRLDRQGNLLKHRRLKLSRTPFCHSFCMAGRYLVLFLPPITLNQFSLLLGNVAYADALGWDAQGGTKIVVFDRQTLEIVSKGETESWFQWHYGNGCELDDGNVRLDFVRFNDFAQTNEYLREVPTGAVKTSTDGQLWQAILNPQTAKIVELTNVLSRSGEFPVINPQRTGQPWRYTYMALQRPAEILGSQWFGEIARIDYHTGDVTTAKLGEHQYPVEPLYIPHPDDGGRGWIITVVYDGDRHGSEVWLWDADRLQAEPICRLALPQVIPFSFHGTWRSV

SEQ ID NO: 13442 - protein, 351 aa, Neisseria meningitidis
MKHRTFFSLCAKFGCLLALGACSPKIVDAGAATVPHTLSTLKTADNRPASVYLKKDKPTLIKFWASWCPLCLSELGQTEKWAQDAKFSSANLITVASPGFLHEKKDGDFQKWYAGLNYPKLPVVTDNGGTIAQSLNISVYPSWALIGKDGDVQRIVKGSINEAQALALIRDPNADLGSLKHSFYKPDTQKKDSKIMNTRTIYLPAAASGAWKPISNASTAWLTRYPYANGNTKNPSYEDVSYRHTGHAETVKVTYDADKLSLDDILQYFFRVVDPTSLNKQGNDTGTQYRSGVYYTDPAEKAVIAAALKREQQKYQLPLVVENEPLKNFYDAEEYHQDYLIKNPNGYCHID

SEQ ID NO: 13443 - protein, 312 aa, Musa acuminata
IGVCYGMLGNNLPPPSEVVSLYKSNNIARMRLYDPNQAALQALRNSNIQVLLDVPRSDVQSLASNPSAAGDWIRRNVVAYWPSVSFRYIAVGNELIPGSDLAQYILPAMRNIYNALSSAGLQNQIKVSTAVDTGVLGTSYPPSAGAFSSAAQAYLSPIVQFLASNGAPLLVNVYPYFSYTGNPGQISLPYALFTASGVVVQDGRFSYQNLFDAIVDAVFAALERVGGANVAVVVSESGWPSAGGGAEASTSNAQTYNQNLIRHVGGGTPRRPGKEIEAYIFEMFNENQKAGGIEQNFGLFYPNKQPVYQISF

SEQ ID NO: 13444 - protein, 317 aa, Solibacter usitatus
MKHALIVSLAVSGLMYAQGPGQGKGAPEIVPHRTNPQGAGAPTAGSAGAIKPGIQYRGGPVMNAPAPYLIWYGNWNQSNGSDNPGGQQIVRDAIFGLSASNYYMTNASYSGVSGSLNVAGFLGNGANGSHEINDPYSQGSNLSDSQVASIVSTAIAQGLGGPGGDSNGIYFVLTSSDVNESSGFCTQYCGWHTYGTLGSKSIKYAFVGNANRCLNSCAAQTTGPNGNAGVDGMISVIAHEMEETNTDPELNAWFSAKGAEDADMCAWTFGSSQLRLPGGAYYNMTLAGISMPTRNYLIQRELDVNSKCYVDYVNKKQ

SEQ ID NO: 13445 - protein, 391 aa, Arabidopsis thaliana
MEETTTFHGLGHLFITIFLYCFSSFIVAPVITDISMAALCPGKDECSLAIYLSGFQQVITGVGSLIMMPLVGSLSDKHGRKCLLTLPMTLNILPLVTLAYSRGATIFYMYYVLKTLTSIVCEGSVLCLALAYVADNVPEGRRASAFGILTGITSCAFVCANLSARFLSIGVTFQVAAAMGILSTLYMRLFLPDSIRDNSLGAPIVINEKLSSPLLEDCPGHRNRIFRAIRLVHEMASLMRSSVPLFQVAMVSFFSSLAEAGLHASSMYYLKAKFHFNKDQFADLMIIVGASGSISQLLFMPVLVPALKEERLLSIGLFFGCAHVPSVAAIFALFSIFPSSCMRSIVSKQVASYEQGKAQGIISSICSLANVISPLAFSPLTGFITIYISIV

SEQ ID NO: 13446 - protein, 1145 aa, Nocardia farcinica
MADQEPLETTSQDADQLPERIRVHALAKRLGVTSKRILAKLSELGSEARSAQSNVDRAVAETVRDALAAGDAEPATATAAPAPPPQPEPEPEPAAPAQPGLLFSAPDPLQTSAPAPADQPATAQLFTHPVRAEAPAEPVVFQPPAEVAAPLFLPPDASAAEQLRRKRRAERDARKAEAAPEDEADTASTEPEAAEADEQDRDEQDRGEQGADADQGEGDGQPRRRRRGRRGRGRGRGEQQNDTDTDTDGEDTDHADADTEERESESAQAEESAETTDAAATADAGEGEDTEESEENGGPEGSTRRRRRRRRRKVGGDGDEAQPADDDPPNTVVHEREPRNKARGRASVDEVQGITGSTRLEAKRQRRRDGREAGRRRPPILTESEFLARREAVDRVMVVREKNFPDHPNITQVAVLEDNILVEHFVTDTGQPSMVGNVYLGKVQNVLPSMEAAFVDIGRGRNGVLYAGEVNWEAAGLGGKERKIEQALKPGDQVLVQVSKDPVGHKGARLTTQISLAGRFLVYVPGGTSTGISRKLPDTERKRLKEILREIVPPDAGVIIRTASEGVSEAELARDVERLQSTWRSIQEQADKDGGAPKTLYEEPDLLVKVIRDLFNEDFSQLVIEGERAWTTVQNYIRTVAPDLLARVSRHENNGVDVFETYRIDEQLAKALDRKVWLPSGGTLVIDRTEAMTVIDVNTGKFTGSGGSNLEETVTRNNLEAAEEIVRQMRLRDIGGMIVVDFIDMVLESNRDLVLRRLTEALGRDRTRHQVSEVTSLGLVQMTRKKLGTGLVEAFSTTCEHCHGRGIIVHNYPVEPGQAEESGGRRESGSRRRRGRDKGAAAPAANGAAPTETVEDAAVKRAHPVALAMAAHQSGGGEHDEPEAHPESVGAAEESVADQVADVAAGPDTDAVAQDEDIETVEVRPSRSRRRAGRAQREAARREAAAQQAADRSDTAQPEDAAERAAADEERDEAGTATPEALEEQAEAVLALPTDAGAVAVTESGAEPGVAEQVPVTEEVAAAESAVAELAGQVEPGQVADEAPEPAAATPAPSAESQSSADVPASSAEANGVAPERPARRRRVARSAAAPAADSSAAVFVVSGTEQPAAPVFDADEPAPVVLPRERPRRRAVGRPAGPPADEAN

SEQ ID NO: 13447 - protein, 151 aa, Zea mays
  misc_feature (69)..(69): Xaa can be any naturally occurring amino acid
  misc_feature (118)..(118): Xaa can be any naturally occurring amino acid
IPVDPRVRSVLVSGPKLRVSNAGKAFGAGVDAIGYSYAVMPSAKDLVPETHPHFIGTYWSIHSTTFCAXIVEYADAYLFARPILNDYSSVGYSLLLKKEKAIIIQPERVIMANGPAFXCVMMKEFLSELANRCNKNTTDYENYQRIFESDG

SEQ ID NO: 13448 - protein, 181 aa, Brassica napus
MAYSMLSSAAVVTSPAQATMVAPFTGLKSSSAFPVTRKANNDITSIVSNGGRVNSMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 13449 - protein, 271 aa, Methanosarcina acetivorans
MVRMGNDNWPEIGEFVVCTVKNVTDFGAYVELEEFGGREGFIHISEIKAGWVKYVRDYVREGQKIVCKVLNVDPSRGHIDLSLKDVNEHQRRAKIQEWKNEQKAAKWLQFVAEETKTDENGLQALHEKLVEEFGSAYSAFEEAAIEGEKAFKGLKVNKKYLKSITKIAGENIKLPFVDIAGYVDLTCNHPNGIEVIKQALNAANSISDVDGKDVRLEVSYTGAPRYRIKVIAPDYKKAESVLKKSAQTAIDTISKLGGHGTFKRHIESAKA

SEQ ID NO: 13450 - protein, 396 aa, Arabidopsis thaliana
  misc_feature (288)..(288): Xaa can be any naturally occurring amino acid
  misc_feature (313)..(313): Xaa can be any naturally occurring amino acid
MSLTLEFLLLLIVLILSHHAHSGSIVKFLPGFEGPLPFELETGYIGIGEEEEVQLFYYFIKSEKNPEEDPLLLWLSGGPGCSSLTGLLFENGPVALKFEVYNGSVPSLVSTTYSWTKMANIIFLDQPVGSGFSYSRTPLVDKISDTGEVKRIYEFLQKWLSKHQQFFSNPFYVGGDSYSGMIVPPLVQEIGKGNYQINLQGYILGNPITDTESEQNYQIPYAHGMALISDELYKSMERICKGNYVKVDSLNTKCYKLIKDYQKCIHKLNKYHILLPDCDITSPDCFVXLYRYTLITFWANNKSVREALQVNKXGDHDMMVPFLATQAWIRSLNYSITDDWKPWMINDQIAGYTRSYSNKMTFATIKASLLGSGHTAEYKPKETSIMFKRWISAQPL

SEQ ID NO: 13451 - protein, 340 aa, Ostreococcus tauri
MRFCGVPLLRPDASTRANARTLRDDPNAALERKITVNSMLVVANGAKDGKDCDEVKRMASARGIACSVVKTTGVGHCVEIVRDADLSGVDVVGVVGGDGTFREAVQGWIERASDGETVTEETALLAFPCGTGNNYARDLGVKTIEDAFGKVDAGKCRKVDAVKVRDGDGAEHVSVNVVTWGMARDAAETAEGMRWMGPLRYDVAGLWHILLNKQNKGTIGVSESFEGEIASETNDYLMLFAQNTRCSGRAFAFTPLAELDDGFFDVVVCDKGSMLRTKSLFDATKSGGGHVEDAGVKYVRAKRLSLSTESPGERVGIDGELTVPTPIHLTVLPGAFTTLV

SEQ ID NO: 13452 - protein, 494 aa, Pseudomonas fluorescens
MRRPGQRHKDGPSQRFIRAHNNKEALKVTTSNKGFEAISNREHGLRRQLTAGQMSMIAIGGAIGTGLFMGSAYAIGYAGPSVLLSYAIGALITLILMGCLAEMTVAHSTSGSFGAYAEFYVSPLAGFLVRYAYWAAIVLAVGAEVTAIAMYMKYWFANVPEWVWIISFSSVLIVLNGISVKTFGNFEYWFSTIKIAAIVGFIILAVYVVFGSGNPDYGLHNYSAHGGFFPNGFEGMWIAVIVSIFSYLSVEMIAVAAGEAKDPQRAVKQAFRATIVRLVVFYLLTLALMLAIVPWAQAGKAQSPFVTVMQTIGIPGATGVMNFVILIAALSAMNSQLYITTRMMFSLSRAGYAPKSMGALSKNGIPLNALLLSSSGIALATLVNVLYPESSFTLMMAISMFGAIFTWFMIFLTHYCFRRYHQRHGEQQLSFRMRLFPYSTLLGLVLMGAVMITTFFTEAFKMTLVFGVPFLLLLTLVYYLCFRKPRVVAGLSEV

SEQ ID NO: 13453 - protein, 175 aa, Capsicum annuum
MASKMCEPLVIGRVIGEVVDYFCPSVKMSVIYNSNKHVYNGHELFPSSVTTKPRVEVNGGDLRSFFTLIMIDPDVPGPSDPYLREHLHWIVTDIPGTTDCSLGREVVGYEMPRPNIGIHRFVFLLFQQKKRQTISNAALSRDRFCTRKFSEENELGSPVAAVFFNCQRETATRRR

SEQ ID NO: 13454 - protein, 99 aa, Arabidopsis thaliana
  misc_feature (77)..(77): Xaa can be any naturally occurring amino acid
RAQPRVRRKLKVNATGTTPAMCYRQIKGNPYPKSRYCRGVPHPKIRIYDVGMNRKGVDDFPFCVHLVSLENENVSSXHLKPARIACNKYMGKSAGKDAF

SEQ ID NO: 13455 - protein, 764 aa, Methanosarcina mazei
MTEGDKSTIKLKVAEADQRDVGKGIVRIDEKFREKLGLKPFDVVEIRGGKSTSALIGRPYPSDSGLDIVRMDGLIRMNAKTSIGEYVDIRKADWKEAKSVTLAPVAKGMQIYAPSETLKAVFMNRTVSKGDFISTTSLRRSRERETFGKGVMFEDFFQDFFGQGFGQSFGLGEIKLQVVSTSPSGIVKITDMTQVELLPEATEITPEQNIPTVMYEDLGGLKDAIGRVREMIELPLKHPELFDRLGIDAPKGVLLHGPPGTGKTMLAKAVANESDAYFISINGPEIMSKYYGESERAIREIFEDAEKNAPAIIFLDEIDSIAPKRAEVTGEVERRVVAQLLSLMDGLKARKNVIVIGSTNRPEAIDIALRRPGRFDREIELRVPDTEGRLEIFQIHTRGMPLADNVNLMDFAQITYGFVGADIAALCREAAMSALRRILPKINLNEPEIPGEILDSLQVTREDFENALKDVQPSAIREILIEVPNIGWDDVGGLGEVKELLKEAVEWPLKSPESYRNIGVEAPKGVLLYGPPGTGKTLLAKAIAHESDANFITAKGSDLLSKWYGESEKRIAEVFTRARQVAPSIIFLDELDSLAPVRGASTGEPQVTARILNQLLSEMDGLEELRAVVVIGATNRPDMIDPALLRPGRFDELILVPVPDEGARREIFRVHTENMALAEDVDIEKLVSLTDQYTGADIAAVCKKAGRYALREDLHAKSVRQKHFLQAIEETGPSVTPDTMKYYQAIRGELRKRKSKEIESPYYI

SEQ ID NO: 13456 - protein, 72 aa, Xylella fastidiosa
MSKDDCIEFEGTVSETLPNTTFRIKLENGHEVTAHISGRMRKNYIRILTGDRVKIEMTAYDLTKGRIIYRMK

SEQ ID NO: 13457 - protein, 116 aa, Brassica napus
LLWHPDCNTNNIYITSDQDLIISYCKADTEDQWIEGNAGSINISNILTGKCLAKITSSSGPPKEDESSSSSLGTNSKQRRNAVAEALEDITALFYDEERNEIYTAKRHGFVLVWSN

SEQ ID NO: 13458 - protein, 387 aa, Cytophaga hutchinsonii
MKVTQMYKNFLENEKAGGVVLIIATIVSLLVANSSIGHSYIGFWEMFVGGHTIEHYVNDGLMTIFFLLIGLELEREVYAGELSNFKKALLPIIAALGGMIVPACIHMFFNTGTPFQSGSGIPMATDIAFAVGILSLLGNKVPLSLKVFLTALAVIDDLGAIFTIAIFYSRGIDVMYLAGAAGIWAVLFILNRRNVNILWPYLLGGIVMWYFMLHSGVHATITGVILAFVIPFGKGDPDSISIKLQHWLHKPVAFIILPIFALANTCIIIDSDWSASLMSTNSIGIFLGLVVGKPLGITLFCAIAVWLGICSIPNDLKWMQVIGVACLGGIGFTMSIFITLLAFDDHAVISGSKIAIMLSSVTAALIGLLWLKMTLKEPLSNELTEEI

SEQ ID NO: 13459 - protein, 249 aa, Aeropyrum pernix
MQEVHDYGAYLILDEYGGVRAFLPWSEIASRAVRNIHAVLKPRQKVVVKVIRVYKKRGQVDVSLKRVMDSEKKRKMMFYKRYLKAATLVELIAEKLGKSVDEAYREVLWKLEDAYGDPMKGLEAAVLQGREALEKAGVPEEWIEPLLETAKTHVRVKTVKITFYLTLRSMAGDGVERVRKVLEAAKSQIESFKDSKVVARIYTVGAPKYRVELQGYNYKTLEKALEKMVEAARKTASKLGVEFSFERED

SEQ ID NO: 13460 - protein, 588 aa, Oryza sativa
MSSPPDSATTCNFLFSPPAAQMVAPSPGYYYVGGAYGDGTSTAGVYYSHLPVMPIKSDGSLCIMEGMMPSSSPKLEDFLGCGNGSGHDPATYYSQGQEAEDASRAAYQHHQLVPYNYQPLTEAEMLQEAAAAPMEDAMAAAKNFLVTSYGACYGNQEMPQPLSLSMSPGSQSSSCVSAAPQQHQQMAVVAAAAAAGDGQGSNSNDGGEQRVGKKRGTGKGGQKQPVHRKSIDTFGQRTSQYRGVTRHRWTGRYEAHLWDNSCKKDGQTRKGRQGGYDTEDKAARAYDLAALKYWGLSTHINFPLENYRDEIEEMERMTRQEYVAHLRRRSSGFSRGASIYRGVTRHHQHGRWQARIGRVAGNKDLYLGTFSTQEEAAEAYDIAAIKFRGLNAVTNFDITRYDVDKIMESSSLLPGEAARKVKAIEAAPDHVPIGRELGATEEASAATVTGTDWRMVLHGSQQQQAAACTEATADLQKGFMGDAHSALHGIVGFEVESAAADEIDVPGGKISGINFSNSSSLVTSLSNSREGSPERLGLAMLYAKHHPTAVSLAAMNPWMPMPAPAAAHVMRPPSAIAHLPVFAAWTDA

SEQ ID NO: 13461 - protein, 582 aa, Unknown
  Synechococcus sp. CC9605
MVVAPAAPKLSLQCEAIGADTHTIRSLDWDRSRFDIEFGLRNGTTYNAFLVRGERTALIDTSHAKFRDTWIPLLKEQINPTAIDVLIVSHTEPDHSGLIGDLIDLNPEIEIVGSKVALQFLKDQVHRPFKSRAVKSGEELDLGTNPESGIQHRFEFLSAPNLHWPDTIFSFDHGSGILYTCDAFGLHYCSDDVFDADPGAIAPDFRFYYDCLMGPNARSVLQALKRMDGLPEINTIAVGHGPLLRHHLSHWISDYREWSGQRSKGESYAAVCYLSQYGFSDRISQAIAHGIGKADAQVQLLDLRATDPQELTALIGDAKAVVVPTWPAEPEPNLKASIGTLLAALHPKQLVGVYDAFGGNDEPIDAVADQLRSQGQKQAFSPLRIKQLPQGSDYQRCEESGTDLGQLLTKEKTIAAMKSLDGDLDKALGRISGGLYVVTASQGEGESKRRSAMVASWVNQASFTPPGLTIAVAKDRAIEALMQVGDRFVLNVLRQDNHQQLMRHFLKRFPPGADRFAGVNVLEGTADGGPVLADALAFLGCRVEQRMEGPDHWIIYAVVEQGNVADAEASTAVHHRKVGNHY

SEQ ID NO: 13462 - protein, 321 aa, Xylella fastidiosa
MSDYPASAKHSRLLILGSGPAGWTAAVYAARANLQPVLITGLQQGGQLMTTTEVDNWPGDAHGLMGPDLMERMQAHAERFDTKVIFDQIYKADLSTRPFTLFGDSGLYTCDGLIIATGANAKYLGIPSEEAFKGRGVSACATCDGFFYRDQDVAVIGGGNTAVEEALYLSNIARKVYLIHRRDKLRAEKIMQNKLFSKAATGKIELIWNNAVEEVLGNDASVTGVRIRSTQDSSTRDIDVQGLFVAIGHHPNTDLFAGQLAMNNGYLQIHSGTAGNVTQTSVEGVFAAGDVADQHYRQAITSAGFGCMAALDAERFLDKGN

SEQ ID NO: 13463 - protein, 170 aa, Brassica napus
RDLAAAARGEGDETEGERASCSHGGGSCGSDDEDGANRDGSRKKLRLSKEEALVLEETFKEHSTLNPKQKLALAKQLNLRTRQVEVWFQNRRARTKLKQTEVDCEYLKRCCDNLTDENRRLQKEVSGLRALKLSPNLYMQMTPTTLTMCPSCERVSASSSAVAAPPPPSS

SEQ ID NO: 13464 - protein, 597 aa, Unknown
  Synechococcus sp. CC9605
MTSTATTRRTIQLPIDDGVIGLRGLSPQRHRFELEYALERGSTANSVLFEAGDGAPAVLVHPPGMAYSAAFLPVLADALPSCDALLVVVGHVNPNRVALLRELAETYAGLELIVSNPGAKLIEELWSQRKPAPPGETSEQPPLPDLPPLRVIRHEQPLPLSHQRSLMLLPAPTPRWPGGLLAFEESLGLLMSDKFFSAHLCTDSWAERNRSSTEEERRHFYDCLMAPMARQVDALVERLEELDIRTIAPGHGPAIEASWRSLLNDYRRWGEGQQTASLTVALLFASAYGNTAAIADALARGVSRTGIRVSSLNCEFTPADELVSTVQQADAVLIGSPTLGGHAPTPIVSALGTLLAEGDRSKPVGVFGSFGWSGEAVDLLETKLRDGGFSFGFEPIRVKFSPDAARVKELEETGTRFARQLLQSQKRAQRRSAGGLSESRSDPAVLALGRVIGSLCVLTTRKADLSGAMVASWVSQASFNPPGITVAVAKDRAVEALLHKGDRFALNVLAEGRETALMKQFLQPFEPGADRFAGLELDTSPAEQPLLPDALAWLDGKVSQRMECGDHWLIYAEVDHGGVLDAEGSTAVHQRRSGANY

SEQ ID NO: 13465 - protein, 172 aa, Unknown
  Populus tremula x Populus alba
PLGWPVGGFPGPQGPYYCGVGADKSFGRDIVDSHYKACLYAGINISGINGEVMPGQWEFQVGPAIGISAGDEVWVARYILERIAEVAGVVVSFDPKPIPGDWNGAGAHTNYSTKSMRNDGGFAVIKKAIEKLGLRHKEHIAAYGEGNERRLTGRHETADINTFSWGVANRGA

SEQ ID NO: 13466 - protein, 469 aa, Zea mays
METADYSGKLFVGGISWETDEDRLREYFGRFGEVTEAVIMRDRSTGRARGFGFVVFADATVAERVTIEKHMIDGRMVEAKKAVPRDDHSIVSKSNTSSIGSPGPGRTRKIFVGGLPSNVTEADFRGYFEQFGVITDVVVMYDHNTQRPRGFGFITYDSEDAVDKALHKSFHELNGKMVEVKKAVPKEQSPGPVARSPAGVGQNYAMNRVHSFLNDFNQGYNPNPIGGYGMRVDGRFGQLSGARNGLSSFGPGYGMGMNVEGRMSGTFGANSGFISNSNGRQMGSYFNGSSNRLSSSIGYLGYDSGSMLSSMSRNFNAGVNYPINPTNMSAFAALGNGGGVNYMGLPSIAPELAQLGNISSLGSGNFSRGAGVNNLSLPSGSYGRSNSTGTIGEPFSASGNAYEVNNPDTYGNSSIYGGTSWRFPSSEVDVPSFSHDLGNVDPNMKSDISANYMGNYSVSNNQPSRGITS

SEQ ID NO: 13467 - protein, 420 aa, Xanthomonas campestris
MSISPDSASAPAPGRRRAALIFIFITVLIDVLSFGVIIPVLPDLVRQFTGGDYAAAAGWIGWFGFLFAAIQFVCSPLQGTLSDRYGRRPVILLSCLGLGLDFILMALAHTLPMLLLARVISGVCSASFSTANAYIADVTPADKRAGAFGMLGAAFGIGFVAGPLIGGWLGSIGLRWPFWFAAGLALLNVLYGWFVLPESLPPERRTARLDWSHANPFGALKLLRRYPQVFGLASVVFLANLAHYVYPSIFVLFASYQYHWGPREVSWVLAGVGVCSIIVNAVLVGRIVRWLGERRALLLGLGCGVIGFVIYGLAGSGRTFLLGVPISAFWAVAAPAAQALITREVGADAQGRVQGALTSLVSLGGIAGPLLFANVFAWFIGSGAPLHLPGAPWLLAGLLLAAGWFMAWKRAGRSPALAQG

SEQ ID NO: 13468 - protein, 258 aa, Arabidopsis thaliana
MASSSAAMSLESISMTTLNNLSRNHQSHRSSLLGFSRSFQNLGISSNGPDFSSRSRSTTSKNLNVTRAFFWNWGKKTENSRPSKIQELNVYELNEGDRNSPAVLKLGKKPTELCLGDLVPFTNKLYTGDLKKRVGITAGLCVLIQHVPEKSGDRFEASYSFYFGDYGHLSVQGQYLTYEDTFLAVTGGSGIFEGAYGQVKLRQLVYPTKLFYTFYLKGLANDLPLELTGTAVTPSKDVKPAPEAKAMEPSGVISNFTN

SEQ ID NO: 13469 - protein, 357 aa, Unknown
  Synechococcus sp. WH 8102
MTLWVVKLGTSLLRGDTAATIAGFAAGIAAAFARGDRVVLVSSGAVGLGCQRLQLPQRPETVVALQAAAATGQGQLMALYERALANHGIAVAQILVTRSDLADRRRYQNASGTLQQLLQWGVLPVVNENDAISPAELRFGDNDTLSALVAAAVGADQLILLTDVDRLYSADPRLVVDARPISDVHHPRELDALEAVAGDGGRWGRGGMTTKLAAARIATASGITVHLADGRDPRRLDALLQGERGGTVFHPHPEPLGNRRSWLAHALQPQGELTLDAGACDALHQRGSSLLMVGITAVKGVFGANQPVRLQGPDGRELGRGLCQLSSAAVQRALDAAPAAGPSPVVVHRDALVLHSR

SEQ ID NO: 13470 - protein, 597 aa, Unknown
  Synechocystis sp. PCC 6803
MGIHAKLETVQLPLLVSCLFPPLTMPAKDVQICPIAVDTTVFRSRTWDRLKFEIEYGLQRGTTANSYLISADKIALFDPPGESFTDNFVGTLIQRLDLNSLDYVILGHVNANRAHTLKLLLSLAPQATIICSNPAAQNLEKLLADAEVNNPIQVMKGNDHLDLGRGHELTFIPTPSPRYPGQLCTYDPRTEILFTDKLFGAHVCGDQVFDEGWTIYQEDRRYYFDCLLAPAAAQVSAALNKLEAYPAQTYAPSHGPLVRYGLRELTRNYQQWLSEQQAQALNVALIYASAYGNTSTLAQAIARGITKAGVAVTAINAETSNAEEIKEAIGKSAGFIFGSPTLGGHAPTPIQTALGITLANASKTQLCGVFGSFGWSGEAIDMLENKFRDAGFSFGFDTIRVKFKPTDQTLKMCEEAGTDFAQALKKAEKRRQPKSALPESESARTEQALGRLVGSLCVVTAQQGELSSAMLASWVSQATFSPPGLTVAVAKERAIESLLHKNSCFVLNILQEGNHLGLMKHFLKPFAPGGDRFADVATETAENGAPILTESLAYLECRVQQRLECGDHWVLYAVTDRGALLKDGVTAVHHRKSGDHY

SEQ ID NO: 13471 - protein, 241 aa, Cucurbita maxima
MERRMWRDKMRLKRLKEQSKVKEGIDIVKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPTGVEEWWPQLGLPKDQGPPPYKKPHDLKKAWKVGVLTAVIKHMSPDIAKIRKLVRQSKCLQDKMTAKESATWLAI

SEQ ID NO: 13472 - protein, 241 aa, Cucurbita moschata
MERRMWRDKMRLKRLKEQSKVKEGIDIAKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPTGIEEWWPQLGLSKDQGPPPYKKPHDLKKAWKVGVLTAVIKHMSPDIAKIRKLVRQSKCLQDKMTAKESATWLAI

SEQ ID NO: 13473 - protein, 781 aa, Magnaporthe grisea
MAPKKKIAVMTSGGDAPGMNAAVRAIVRMSIHLGCDAFCVYEGYEGLVQGGNFIRQMQAEDVRGWLSEGGTLIGTARCMAFYERPGRLTAAKNMVLNGIDALIICGGDGSLTGADKFRAEWPSLLEELVSKGELKEEQIAPYKHLNIVGLVGSIDNDLSGTDATIGCYSALSRICEMVDYIEATAASHSRAFVIEVMGRHCGWLALLAGVATGADFIFIPEHPQEGNWKEGMYAVVEKHRKLGKRKTIVIIAEGANDRNGKKITPEEVKDLLADKNGLALDTRITTLGHVQRGGRAVAYDRIIATQMGVEAVRAVIEATPETETCFIAVNENKIVRKPLMQAVKDTKKVATAIEAQDFDQAMSLRDSEFAEQYQSFQIMTTPEPALLLPKEKRMKIAFINVGAPAGGMNAAIRAGVLWCQSRGHEAIAIHNGFAGFARHHGDKPLGAVRPFDRLEVDGWASRGGSEIGTNREVPSQSGMELIAKLIGQYGFDALFVIGGFEAFQAVSELRRAQEEYPSLRIPMALLPATISNNVPGTEYSLGSDTALNALVDYSDMIKQSAAATRRRVFVIETQGGKCGYLATLAGMACGASAVYTPEEGISLDMLAADVAHLKEIFAHDKGQSRAGRLVLVNEKASNVYNAKLIADILREEAHGRFEARDSIPGHVQQGGVPSPMDRSRAVRLAIKCIQHLEQYGPKPHEKVKADPRSAGVIGIRGADVVMTPMKEVEDTETDWPNRRPLNAFWTEMKESVDILGSRGPYPRPEPTLKGLKAKDVKRGLE

SEQ ID NO: 13474 - protein, 226 aa, Phaeodactylum tricornutum
MSDISLSQLLEAGVHFGHKAYRWNPKMFPYIYSEVNNIHILDLVQSATLLKEANLYLESAARENKTFLFVGTKRQASTLIAQEAKRCDSYYVNHRWLGGMLTNWSTLKERIAHLKDLEQQEANNTFDLLTKKEGALRRKELKKLRRHLDGIKDMKNLPDIAIVIDQKRETTAIRECRKLGIPVVSILDTNCDPDLVDIPIPGNDDAVRSIKLILKSLTDSILIGKS

SEQ ID NO: 13475 - protein, 275 aa, Prochlorococcus marinus
MTDFLVAALQITSTSNVEANFTEAEEQIELAARRGAELIGLPENFAFLGGDDEKLRLASELSVKCTNFLKTMSQRYQVFLLGGGYPVPAGDDSHTFNRSALFGKDGQILAKYDKIHLFDVDLPDGNLYKESSTILSGAEYPPVVDVPGLCKIGLSICYDVRFPELYRYLSSNGAELIMIPAAFTAFTGKDHWQILLQARAIENTAYVVAPAQTGIHYGRRQSHGHAMVIDPWGTVLSDAGKTQGAAIAPADKERVKKIREQMPSLKHRKNKLFSN

SEQ ID NO: 13476 - protein, 234 aa, Oryza sativa
  misc_feature (216)..(216): Xaa can be any naturally occurring amino acid
AREFSSELRAGSKASKSSTPLFEGPASANQSISITDTTADAYCKMITVFIPLLVDESSFFAHFMCFDVAALAPSDESDNNNPVAVSEPPGSSAKPINSSAELGVLNQFLQELLDGIQEDFYAIVDWAFKLDPLSCISMHGITDRYLSAQFVDDACYQIEKYERNVRQIGVVPYIPRFSQLAARMEQYINGSRDLVDQAYTKIVTIMFVTLEKIAQXEPKYVDIVLLENYAAFQH

SEQ ID NO: 13477 - protein, 77 aa, Unknown
  Iris sp. Qiu 95091
MKEQKLIHEGLITESLPNGMFRVRLDNEDLILGYISGRIRRSFIRILPGDRVKIEISRYDSTKGRIIYRLRSKDSND

SEQ ID NO: 13478 - protein, 345 aa, Oryza sativa
  misc_feature (209)..(209): Xaa can be any naturally occurring amino acid
MEFTPKITGKTTSMSGELKRDYEIGEEIGRGRFGVVHRCTSRATGEAFAVKSVDRSQLADDLDRELAELEPKLAQLAAAGNPGVVQVHAVYEDDAWTHMVMDLCSGPDLLDWIRLRRGAPVPEPVAAAVVAQLAEALAHCHRRGVAHRDVKPDNILLDVVDDGIDGGGTPRARLADFGSAAWVGESGGSAEGLVGTPHYVAPEVVAGGXEYGEKADVWSAGVVLYVLLSGGALPFGGETAAEVLASVLRGSVRFPPRLFAGVSPAAKDLMRRMMCRDTWRRFSAEQVLGKNNPTKSSKSSWISPHFPPSFRSKRTNHLIACRAVRNAGHPWIVSGGGARAMEQPT

SEQ ID NO: 13479 - protein, 216 aa, Hyphomonas neptunium
MLFMKKNLDLPTAETALKGRSIAIPTADTHFVFGRPLNAPPPEGIETAIFGLGCFWGAERIFWKTPGVWLTRVGYAGGITPNPTYEEVCSGRTGHTEIVEVQFDPKEVSFAALVKLFLESHDPTQGMRQGNDIGTQYRSAIYFRSPEQEATARQMITEYEKALAASGHREKVTSEVKPLDTLYLAEDYHQQYLAKNPNGYCGIGGTGVSCPLPQTA

SEQ ID NO: 13480 - protein, 946 aa, Ostreococcus tauri
MGAIDARGTDERRDALALKTPPPSDRASLRALDDARASARTARETRREAVRGRAWETARALARSGRGRDALETLARTSTEALGGISGRMCAEGECLEAMGMTTAAYERFRAACGDDDGRPEAWCGLGRLAHASGAYDEATKCYRRGRDRFKELGAMDEAREADQTLAAAWTDLGTTHKAAGDVERALATYRAVIAELPWCAAAAYYNLGVSLVECGQLVEAEHAYRRSIAVDPTRAEAYCNIGVVFKMMSRMDEAVEAYEHCLRLAPDFELGRKNLSLVLTDQGTEFKMKNSLSAAMATYERALTYDSLNVEAYYNLGVACAEAEEYDRAIIAYETAGRLRPHYAEVWNNAGVLYKERGNDERAMEYYHRAVACNPNFAQPLNNLGVLHTMSGQAQFALDALQRAVTVDPAYAVAHNNIGVLLRDTGDIEHACDAYRECVRHSPNDRHAEQNYLLALNYIRRGEEREVCEAHAAWGTRFAKLIGPPLKARRAVRQDSGAGTPGRRKLVVGYVSPDMYTHSVSYFAAAPLRSHDSEMIKPIVYNVAKFRDAQTERLRKFTLESGGEWRDCATLTEAELAECIRNDSVDVLVELTGHTANNRLGTMVLEPAPVQITWIGYPNTTGLRSIRYRITDEVCDPAATKQTFTEQLVRLPSPYAFLCYTPNPEAPSTVSLAPCLSVGYVTFGCFNTMAKVTAEVRTVWSRIMLATPGSRLYFKSKAFACEVIRQRFLTQMAACGIESWRIDCVPLEKATSSHLAMYDRVDIALDTFPYAGTTTTCESLYMGVPVITLSGGCHAHNVGKSLLKTIGLDEFVANDVEAYVRIATSLAKDTKRISKTRSSLRDKLLHSPLCDANGFTRELESIYRELWQRWCDEQARAADAESDLDEEAEEKEDDEDRCSVDGVEDGSKGESNSSDNDTAEQYAGTSAEHAEQGEFSSKLIDTLEI

SEQ ID NO: 13481 - protein, 960 aa, Unknown
  Synechococcus sp. CC9605
MHSTLTSPFAQRHIGPSEAEQLRMLNALGYSDLQEFIADVVPADILDSKPPVEALPEGCGEAEALQQLKQLSETNTLRRSLIGLGYYGTATPALIQRHVFENPAWYTAYTPYQAEIAQGRLEALLNFQTLISELTGLPIANASLLDEATAAAEAMSLSFGVCRRPEATRFLVDANVLPQTWAVLQTRAEPLGISLECIDPATAPIDASVFGVLLQLPGADGCLWDPSAVIQAAHAAGALATVAIDPLAQTLMAPVGSLGADIAVGSAQRLGVPMGFGGPHAAFFATVEAYKRQIPGRLVGQSKDAEGRSALRLALQTREQHIRRDKATSNICTAQVLLAVMASFYAVHHGPDGLQAIAQRIVGLRSQLEQGLRALGYPLQLADRFDTVTVHCVLAPAVHRAAAVAGFNLRVLPDGAAPADATGFGISLDELSDQQELQALLALLAEACGQVPPQLEAAQPPSLSLPQRSQPWLSQSVFHQYRSESELLRYIQRLVSRDLSLVHGMIPLGSCTMKLNAAAELQPVSWPAFAALHPFSPADQAQGYRRLADDLEQWLAALTGFAAVSLQPNAGSQGEYAGLLVIRAWHHSRGEAHRDICLIPTSAHGTNPASAVMAGLKVVAVACDDEGNIDQQDLAAKAAEHADRLAALMVTYPSTHGVFETGIREICAVVHRHGGQVYLDGANLNAQVGLCRPGAFGADVCHLNLHKTFCIPHGGGGPGVGPIGVAAHLEPFLPGHPLQAGAASAIGPVSAAALGSASILPISWMYLRMMGAEALRQASALALLSANYLAHRLDASYPVLFRGSTGRVAHECILDLRPLKRDAGIDVDDIAKRLMDYGFHAPTVSWPVAGTVMVEPTESESLAELDRFADALVAIREEIRAIEAGTSDPQNNPLKRAPHTLAAVTADTWDRPYSRQQAAFPMEEQQESKIWPAVARIDNAFGDRNLVCTCPSVESVAVAV

SEQ ID NO: 13482 - protein, 176 aa, Unknown
  Populus tremula x Populus alba
CAGHADGICHVYVDKSANMEMAKHVVLDAKIDYPAACNAMETLLVHQDLVQTAGLNELIVDLRTEGVTLFGGQRACKELNLPEAHSLHHEYNSMACTVEIVDDVHAAINHIHQHGSAHTDCIIAEDQDVAEVFLCQVDSAAVFHNASTRFCDGARFGLGAEVGISTSRIHARGPVG

SEQ ID NO: 13483 - protein, 145 aa, Unknown
  Populus tremula x Populus alba
EFDAIHSDKAKKMLEDHRIGELVNSSAYTSDSNASTPNNSIHLPPIKEIASIRNVALVPREKIPCKLIKKEILSHDVRLFRFALPSEDQVLGLPAGKHIFLCATVNDKLCMRAYTPTSTVDVVGYFDLVIKVYFKGVHPKFPNGG

SEQ ID NO: 13484 - protein, 522 aa, Oryza sativa
ISTMQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 13485 - protein, 283 aa, Arabidopsis thaliana
MAEHLASIFGTEKDRVNCPFYFKIGACRHGDRCSRLHNRPTISPTLLLSNMYQRPDMITPGVDPQGQPLDPSKIQDHFEDFYEDIFEELNKFGEVESLNVCDNLADHMIGNVYVLFKEEDHAAAALQALQGRFYSGRPIIADFSPVTDFREATCRQYEENSCNRGGYCNFMHVKQISRELRRKLFGRYRRSYRRGSRSRSRSISPRRKREHSRERERGDVRDRDRHGNGKRSSDRSERHDRDGGGRRRHGSPKRSRSPRNVREGSEERRARIEQWNRERDEGV

SEQ ID NO: 13486 - protein, 206 aa, Kluyveromyces lactis
MNSEYDYLFKLLLIGNSGVGKSCLLLRFSDDTYTNDYISTIGVDFKIKTVELDGKTVKLQIWDTAGQERFRTITSSYYRGSHGIIIVYDVTDRESFNGVKMWLQEIDRIATSTVLKLLVGNKCDLKDKRVVEYDVAKEFADANKMPFLETSALDSTNVEDAFLTMARQIKESMSQQNLNETTQKKEDKGNVNLKGQSLTNTGGGCC

SEQ ID NO: 13487 - protein, 241 aa, Citrullus lanatus
MERRMWRDKMRLKRLKEQSKVKEGIDIVKQRQSQDQARRKKMSRAHDGILKYMLKIMEVCNAQGFVYGIIPEKGKPVTGASDNPREWWKDKVRFDRNEPAAIAKYQADNAIPGRNDGCNSIGPTPHTLQEPQDTTLGSLLSALMQHCDPPQRRFPLEKGVPPPWWPTGVEEWWPQLGLPKDQGPPPYKKPHDLKKAWKVGVLTAVIKHMSPDIAKIRKLVRQSKCLQDKMTAKESATWLAI

SEQ ID NO: 13488 - protein, 389 aa, Oryza sativa
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSEHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPQHYPDFTWADLMRFTQRHYRADTRTLDAFTRWLAPPAADAAATAQVEAAS

SEQ ID NO: 13489 - protein, 195 aa, Unknown
  Frankia sp. EAN1pec
MARTARVERKTKESHVLIELDLDGTGLASAETGVPFFDHMMEQLGKHGGFDLTVRTEGDLHIDAHHTVEDTAIAFGTALREALGDKAGIRRFGDATVPLDEALVQSAVDLSGRPYCVHVEPELVGLIGTYDTTLTRHIFESITASARIALHVRVLSGRNAHHVVEAQFKSVARAMRDAVALDARVAGVPSTKGVL

SEQ ID NO: 13490 - protein, 343 aa, Streptomyces vinaceus
MPTCRVIRNWGVTMDPVEYEMLRHMWFPVARVADLKNGVASGSILGEELVVYGDEGSVTVAQGFCPHRGVALRLGQLRDGALECPYHGWLFETGSGRCTRIPSLPPGRGRPHTALRTHPAEVAYGLVWSCLGDPFLPLPRLPEYVDDSWRLGAGEPYTLNCGMRLLTENFRDKAHFPFVHADSMGHVDKVVQPYRISRDGWRLGWSSSLGSEGVPEDLAEELSHRLDYHITMPVFASICVSSPSGGRRLVAQVATPVSADGKAVRQFWLAGTDAESTAQGAVLADVLGFERQVFEEDHPIVENQWPVEAPLDVHSQVHTPADRFSITYRKVYGELLMNFKESR

SEQ ID NO: 13491 - protein, 317 aa, Haemophilus somnus
MSDFKHSQLLILGSGPAGYTAAIYAARANLKPVLVTGLQQGGQLTTTTEIENWPGDFGDTTGPELMQRMLQHAEKFDTEIVFDHINNVDLSERPFKLFGDAGAYSCDALIIATGASARYLGLPSEETYKGRGVSACATCDGFFYRNKPVAVVGGGNTAVEEALYLANIASEVHLIHRRDTFRAEKILIDRLNKKVEEGKIILHTNRTLAEVLGDNMGVTGIRLKNTQTENVEDLKLEGVFIAIGHAPNTELFANQLELNNGYIVVKSGLEGNATATSVQGVFAAGDVMDHNYRQAITSAGTGCMAALDAERFLDTQK

SEQ ID NO: 13492 - protein, 321 aa, Synechococcus elongatus
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFSSLYPGCVADTPLFRNTPKLFQKIFPWFQKNITGGYVTQELAGERVAQVVADPEFKTSGVHWSWGNRQQKDRQSFVQELSDKASDDRTAQRLWDLSAKLVGL

SEQ ID NO: 13493 - protein, 357 aa, Unknown
  Frankia sp. EAN1pec
MDAVMLVGGQGTRLRPLTMSAPKPMLPVAGVPVTAHMLARARDAGITRVVLATSYRAEVFEEHFGDGSGHGLELEYVTETEPLGTGGAIRNVASRLRSGADEPVVIFNGDILSGLDIGALVERHTTADAAVTLHLTRVDDPRAFGVVPTDPAGRVTAFLEKTPDPPTNLINAGCYVFRRSLIDTIPAGRPVSVERETFPSLLAAGVPVVGYPDDTYWLDLGTPAAFVLGSRDLVTGRMPSSALPGPVGDRLVLPGSTVATDAKIGGGSTIGAGASVGTGARIDGSVLFDRASVGAGAYVRDSVVGREAVIGNGVVLENVVIGDGAVIEPGNELRAGARVFPGAVLGAGAVRFSSDRA

SEQ ID NO: 13494 - protein, 541 aa, Pichia angusta
MKLSMSVLALVATCIGSAQAAAIKKDTAGQHPLGMNSKFGDVFVEKGKSLLDRVSEVVSESSKNISPELRDIWNEMEAKFPDTLKNMKLKSEPVVKITKKPADFWDFNVFNEKFSNYKLRVKKTDPGALGLDHTRQYSGYLDVEDEDKHFFYWMFESRNDPANDPVILWLNGGPGCSSLTGMLFELGSASIGPDLKPINNPYSWNSNATVIFLDQPVNVGFSYSSKSVSNTVAAGKDVYAFLELFYQQFPHLLKNDFHIAGESYGGHYIPVFASEILTHADRSFNLTSVLIGNGLTDPLNQYPFYERMACSTDGGYEPTLDESECEGMLETLPRCLSLIESCYSSQSVFSCVPASIYCNNAQLGPFQKTGRNVYDVRKMCEGTLCYKDMEYIDQYLNQDFVKEKIGAEVETYESCNFDVNRNFLFAGDWMKPYHKNVINLLEQGLPVLIYAGDKDFICNWLGNQAWSNELPWSGHEEFESAELYNLTLKDGTKVGEVKNAGKFTFARMFDGGHMVPYDQPESSLAMVNRWIAGDYSLGTKK

SEQ ID NO: 13495 - protein, 636 aa, Glycine max
FLIYKFDGVTHHSFRNVANNNLEGPIPSNLSSCKNLNSLNVHGNKLNGSIPPSLQSLESMTSLNLSSNNLQGAIPIELSRIGNLDTLDISNNNLVGSIPSSLGDLEHLLKLNLSRNNLTGIIPAEFGNLRSVMEIDLSNNQLSGLIPDELSQLQNMISLRLENNKLTGDVASLSNCISLSLLNVSYNKLFGVIPTSNNFTRFPPDSFIGNPGLCGNWLNLPCHGARPSERVTLSKAAILGITLGALVILLMVLLAACRPHSPSPFPDGSFDKPVNFSPPKLVILHMNMALHVYEDIMRMTENLSEKYIIGYGASSTVYKCVLKNCKPVAIKRIYSHYPQCIKEFETELETVGSIKHRNLVSLQGYSLSPYGHLLFYDYMENGSLWDLLHGPTKKKKLDWELRLKIALGAAQGLAYLHHDCCPRIIHRDVKSSNILLDADFEPHLTDFGIAKSLCPSKSHTSTYIMGTIGYIDPEYARTSRLTEKSDVYSYGIVLLELLTGRKAVDNESNLHHLILSKAATNAVMETVDPDITATCKDLGAVKKVYQLALLCTKRQPADRPTMHEVTRVLGSLVLSNTPPKQLAALPPASNPSAKVPCYVDEYANLKTPHLVNCPSMSTSDAQLFLKFGEVISQNSE

SEQ ID NO: 13496 - protein, 415 aa, Unknown
  Burkholderia sp. 383
MFNRTTSTVANVDPELYAAIEQENRRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAHGGHLTHGSPVNMSGKWFNVVSYGLNENEDIDYEAAEQLAQEHKPKLIVAGASAFSLKIDFERLAKIAKSVGAYLMVDMAHYAGLIAAGVYPNPVPHADFVTTTTHKSLRGPRGGVILMKAEYEKPINSAIFPGIQGGPLMHVIAGKAVAFKEALSPEFKAYQEKVVENARVLAETLVKRGLRIVSGRTESHVMLVDLRAKNITGKAAEAALGAAHITVNKNAIPNDPEKPFVTSGVRLGSPAMTTRGFGVKEAEIVGNLIADVLEAPEDAATLERVRGQVAELTKRFPVYG

SEQ ID NO: 13497 - protein, 421 aa, Nocardia farcinica
MTVETTAEFDVREAVHEAARRARVASRALAQLTTAQKNDALHAAADTLLAAADTVLAANAEDIAAAEAAGTEASLLDRLRLTKARIDGIASGLRQVAGLPDPVGGVVRGSTLPNGLEIRQVRVPLGVVGMVYEARPNVTVDAFGLALKSGNAALLRGSSSAAKSNAALVEILREALRAQQIPADAVQLLPSHDRSSVTHLIQARGLVDVVIPRGGAGLINAVVRDAIVPTIETGTGNCHVYVHAAADLDMAEQILINAKTRRPSVCNAAETVLIDRAVADTAVPRLTAALREHGVTIHGDLPGLVPATDTDWGEEYLTLDIALKVVDNLDAAVEHINTWGTGHTEAIVTGDLAAAREFTSRVDAAAVMVNASTAFTDGEQFGFGAEIGISTQKLHARGPMALPELTSTKWIVWGEGQIRPV

SEQ ID NO: 13498 - protein, 252 aa, Clostridium thermocellum
MSVISMKQLLEAGVHFGHQTRRWNPKMAEYIFTERNGIYIIDLQKTVKKVEEAYYFLREVAMNGQGVLFVGTKKQAQDSIREEAQRADQYYVNARWLGGMLTNFKTIKGRINRLKELTKMEEEGVFDVLPKKEVTKLRAEKEKLEKYLGGIKEMKELPGALFVVDPRKERIAVLEARRLGIPVVAIVDTNCDPDEVDYVIPGNDDAIRAVKLIASKMADAIIEGRQGEQLSVESTAQEQVEETAQEETAVEA

SEQ ID NO: 13499 - protein, 104 aa, Glycine max
  misc_feature (44)..(44): Xaa can be any naturally occurring amino acid
  misc_feature (82)..(82): Xaa can be any naturally occurring amino acid
MGRRPARGYREIKNKPYPKARVWRGGPDPKIRIYDVGMKKKGVXDEVPFWGHLGRWEKENGSSGALEAGRIAWNKYMGKFAXKGAFHLRGMGDPLHVLRINKML

SEQ ID NO: 13500 - protein, 404 aa, Ostreococcus tauri
MARGDDDDRVVDRDEHENVSFEVSKGIARHATFDAMGIREDLLRGLYSYGFEKPSAIQQRAVVPIISGRDVIAQAQSGTGKTSMISLALCQMLDTTSREVQGLVLSPTRELAVQTEKTALALGNFMNVQVHACIGGRSIGEDIRKLDYGCHIVSGTPGRVFDMIKRRNLRTRGIKILVLDEADEMLNKGFKEQIYDVYRYLPPETQVVLVSATLPNEVLEMTGKFMTDPLRILVKRDELTLEGIKQFFVAVEREEWKFDTLCDLYDTLTITQAVIFCNTKKKVDWLTEKMRQNNFTVSAMHGDMPQKEREEIMNEFRGGTTRVLITTDMWARGIDVQQVSLVINYDLPGNRENYIHRIGRSGRYGRKGVAINFVKEEDVRALRDIEQYYSTQIDEMPMNVADMI

SEQ ID NO: 13501 - protein, 345 aa, Ostreococcus tauri
MKSTISVRAKRSSARASRVATRAANAVNIADNVTQLVGCTPMVYLNKVSEGCGAEIAAKLEIMEPCCSVKDRIGWSMIAAAEQEGKITPGKTTLVEPTSGNTGIGLAFIAAAKGYKLTLTMPASMSLERRILLKAFGANLVLTDPAKGMKGAVGKAEEIAAKTADSYILQQFENPANPKVHFETTGPEIWEDTAGQIDIFVAGVGTGGTITGTGRYLKSKNPNCKIVAVEPTESPVLSGGGPGPHKIQGIGAGFIPGILDVDIIDEIVQVASDDAIAMAKQLALQEGLMVGISSGAAAVAAIQLAKRPENAGKLIGTVFPSFGERYLSSALFSTIRDEAEAMVAE

SEQ ID NO: 13502 - protein, 266 aa, Unknown
  Rhodococcus sp. RHA1
MRAALFQGPELSFDVAANLSAIESVAQTAAASGASILVCPEMAATGYNIGSLIAERAEPADGPIATRIAEIARESGIAVVYGYPEADGGVVYNSVQVFDPSGTPLANYRKTHLFGELDRSHFAAGDELVVQFDHAGIRCGILICYDVEFPEAVRAHADRGTQWLVVPTGLMSPYEFIAESVVPTRAYESQLFVTYVNRCGTEADLDYCGSSCAIAPDGTELARAGRHEELAIVDLELDVLHRSRRGNTHLDDRRVDLYPFLQEKTS

SEQ ID NO: 13503 - protein, 318 aa, Prochlorococcus marinus
METIETDVVIVGGGPAGCSCALYTSRADLKTVILDKNPSVGALAITHQIANYPGVPTDISGDDLLTLMRDQAIQYGTDYRRAQVFGVDVNGEWKTVFTPEGTFKAKALVLASGAMGRPASFKGEADFLGRGVSYCATCDGAFYKGREVAVVGTNKEAIEEANVLTKFASTVHWITSSDPKDDDMHAQDLMNQPNVKHWSRTRLMQIEGDDGGVTGVLVKNRSQESNQSLTLEGVFVYMSGSKPITDFLGDQIALNENGGVVVDDFMSTTSEGVWAIGDIRNTPFKQAVVAASDGCIAAMAIDRYLNSRKSIRVDWVHS

SEQ ID NO: 13504 - protein, 106 aa, Arabidopsis thaliana
  misc_feature (28)..(28): Xaa can be any naturally occurring amino acid
  misc_feature (45)..(45): Xaa can be any naturally occurring amino acid
RTRGIRTTATYTLSSATRAACPTQATLXAPINGLKNSGALPSHTXMANHYFTSITSNEGRDNCMHVRPPIGENKFETLSYLPDHIHFECSNAVDYLIRIMRVSRDQ

SEQ ID NO: 13505 - protein, 464 aa, Lactobacillus reuteri
MSGRVTLLGAGPGNPELLTLIGKRRLGEADVVLYDRLIDPSLLSFTNDDATLVDVGKMPLHHKVKQSQINEMLVDYANLGKKVVRLKAGDPYVFGRGGEEAQILQQQGINFEIIPGITSAIAGLAAAGIPITHRDFASSFHVITGHHKKDGQQLDWENIANQEGTLVFLMGMAQLPNICHQLIAHGKAVETPVAIIQWATQWRQKMVSGDLSNIVELVNKNGLSSPALIVVGNVVKLSKQLNVAKPLAGVHVLVPYSKRQRLFNCLEDLGATADFYQRSIVESAPAKLPVLDSYSSILFDDYLAYKEFIKLLTASKKDIRALVGKKILAGNQSVANHLAKQGLLVDEVVATNKLSDDVLEVGGQNSSYSHKEFLSLYQRKEQTHELPFDLAEFNAVIFPSTASLRDFKSTLNEEQFKQLKDLTAFVMGQSIYDLATQNGFKKVINCQPNIKATIEQVKEELASE

SEQ ID NO: 13506 - protein, 449 aa, Alkaliphilus metalliredigenes
MFSLFKNAKEAEKMTVKEVNPMFCYQCEQTPAGGCTKFGVCGKNPDIASLQDTMIFGLKGIAAYATHARELGLIDPEVDAITHEALYTTLTNSNFSVEEHINMTLKVGQATVKVMDLLDRAHTGKLGIPTPVVVSQDKVEGHAILVTGHNLYALEELLKQTEGKGINIYTHSEMLPAHGYPELKKYPHLKGNVGKAWFDQRKLFEEFSGSILGTTNCLMPIKGSYSDRMWTYGNAGLEGVQKIANDDFTPLIEKALALPKSNIASDKTITTGFHHSTVLDIAPEIIDAIKAGKIKRFFVIAGCDAPTKGRDYFRDLASSLPKECVILTTSCGKFRFNDIDFGTVPGTDIPRYIDLGQCNNSGSAAKIAIALADAFECTVNDLPLTIVLSWFEQKAVAILLGLFSLGVNNIFIGPSAPEFVSPGVLDVLQNTFNLQLISGDAKADLAKML

SEQ ID NO: 13507 - protein, 363 aa, Glycine max
MAAPETPLCYVGVARQSAAFRLMKQMGWEEGEGLGKEKQGIKGHVRVKSKHDTIGIGLEKPNNWAFDTTQFDNILKRLKVQAPQSHDTDIEEKVETKASVPVDNEEDSVPKTTRPQGRYARRERGKLVSQYSLKDLEGILVKKGDVSGSTDNSDGELDMLKTSEIQKFEDEGSKYPAIPPDWWGYKYGFVSGGFLGAESKKKKSMISGKAERTAFFEEDQENLYNLVQEKSTTGKQGLGIKDRPKKVAGCYFQGKKKSFDDSDEDSADNDSLEQAANDDLIKVEKIVEGKVKLKKLCKQILQQVPGESLKLKQLKVLIDEHSSSILSDFSSRRESVAYLKQKLTGSRKFYIEGKRVRLASKRS

SEQ ID NO: 13508 - protein, 177 aa, Arabidopsis thaliana
MENMGTRVIEPLIMGRVVGDVLDFFTPTTKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFRQKQRRVIFPNIPSRDHFNTRKFAVEYDLGLPVAAVFFNAQRETAARKR

SEQ ID NO: 13509 - protein, 126 aa, Prochlorococcus marinus
MLRVGDLEKSLWFYTTILGMNLLRQKEYPSGRFTLAFVGYGPEENNTVLELTHNWDVDHYELGNAYGHIALGVKNIFETCELIKKNGGNIVREPGPMKHGKTIIAFVEDPDGYKIELIDLSSRTLK

SEQ ID NO: 13510 - protein, 509 aa, Zea mays
  misc_feature (81)..(81): Xaa can be any naturally occurring amino acid
GSRDSIGTVLKCMQKGAVDFLVKPVRKNELGNLWQHVWRRHAMNCQTNGSENNAASNHVSTNVANGSKTGENNDEESDAQXAPSESEKNVRSKCLNGITSAKVAEQIMDNALRITDASSRRPTNLGKDLAMTEPAADRKCQSLVMENNAVKEKNPGEKSKSAVIGHADSYPSQFLETNLGKQQYRNGYKNQEFREKDIFNHSNSSAFSRYGNRRIESSGEIQFLPSRCIVGQEQHVHGKDPVFQPNGVLLPPNDHNTGESTRQARITLDSSMEGADIICSSSAREDAGASSSSHRKDSMSHPSYGFVPVPIPVGAMMPYHCGAILQPVYYPQGPLMHCNSSAINKATIHQTSGQSNYREDCGSGRPSQVDEHKQSEEKHQLHHSRQIHRESGQPVDMVRAHMDHANQSASCSRDICKGSGCTGSGEADTNANTTVALESGNESGIQNSDRSHREAALMKFRMKRKDRCFDKKVRYHSRKKLAEQRPRVKGQFVSQKLKAAMATEAETDS

SEQ ID NO: 13511 - protein, 921 aa, Oryza sativa
MASKGTEGGHGGVERKEQQQQRGYQLPRDSRGSLEVFNPSSASSFRTAAAAPKSASPFLAIPDREEDNVVAQQRAAEWGLVLQTDHHTGLPQGVSARPSSGSARTSSEDNPQQQQSAAAIPRVSEELRAALSAFQQTFVVSDATHPNHPIMYASAGFFNMTGYTSKEVVGRNCRFLQGSGTDPHEIDKIRQSLANGSNYCGRILNYKKDGTPFWNLLTIAPIKDEDGRLLKFIGMQVEVSKYTEGKKDTVVRPNGLSESLIKYDARQKDHARSSVSELLLALKNPRSLSESSNNTLKRKSQESLSMSMTEVPSKRSSESGSRRNSRSGTRSSLQKINEVPDQGNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRATVRKIRDAIDNQAEVTVQLINYTKSGKKFWNLFHLQPMRDQKGDVQYFIGVQLDGTEHVQDDAAKEGVVLVKKTADNIDEAAKELPDANLRPEDLWANHSKVVLPNPHMKDTASWRAIQKVLESGESIGLKHFRPVKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYAAEVVVALEYLHCQGIIYRDLKPENILLHRDGHISLTDFDLSCLTSCRPQVFLPEDADEKKGRKNGSYPIFFAEPMRASNSFVGTEEYIAPEIITGAGHTSAVDWWALGILLYEMLYGYTPFRGKTRQRTFANILHKDIRFPASISVSLAARQLMYRLLHRDPANRLGSYEGANEIKGHPFFRGINWPLIRATAPPKLEIPLFSKDDMEKKGLVTNNRTDMF

SEQ ID NO: 13512 - protein, 441 aa, Debaryomyces hansenii
MLNTHNIHWLTPSKRIYDASDIPNFKRSIAYYKIRHTLSVVIEKVKGCDLPPGILDKSIVTRKINNIPPSNTTHSRPLDLPPPQGEEEGDKCNISHSSNQTIRGEANESNYEGLLRILEVLNRYIDETPPLKGPRRFGNLACRDWHEKMNTKMNDLLKDNIKIHNSSFNLEFDGFIKELKYYIENSFGSAIRLDYGTGHELSFLAFIGGLIDFKLLSLEELTGSDILTIFAKYYDLTRRLILVYSLEPAGSHGVWGLDDHYHLIYIFGAAQFNGDQDKIIPPVQQILTRPVLDRYKETNLYVNAISFIHKIKLGPFNEHSPIIFDIHSSVSLWSKVLSGLLKMFEVEVLGKFPVVQHFWFGSSLYPWRDFETNKELPIYKRDEDEMDEDSLGDFLNGNTGIKTTKHNISMTGAPWNLNATQRQDDLNSTTYRGRQPRLGRN

SEQ ID NO: 13513 - protein, 93 aa, Brassica napus
  misc_feature (65)..(65): Xaa can be any naturally occurring amino acid
  misc_feature (74)..(74): Xaa can be any naturally occurring amino acid
  misc_feature (81)..(82): Xaa can be any naturally occurring amino acid
  misc_feature (86)..(86): Xaa can be any naturally occurring amino acid
  misc_feature (88)..(88): Xaa can be any naturally occurring amino acid
MASSMLSSAAVVTSPAQATMVAPFTGLKSSAAFPVTRKANNDITSIASNGGRVSCMKVWPPVGKXKKFETLSYXLPDLTEXXWRKXGXYLFPQ

SEQ ID NO: 13514 - protein, 239 aa, Haemophilus somnus
MAQVSMRDMLQAGVHFGHQTRYWNPKMKPFIFGPRNGVHIINLEKTVPMFNEALVELTRIASNNGRILFVGTKRAASEVVKAAALDCQQYYVNHRWLGGMLTNWKTVRQSIKRLKDLETQSQDGTFDKLTKKEALVRTREMEKLELSLGGIKDMGGLPDAIFVIGADHEHIAIKEANNLGIPVFAIVDTNSSPDGVDFVIPGNDDASRAIQLYLSAATTAVKEGRNQETVTEEVFAAAE

SEQ ID NO: 13515 - protein, 560 aa, Salicornia bigelovii
MLSQSSSLFYSKMDMLSTSDHASVVSMNLFVALLCGCIVIGHLLEENRWMNESITALLIGLCTGVVILLISGGKSSHLLVFSEDLFFIYLLPPIIFNAGFQVKKKQFFRNFITIIMFGAIGTLGSFSVVSLGAMTIFKKMDIGSLELGDYLAIGAIFAATDSVCTLQVLNQDETPLLYSLVFGEGVVNDATSVVLFNAIQNFDLTNIDHRIAIQFSGNFLYLFFASTMLGAMTGLLSAYVIKKLYFGRHSTDREVALMMLMAYLSYMLAELFYLSGILTVFFCGIVMSHYTWHNVTESSRVTTKHAFATLSFVAEIFLFLYVGMDALDIEKWRFVSDSPGTSVAVSSILLGLLMVGRAAFVFPLSLLINFSKKSHSEKITFNQQIVIWWAGLMRGAVSMALAYNQFTRSGHTQLRGNAIMITSTITIVLFSTMVFGLLTKPLILFLLPHSKHFNSASTVSDLGSPKSLSLPLLDGGQDSEADMDNQDEAVNNRYEGTHNRTIARPGSLRMLLNAPTHTVHYYWRKFDDSFMRPVFGGRGFVPYVPGSPIEQNTDNLLDRT

SEQ ID NO: 13516 - protein, 386 aa, Catharanthus roseus
FLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 13517 - protein, 550 aa, Porphyromonas gingivalis
MEKKMFCYQCQETAGNKGCILKGVCGKDFSTANLMDLLVFNLKGIAIIMTSMRRAGVKADYRKADKAIMESLFATITNANFDYSSIAKRVEKTFALKAELYSLAFTQGIELPENEAVTMQGKPEEYDRLALSVGILRETDEDVRSLKELTIYGLKGLAAYAEHADRLGYVDEEINAFTERALHDVTMGLLSAEELTALVLETGSFGVKVMALLDKANTETYGNPEITEVNIGVGSRPGILISGHDLKDMEMLLEQTEGTGIDVYTHGEMLPANYYPKFKKYNHFFGNYGNAWWKQREEFETFNGPILFTTNCIVPPKANASYKDRVFTTNATGYPGFKYIESDQHGRKDFSEIIALAKTCQPPTEIESGTIIGGFAHHQVLSIADKVVEAVSSGAIRKFVVMSGCDGRQSGRNYYTEFAEALPSDTVILTSGCAKFRYNKLQLGDIGGIPRVLDAGQCNDSYSLAVIALKLKEVMGLDDINKLPIVYNIAWYEQKAVIVLLALLSLGVKNIHVGPTLPAFLSPNVAKVLIENFGIAGIGTVEEDIRTLIA

SEQ ID NO: 13518 - protein, 846 aa, Glycine max
  misc_feature (630)..(630): Xaa can be any naturally occurring amino acid
  misc_feature (670)..(670): Xaa can be any naturally occurring amino acid
MALSMHKDSANNQMDSSKYVRYTPEQVEALERVYAECPKPSSLRRQQLIRECPILSNIEPKQIKVWFQNRRCREKQRKEASRLQTVNRKLTAMNKLLMEENDRLQKQVSHLVYENGYMKQQIHTASAGTTTDNSCESVVMSGQNQQQNPTPQHPARGLFVCFSLLAIAEETLAEFLSKATGTAVDWVQMIGMKPGPDSIGIVAVSRNCSGVAARACGLVSLEPTKVAEILKDRQSWYRDCRCVDVLSIVPTGNGGTIELLYMQTYAPTTLAAARDFWTLRYTTSLEDGSLVICERSLTSSTGGPTGPAASNFVRAEMLPSGYLIRSCEGGGSIIHIVDHVDLDVWSVPEVLRPLYESPKFLAQKLTTAALRHVRQIAQESSGEVQYGGGRQPAVLRTFSQRLCKGFNDAVNGFVDDGWSLMGNDGVEDVTIAINSSPNKFLGSNYNASMFPAFGGGVLCAKASMLLQNVPPALLVRFLREHRSEWADYGVDAYSAACLKASPYAVPCARPGGFPSTQVILPLAHTIEHEEFLEVVRIEGHAFSPEDVALARDMYLLQLCSGVDESAVGACAQLVFAPIDESFADDALLLPSGFRVIPLLPLPDGLASSRTWVLASTLGAGSGNARSAGHXDSNNYNLRSVLTIAFQFTFENHLRDNVAVMARQYVRNVVXSVQRVAMAIAPSRISTQLGPKSLPGPPEALTLARWICKSYSLHTCTELFSVESTSGDAILKQLWHHPDAILCCSVKTNASPVFTFANQAGLDMLETTLVALQDIMLDKVLDEAGRKFLCIEFSKIMQQGFAYLPAGICVSSMNRPVSYEQAIAWKVLDDDDSNHCLAFVFMNWSFV

SEQ ID NO: 13519 - protein, 382 aa, Catharanthus roseus
SEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 13520 - protein, 321 aa, Unknown
  uncultured proteobacterium
MTVCILGAGAFGTALAVALSDRHDVRLWGRDGAALREMAQSRKSPRLPDVTLVENITVTCDAKMALQGADFILSAIPLQATHAALSELVPLFAGQPLIGCSKGVDLTTGLGGYSVLRSVYVAGPSGLLTGPSFAADIAGGLPTALTLAAAAQEDAGAWQAALSTETLRLYTSSDPIGAELGGALKNVIAIACGATIGVGLGQSARAALITRGQAEIMRYAVKLGAQPETLAGLSGFGDLCLTCTSEKSRNYQFGLALGRGQVFDNAVTVEGRATALALLPIVERLDIDMPITKAVAGLCSGTITVSQALAVLMARPLRKEI

SEQ ID NO: 13521 - protein, 231 aa, Triticum aestivum
  misc_feature (10)..(10): Xaa can be any naturally occurring amino acid
  misc_feature (32)..(32): Xaa can be any naturally occurring amino acid
  misc_feature (50)..(50): Xaa can be any naturally occurring amino acid
MVSPDAIRTXIGVIGNGTALVLFLSPVPTFIXIWKKKTVEQYSAVPVPGXTLLNCMMWVLYGAPAGAPAKKWLVITIKRAPGNAHRSSPKIALFLTFSVAHTHDRRSMVVGILCVLFGTGMYAAPLSVMKMVIQTKSVEYMPLFLSVASLVNGICWTAYALIKFDLYITIPNGLGVMFAVGQIILYAIYYKSTQQILEARKRKADQVPMTEVVVDGKSGSATNSGAANGHY

SEQ ID NO: 13522 - protein, 380 aa, Photobacterium profundum
MSKRDFYEVLGVGRDAGERDIKKAYKRLAMKFHPDRNQEADATEKFKEVKTAYEILTDPQKKAAYDQYGHAAFEQGSGGGGYGGGGGADFGDIFGDVFGDIFGGAGGGRRQQQRAQRGSDLRYNMELTLEEAVRGCSKEIRVPTLVGCDSCDGSGAKRGSSATTCGTCHGQGQVQMRQGFFAVQQACPHCHGRGKIIKDPCNSCHGQGRVEKTKTLSVKIPAGVDTGDRIRLSGEGEAGEFGAPAGDLYVQVHVAEHSIFERDGNNLYCEVPVSFTMAAVGGEVEVPTLNGRVNLKVPSETQTGRMFRMRGKGVKSVRGGAVGDLICKLVVETPVNLSSHQKELLKELEESFGGKAAGKHKPKSEGFFNGVKKFFDDLTG

SEQ ID NO: 13523 - protein, 467 aa, Unknown
  Shewanella sp. MR-7
MSSLEQSTSVPPNHSPANAGLEKKKMLILVADILLLFALYYGLPFDQGVNTGLAILVFAAILWLSEAIHISITAILVPILAVFFGVFETKEAMSNFANPIIYLFFGGFVLAAALHHQKIDTLIAQKLLLASKGKLSIACLMLFGVTALLSMWISNTATTAMMLPLALGILQQLDRKMYHSTYVFLLLGIAYSANIGGIGTLVGSPPNAIAAAQVGLSFSDWLKFGIPTVILMLPMMLLALYWYFKPDLSAQCKLDVEEQKLTFQGKLTLVIFLATVCCWIFSVPLAKALGGITQFDTIVALGTVVLLAGLGLVGWKKIESTTDWGVLILFGGGLTLSAVLKSTGTSVFLAHWMTDIFGSTHMSLFVFAVIAFVVMLTEFASNTASAALLVPVFAAIAEALGVSPVMLSVLIGIAASCAFMLPVATPPNAIVYGSGYIKQSEMVRVGMIVNFLSMIVLGIIAHTFWEV

SEQ ID NO: 13524 - protein, 333 aa, Prochlorococcus marinus
MIKYKSILITGGNSGIGFFAIINLLKTKNILYVVIKNEFRKNEFLKKIEKYFDKNYLIKFLNIIENCDLSDLENINKIKEYFISKKIFLDTVVLNAGLQYTGSFYPKVSKQGIELTFAVNHLAHFYLVSVLKDFIRDKEESRIIITSSDVHDPKSSGGNIGKKAGLNNLVDFRKKVTGQFLNFNADEAYKNSKLCNILFAKELEKKLKMSSSKISVITWAPGLVIPTDDSGFFRYSKRFNLFGYLIFSKVAKNILGISESIENAGKILSEIVVDSNLNNVGYVHLSNKLLSFKKHKLVESKVSDEANNSELASKLWILSEEICRSFGFVTFNI

SEQ ID NO: 13525 - protein, 554 aa, Unknown
  Shewanella sp. MR-7
MFCIQCEQTIRTPAGNGCSYAQGMCGKLAATSDLQDLLIYMLQGVSVYATKARELGVINPEVDTFVPKAFFSTLTNVNFDDERIIAYAKQAAEYRESLKNAYEAACETAGKRAESLPPVAQFVLGTSKPEMLSQAPVALLNKDKNEIHEDILGLRLLCLYGLKGAAAYMEHARVLGKTDAEIAGRFHEIMAFLGEPSVDADKLFTTAMDIGQLNYRIMAMLDAGETEAFGHPEPTVVNTKPVKGKAILVSGHDMKDLELILEQTAGKGINVYTHGEMLPALAYPAFKKYAHLVGNYGSAWQNQQKEFANFPGAVVMTSNCIIDPNVGQYSDRIFTRSIVGWPGVTHVIGDDFSVVIDKALSLDGFQYDEIPHNITIGFARNALMAAAPTVVENVKNGSIKHFFLVGGCDGDKSERSYFTDLAKSAPKDSVILTLGCGKYKFNKLEFGDINGIPRLLDIGQCNDAYSAIQLAIALSQIFECDINELPLNLVLSWFEQKAIVVLLTLLSLGVKNIRTGPTPPAFLTANLAKILEEKFGLRNTTTVEADLKTMLNVA

SEQ ID NO: 13526 - protein, 174 aa, Populus trichocarpa
MAKMSEPLVVGRVIGDVIDHFTANVKMTVTYQSNRKQVFNGHELFPSAVTHKPKVEVHGGDMRSFFTLVMTDPDVPGPSDPYLREHLHWIVTDIPGTTDATFGREVMNYEMPRPNIGIHRFVFLLFKQKGRQTVTTPASRDKFNTRKFAEENELGLPVAAVFFNAQRETAARKR

SEQ ID NO: 13527 - protein, 89 aa, Methanococcoides burtonii
MSNVVIMDFTATWCGPCQIQKPILEQLEGELGDKVEFKMVDVDQNNALAGKYGVSAVPTLIIEKDGEVVKRYTGVTSADVLRAELNTLI

SEQ ID NO: 13528 - protein, 722 aa, Prochlorococcus marinus
MQGQTTSVSFDGREIRLTTGRYAPQAGGSVLIECGDTAVLVTATQGQGREGADFLPLSCDYEERLYAAGRIPGSFMRREGRPPERATLISRLIDRPLRPLFPNWMRDDIQVVATCLSLDERVPADILAVTGSSMATLLAGIPFYGPMAAVRVGLLGDDFVLNPSFREIERGDLDLVVAGTPDGVVMVEAGSNQLTEQDVIEAIDFGYEAVNELIKAQESILKDSGLTQIKPEKPDLDETVPSYLEKNCTKPISALLKEFDLSKEDRDLKLDEIKTNCAEKIDSLKDDNAVKKSITTNTKLLGISFKALTKKLMREQIIKDGKRVDGRALDEVREISAEAGILPKRVHGSGLFQRGLTQVLSTATLGTPSDAQEMDDLNPSPDKTYIHHYNFPPYSVGETRPMRTPGRREVGHGALAERAIIPVLPPKESFPYVLRVVSEVLSSNGSTSMGSVCGSTIALLDAGVPLKAPVSGAAMGLIKEGEEVRILTDIQGIEDFLGDMDFKVAGTEKGITALQMDMKMTGLPIKIIGEAINQAKPARTHILEKMVQAIDKPRETLSPHAPRLLSFRIDPELIGTVIGPGGRTIKGITERTNTKIDIEDGGIVTIASHDGVAAEEAQKIIEGLTRKVHEGEVFTGSITRIIPIGAFVEILPGKEGMIHISQLSEARVEKVEDVVKVGDEVTVRVREIDNRGRINLTLRGIPQNGDMQYYPQPTPTPVAPLM

SEQ ID NO: 13529 - protein, 471 aa, Burkholderia thailandensis
MGKQAIGVVGLAVMGRNLALNIESRGYAVSVYNRSREKTDELIAEFPDRKLVPAYTLEEFVASLETPRRILLMVKAGEATDATITALKPLLDKGDVLIDGGNTHFTDTIRRNQELAQAGLHFIGTGVSGGEEGALRGPSIMPGGQRDAYDLVEPILKQIAAKAPADGEPCVAYMGPDGAGHYVKMVHNGIEYGDMQLIAESYAVLKQVAGLTNDELGAVYAEWNQGELDSYLIEITAKIFGKKDDETGEHLVDVILDRAAQKGTGKWTSQNALDLGVPLPLITESVFARVLSSLKDQRVAASKVLAGPAPAPLEGDRAAFVESVRRALYLSKVISYAQGFAQLDTASKEYGWKLDLGAIAKIFRAGCIIRARFLQKITDAYAKNAALANLLLDPYFQDIAANYQSALRDVVIAAVKAGVPVPAFASAVAYFDSYRSARLPANLVQAQRDFFGAHTFERTDKPGSFHASWAE

SEQ ID NO: 13530 - protein, 74 aa, Unknown
  Euonymus sp. Qiu 94190
MKEQKWIHEGLITESLPNGMFRVRLDNEDFILGYISGRIRRSFIRILPGDRVKIEVSRYDSTRGRIIYRLRNKD

SEQ ID NO: 13531 - protein, 103 aa, Unknown
  Synechococcus sp. CC9605
MNALNEPMASYQITITTSEGSSSFACADDQYILDAAEEAGADLPYSCRAGACSTCAGKLSSGSLDQSDQSFLDDEQIAKGFALLCVAYPTSDCQIKGEAEEEL

SEQ ID NO: 13532 - protein, 221 aa, Psychrobacter arcticus
MTVNSTAPSQDQIPASSSGHNLHGRPERIATVERITAETQVTCTVNLDGTGQGTVDTGVPFLDHMIDQIKRHGLFDLDIKCTGDTFIDDHHSVEDTGITLGQAFNKALGDKKGIRRYGHFYAPLDESLTRAVVDLSGRPGLHMEIPFTRSHVGTFDVDLFSEFFYGFVNHSWMTVHLDNLKGKNSHHQIESTFKAFARALRMACEYDERALNTLPSTKEAF

SEQ ID NO: 13533 - protein, 339 aa, Clostridium thermocellum
MNKKISIIGAGSWGTALAVLLANNGMSVTMWSIFEDEIKMLNEKREHVHKLPGVIVPENVTFTSDLEKAVCDAEVVVVVVPSQTVRQTAKDISKYIRDDTVIVSCSKGLEEGTGLRMSEVIGQEIKDAKTVILSGPSHAEEVGRGVPTAIVAASCDIKAAELIQDIFMSPEFRVYTNTDVVGVELGGALKNVIALCAGISDGLGFGDNTKAALMTRGITEISRLGVSMGANPQTFAGLTGIGDLIVTCTSMHSRNRRAGILIGQGKSPQEAMDEVKMVVEGVTTTKAAYELARKMDVAMPITFEAYEVLFNGKNPRQAVYDLMMRNKKNEVEELDAKWL

SEQ ID NO: 13534 - protein, 556 aa, Campylobacter coli
MSEVNKKVQNNLEDYLEDEDFGQLLEAFDKSREETITEGVIVEIKNDEVYVDIGRKSEGILALNEIQDENANLLFKVGDSIKVAVVGSRGGRSLLSHKKALRKEKVIDFIQNYKEDDEYIFEVKVVGKNKGGLVVVNDDDVEFFLPKSQYGFKENNNLIGKTFKVKIIKVDKEEQSIIVSRKKTLDDERKKRKELINNIAQQEGLIEGVVKKITTYGMFVDVGGVDGLVHYSEISYKGPVNPSILYKEGDKVPVKVVKYDKDRKHLSLSIKAALPDPWGEIKDSLEVGDTIKVIVSNIEPYGAFVDLGNDIEGFLHISEISWDKNIKNPKDYISKGQEIDVEVIEINSDERRLRVSLRNLLSKPFDEFMKNHKIGDVIEGEVTSTTSFGAFVKIGSVEGLLHNEDASWDRNEKCKDKFNNGDIIKVKIIKIDEEGQKISLSIKELSESPVQEYAKNHKVGDIVKGKIRDIKDFGVFVELNKNVDALIHKEDISASTLENLKIGDEIEAAIAFIDEKKNRIRLSVKNLVRIKEREVLNEINSDDKVTLGDIIKDQLA

SEQ ID NO: 13535 - protein, 252 aa, Unknown
  Vibrio sp. Ex25
MTTANSSLNSGFVSLVGAGPGDPDLLTVKGLKAIQAAEVVVYDRLVSKDILELAHASAEMIYVGKKLDFHCVPQDQINQILVQKAQEGKRVVRLKGGDSFIFGRGGEELEELAEYGIKYEVVPGITAAAGATAYAGIPLTHRDHAQSVQFITGHVQKDGREIEWHSLAQSNNTLVFYMGLKQSGHIMDNLITHGLDPEMSCAIIENGTRPEQRVFQGKLNELSEMAEKAISPALIVVGCVTQLHNKLDWFRK

SEQ ID NO: 13536 - protein, 424 aa, Burkholderia thailandensis
MASQHDSGAAGHAPAIPARAWSVLFASTFAFLVCFVVWMMFGVLGVQLREDLHLNATEFGMLTSTPVLTGALMRLPLGAWTDRFGGRIVMTVLLAVCAVPVYVVSYATALWQFLLIGLFLGCVGASFAVGTPYVARFFPPQRRGLAMGVFGAGTAGAAVNLFVTPLLLAAYGWRVVPRVYAVALLVTAAIFWFASAPDPGAGEQKGSWVDSFKVLRDPRVWKLCQYYSITFGGFTALSLWIPQYLKNDYGMSLVAASALAAGFSLPGSVLRALGGALADRYGAHAVTWWGLWVAWVCLFLLSYPPTDLVIHTIDGTATLRLHVPLAAFVVLTFVLGAVFAFGMASTFKYVADDFPHNMGVVTGIVGLAGGLGGFLLPIIFGALVDLFRVRSTCFMFLYGIVWVSLIVLYLSEIRRVPVTGTSPR

SEQ ID NO: 13537 - protein, 335 aa, Mycobacterium bovis
MTAPPVHDRAHHPVRDVIVIGSGPAGYTAALYAARAQLAPLVFEGTSFGGALMTTTGVENYPGFRNGITGPELMDEMREQALRFGADLRMEDVESVSLHGPLKSVVTADGQTHRARAVILAMGAAARYLQVPGEQELLGRGVSSCATCDGFFFRDQDIAVIGGGDSAMEEATFLTRFARSVTLVHRRDEFRASKIMLDRARNNDKIRFLTNHTVVAVDGDTTVTGLRVRDTNTGAETTLPVTGVFVAIGHEPRSGLVREAIDVDPDGYVLVQGRTTSTSLPGVFAAGDLVDRTYRQAVTAAGSGCAAAIDAERWLAEHAATGEADSTDALIGAQR

SEQ ID NO: 13538 - protein, 682 aa, Brassica rapa
IPSPRHQNKTVSVPTEKIVVRETKNDVVEHSYDSSDDEDESHNRNVSYYKEMIRKSNSDVEPSILDSRDESTADNWIHRNSSMVRLTGKHPFNVEPPLPRLMHHGFITPVPLHYVRNHGTVPKADWSDWTVEITGLVKRPAKFTMEQLISEFPSREFPVTLVCAGNRRKEQNMVKQTIGFNWGSAGVSTSLWKGVPLSEILRRCGIYSRRGGALNVCFEGAEDLPGGGGSMYGTSIKKEMAMDPARDIILAYMQNSELLTPDHGFPVRIIVPGFIGGRMVKWLKRIIVTPQESDSCYHYKDNRVLPSLVDAELANAEAWWYKPEYIINELNINSVITTPGHQEILPINAFTTQKPYTLKGYAYSGGGKKVTRVEVTLDGGETWSVCELDHQEKPNKYGKFWCWCFWSLDVEVLDLLSAKEVAVRAWDESLNTQPEKLIWNVMGMTNNCWFRIKTNVCKPHRGEIGIVFEHPTRPGNQSGGWMAKERQIEKSSESHPTLKKSVSTPFMNTASKMYSMSEVRKHNSAESAWIIVHGHIYDCTRFLKDHPGGSDSILINAGTDCTEEFEAIHSDKAKKLLEDYRIGELITTGYDSSPNVSVHGGSSVMSLLAPIRELAPAKNIALVNPREKVPVKLIEKTSISHDVRRFRFALPSEDQQLGLPVGKHIFLCATINDKLCLRAYTP

SEQ ID NO: 13539 - protein, 179 aa, Chlorella pyrenoidosa
AGLSADPQTFARYREIEVIHARWAMLGALGCITPELLAKNGIPFGEAVWFKAGAQIFQDGGLNYLGNESLVHAQSILATLAVQVLLMGAAESYRANGGAPGGFGEDLDSLYPGGAFDPLGLADDPDTLAELKVKEIKNGRLAMFSMFGFFVQAIVTGQGPIANLDAHLSDPTGNNAWNY

SEQ ID NO: 13540 - protein, 108 aa, Triticum aestivum
  misc_feature (8)..(8): Xaa can be any naturally occurring amino acid
  misc_feature (12)..(12): Xaa can be any naturally occurring amino acid
  misc_feature (15)..(15): Xaa can be any naturally occurring amino acid
  misc_feature (22)..(22): Xaa can be any naturally occurring amino acid
  misc_feature (32)..(32): Xaa can be any naturally occurring amino acid
  misc_feature (35)..(35): Xaa can be any naturally occurring amino acid
  misc_feature (44)..(44): Xaa can be any naturally occurring amino acid
  misc_feature (53)..(53): Xaa can be any naturally occurring amino acid
  misc_feature (58)..(58): Xaa can be any naturally occurring amino acid
  misc_feature (60)..(60): Xaa can be any naturally occurring amino acid
  misc_feature (63)..(63): Xaa can be any naturally occurring amino acid
  misc_feature (65)..(65): Xaa can be any naturally occurring amino acid
  misc_feature (70)..(70): Xaa can be any naturally occurring amino acid
  misc_feature (78)..(78): Xaa can be any naturally occurring amino acid
  misc_feature (81)..(82): Xaa can be any naturally occurring amino acid
  misc_feature (86)..(87): Xaa can be any naturally occurring amino acid
  misc_feature (93)..(93): Xaa can be any naturally occurring amino acid
MGRRPARXYREXKNXPYPKSRXCRGVPDPKIXIYXDVCMKKKGXVDEFSHCVXLVSMXEXENXSXEGSFXDAPLLLCXKYXXQSHXXKRDAFXPQRRGTRFPCGSVQD

SEQ ID NO: 13541 - protein, 552 aa, Unknown
  Erythrobacter sp. NAP1
MSDTKKASDVFIDCLEAEGCEYIFGVPGEENLDFLDSLGRSKKIKLILTRHEQGAGFMAATYGRHTGKTGVCVATLGPGATNFVTSAAYAQLGGMPVLMITGQKPIKKSKQGRFQIVDIVSLMEPVTKYSIQIAAGDNIPSRVREAYRLAEEEKPGATLIELPEDIAEEQATDFKPLPKSVARRPSAEPKAVRAAVKAIENAKNPVLVIGAGANRKLCGRMLEQFVEKTGIPFLTTQMGKGVIDERHPKFLGCAALSAGDFVHRAVEASDCIINVGHDVIEKPPFFMKDNGVTVIHVSTKTAEVDPVYFPQIEVIGDIANAVWQIKEDISPNRDWDFEQMLGYHKAELEHTGKLAADDRFPIFPPHLVQQVRDAMPRDGIICLDNGVYKIWFARGYTAYLPNTVLLDNALATMGAGLPSAMMSAMLYPDRKVMAICGDGGFMMNSQEMETAVRLGLNLTVLILRDDAYGMIRWKQANMGFDDFGLTYGNPDFVQYAESYGAKGHRVESSAHLAELLKHCNETPGLHLIDCPVDYSENDQILNIDIKKLSAEL

SEQ ID NO: 13542 - protein, 1017 aa, Porphyromonas gingivalis
MFGENKEDGHATFMPYATTALLQADERYQKPWLTPSQAEFLSLNGLWYFRYFPDARTARTDFVEDLFDVSAWDTITVPSCWQMKGWDTPLYINVNHIFEDNPPFIRIQKTYTSAVDPNPTGSYRRDFILPTGWEKKRVYLHFDGLYSGAYVWINGRYIGYTQGGNNDAEFDISAAVRAGQNNVSIQVVRWTDASYLEGQDMFHMSGLHRDVYLYATPRTSIRDHYITSKLHPESDYTTGEISVAVEMDNRDGSAARKTVGIRLLDPQGKVLWEERKQTRLSVGEQKQSLHFRKADLRNLSLWTAETPTLYTLIITQWDDKEREELAFATKYGFRQPEIRDQSVYLNGRKVLFKGVNTQDTHPLHGRSIDLPTMVKDITMMKQANVNTLRTSHYPRQPKMYALCDYYGLYVMDEADLECHKNWDDHGEKGGITNAESWRAQYVDRTVRMVCRDRNHPSVLFWSLGNESGGGENFRHTYAAVRALDSRIIHYEGATRGGTEYTDLHSVMYPSLAQVQAGSNGRETDGKPYFMCEYAHAMGNGVGNLQDYWDIMEQSSAGIGGCIWDWVDQAIYDPSEIKRGLYRLHTGYDYPGPHQGNFVNNGLVTADRSWTPKLYEVKKVYQYVKFDAYDSKSKLLTLHNAYSFTDLNRFGLRFKLLSDGCVIESGEVDLPKLPAGEKATLRIPVADIPMYSTRDFHIDFELFLREATTWSDKGYTVASEQFTLAQREGFASLLPERMPTLQVTTEGNHLHIANDRVQLVFDLHTAELICWNYGSHPVIIPRGGPVYDNFRWVENDSPYGSIPPGAPAGPVQPAVPSYEVNADSTRVILAASHRALCPYRLNYYIYGDGTVDIRADFTPEEEHADKLRRLGIKMCLPLQMDRIEYLARGPHENYVDRRQSAFFGLYSDRVSRMVEPYVRPQSTGNRTGLRALTLTDDSGRGIRVEASGQVDFSILPYEDEHLARTRHQWELPMPAHHILRFDYMQRGLGNGSCGPGTAPTYLCPSSGTYSFELRFRPL

SEQ ID NO: 13543 - protein, 306 aa, Methanosarcina mazei
MVINMKVACIQMDVLQCKKQENLEKALSMALKAVDKGAELVVFPEVFSTGFCYENIDHAAETLPSPLLENLACFSEANDCIILGSIILKDGNESGEEKYFREGDACFSGNENEMPVNKNSTEYKNFTENKNSAENKNSPYYNLGFCFESGALAGTYRKTHPFKAENKYFSKGSSIEPISLKKQDLKIGFEICYELRFPEVARKLALAGSDLLVTTAAFPNPRSEHWKVLAKARAIENQIPHIACNRTGSAPDCSYFGHSMIIDAWGEVKADAGSKECVIVHDLDMSQKDEVRKLIPVFEDRRVELY

SEQ ID NO: 13544 - protein, 256 aa, Yarrowia lipolytica
MGKAEFGTPKYIANRMKSRGLQKLKWFCQVCEKQCRDENGYKCHVQSESHQRQMLLLGENARKHIGQYSRDFQTDFLSQLRMSHGEKRVNANRFYNEYIQNKEHVHMNATQWASLSAFVKHLADKKICHVEETDKEGLTIAYIDNSAASLERKQMAAKKSGAEDTETMERKRIEAEVKKAKENGVVEEVKEAVLTKTDAPIQLSLGLKKAETQPEKPKVKKNPFGAAKSKVSKPKPEKAEKDDVFKKLMLQDMKRR

SEQ ID NO: 13545 - protein, 302 aa, Unknown
  Synechococcus sp. CC9605
MGWSAADIPNQQGRIALITGANSGLGLETARALKRCGATVVLACRSPRKAELAKQELLQERDGGAVDLVDLDLADMTSVERAAATVGERYGCLDLLINNAGVMAPPRRTTAQGHELQFGVNHLGHMALTQALLPLMQNRPDPRVVTVTSGAQYFGKIRWDDPSWSKGYDRYGAYGQSKLANVMFALELDARLHKKGSPIRSLAAHPGIARTELQPTAIANVGNRFEALAYRLMDPLFQSAGMGALPQLHAATAATAQGGEHYGPEQFGGLRGAPALCRVAPAASQPAERQRLWSLSEELLSA

SEQ ID NO: 13546 - protein, 290 aa, Brassica napus
  misc_feature (194)..(194): Xaa can be any naturally occurring amino acid
MMFNEMGMLGGNMDLYSSSSLGELDFCPAPQLEPDSIVEDDYTDDEIDVDELERRMWRDKMRLKRLKEQDKSSKQGVDYDSAKQRQSQEQARRKKMSRAQDGILKYMLKMMEVCKAQGFVYGIIPENGKPVTGASDNLREWWKDKVRFDRNGPAAIGKYQADNNVPGACENNGLIGPTPHTLQELQDTTLGSLXLSALMQHCDPPQRRFPLEKGVPPPWWPSGKEDWWCQLGLGKDQGPAPYKKPHDLKKAWKVGVLTAVIKHMFPDVGKIRTSVSGFIYVLCLVLLFWL

SEQ ID NO: 13547 - protein, 307 aa, Staphylococcus aureus
MNAAVRAVVRTAIYNEIEVYGVYHGYQGLLNDDIHKLELGSVGDTIQRGGTFLYSARCPEFKEQEVRKVAIENLRKRGIEGLVVIGGDGSYRGAQRISEECKEIQTIGIPGTIDNDINGTDFTIGFDTALNTIIGLVDKIRDTASSHARTFIIEAMGRDCGDLALWAGLSVGAETIVVPEVKTDIKEIADKIEQGIKRGKKHSIVLVAEGCMTAQDCQKELSQYINVDNRVSVLGHVQRGGSPTGADRVLASRLGGYAVDLLMQGETAKGVGIKNNKIVATSFDEIFDGKDHKFDYSLYELANKLSI

SEQ ID NO: 13548 - protein, 333 aa, Triticum aestivum
MKVSRGAVACAALMLLSTAAALRSEPSRLSTSGAPKLRASAEAAQANATFCSKEEVFAWAKKDHRRLLHVVYRVGDIHKTIKFYTECLGMKLLRKRDIPEEKYTNAFLGYGREDAHFVVELTYNYGVDKYDIGAGFGHFGIATDDVAKTVELIRAKGGKVTREPGPVKGGKTVIAFIEDPDGYKFEILERPGTPEPLCQVMLRVGDLDRAISFYEKACGMKLLRKRDNPEYKYTVAMMGYGPEDQNAVLELTYNYGVTEYDKGNAYAQIAIGTDDVYKTAEVVKLSGGQVVREAGPLPGLGTKITSVLDPDGWKTVFVDNIDFAKELGGHAHH

SEQ ID NO: 13549 - protein, 488 aa, Unknown
  Marinobacter sp. ELB17
MTQLVWFRNDLRAADNPALAAACQSAAQSSGEPVEACFIVTTEQWLSHDWSAAKVHLMLDHADALAQELAKLGIALSFLRAADFEQSLSTLEAFCRDHKISQVHFNEEYGVNERRRDKALKPRFDTLGVKVSKYRDQAAVPVGEVLTQQSEPYSVFTPFSRRWRSWQEEQQPALLAVPKKVGEALAGADVKNSSSVILKKEVDALFGEAPPALVATGENAAHDALQDFLQERAGDYKNDRDFPAIEGTSKLSPYLAIGALSGRQCVQAAWQLKQSMGSSFGKAANDEEGFFTWETELAWRDFYIHILYHCPRVSMHRAFKPETEALQWNTADEHFEAWKNGRTGIPMVDAAMRQLNETSWMHNRLRMVAAMFLTKNLFIDWRRGEAYFMSKLADGYLASNNGGWQWSASTGTDASPYFRVFNPMTQGERFDADGEFIRHWVPELAKLDSKRIHNPGKGGVIPGGYPRPIVDLKESRKEAIARFQALRD

SEQ ID NO: 13550 - protein, 704 aa, Alkaliphilus metalliredigenes
MIKQFQTELAGKTLHVEIGKYAEQASGSCMVRYGDTTVLVNATASKSPREGIDFFPLSVDYEEKLYAVGKIPGGFIKREARPSEKAVLTSRLIDRPIRPLFPKGYRNEVQVIATVMSVDKDYAPDIVAMIGSSIALSISDIPFGGPTGSVNVGLVNGEFVLNPTSDQRAISDIDLVVSGTKDAIMMIESGANEVTEDQMLDALMFAHEEIKTIVAFIEEIVAEVGKPKQEVQLFAIDETLDMEVRVFAKDKIVTAMKTFDKMERNERLDNVKKEILVHFSKQYENELKSIVEVINSIIKEQFRYMITHDKVRPDERALDEIRPITSEVGILPRTHGTGLFTRGQTQVLTVATLGALGEVQILDGLGEEESKRYMHHYNFPPYSVGEAKFLRGPGRREIGHGALAERALLPMVPSQDDFPYAIRLVSEVLSSNGSSSQASVCGSTLALLDAGVPIKDMVAGIAMGLVKENDKIAILSDIQGMEDALGDMDFKVAGTDKGITAIQMDIKIKGIHKDILKDALEQARVGRLHILDKMKKAIDKPRPELSPFAPRVLKMKIHPDKIRDVIGSGGKTINRIIDETGVKIDIDNDGTIFIAAESQEAVEKAIIIIENIIKDPEVGQNYTGKVIKIMNFGAFLEILPGKEGLLHVSNIAHERVNKVEDVLEVGQEIEVKVMEIDQQGKINLSRKALLPKESKAENTKEEKA

SEQ ID NO: 13551 - protein, 199 aa, Arabidopsis thaliana
MEQSEEGQQQQQQGVMDYVPPHAYQSGPVNAASHMAFQQAHHFHHHHQQQQQQQLQMFWANQMQEIEHTTDFKNHTLPLARIKKIMKADEDVRMISAEAPVIFAKACEMFILELTLRAWIHTEENKRRTLQKNDIAAAISRTDVFDFLVDIIPRDELKEEGLGVTKGTIPSVVGSPPYYYLQQQGMMQHWPQEQHPDES

SEQ ID NO: 13552 - protein, 379 aa, Streptococcus agalactiae
MNNTEFYDRLGVSKDASQDEIKKAYRRMSKKYHPDINKETGAEEKYKEVQEAYETLSDTQKRAAYDQYGAAGANGGFGGFDGGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLKISFVQAALGDTIDIPTVHGAVEMSIPAGTQTGKTFRLRGKGAPKLRGGGQGDQHVTVNIVTPTKLNDAQKEALHAFAEASGDKMVHPKKKGFFDKVKDALDVD

SEQ ID NO: 13553 - protein, 301 aa, Zea mays
  misc_feature (111)..(111): Xaa can be any naturally occurring amino acid
MAAAAGRKVAVAAVQFACTDVEAENVATAERLIREAHKKGAKIVLVQELFEGHYFCQAQRLDFFRRAKPYKGNPTIIRMQQLAKELEVVIPVSFFEEANNAHYNSVAIIDXADGADLGLYRKSHIPDGPGYQEKFYFNPGDTGFKAFKTKYATIGVGICWDQWFPECAIAMALLGAEILFYPTAIGSEPQDCNLDSREHWKRVMQGHAGANLVPLVASNRIGRETVDTEHGKSSITFYGNSFIAGPTGEIVKLANDKDEEVLVAEFDLDEIKSIRHGWGIFRDRRPELYKVLLTLDGEKQS

SEQ ID NO: 13554 - protein, 228 aa, Brassica napus
RHLAEFWMVEPELAFADLEDDMNCAEAYVKYMCKWLLEKRYDDMELMAKNCDKGCIDRLKLVASTPFGRLTYTEAIKILEEAVAKGKKFDNDVEWGIDLASEHERYLTEVVFQKPLIVYNYPKGIKAFYMRLNDDGKTVAAMDVLVPKVGELIGGSQREERIDVIMERLEEIGLPVEPYEWYLDLRRYGTAKHSGFGLGFERMVLFATGMDNIRDVIPFPRYPGRADL

SEQ ID NO: 13555 - protein, 239 aa, Triticum aestivum
MAAPPSSVSVRAGASVSAKLTPRQAARAGFGGRVSVSSGRKCGGPVRASLFSPKPAVAMDARPTKVQELHVYELNERDRESPAYLRLSAKQSQNALGDLVPFTNKVYNGSLDKRIGITAGICILIQHVPERNGDRYEAIYSIYFGDYGHIAVQGPYLTYEESYLAVTGGSGVFEGAYGQVKLNQIVFPFKIFYTFYLKGIPDLPKELLCAAPVPPSPTVEPTPAAKATEPHACLSNFTD

SEQ ID NO: 13556 - protein, 961 aa, Magnetospirillum magnetotacticum
MLIKKRDGEARKSALSQTLASVSGGSMDRRAFLRRSGLTAGGAALLGGIGAGTVRKAEAVPAASDPKAEVKKAICTHCSVGCTVNAEVSNGVWIGQEPAFDSPINLGSHCAKGAAVREHAHGDRRLKYPMKLEGGKYKRISWEQAITEVGDRLLKIRETAGPDSVYWLGSAKFSNEQAYLMRKFAALWGTNNIDHQARICHSTTVAGVAQTWGYGAMTNSYNDIHNSKAMFFIGSNAAEAHPVAMLHILKAKEQNKAPLIVCDPRFTRTAAHADEYVRLRPGTDVPLIWGIMWHIFENGWEDKEFIRKRVWGMDQVRAEVAKWTPEETERVTGVPGAQLKRVAQILATHKPGTVVWCMGGTQHTVGNANVRAYCNLQLALGNVGVAGGGTNIFRGHDNVQGATDMGLDVTTLPAYYGLAAPAWKHWARVWGLDYDYIKGRFKTPELMEAPGIPVSRWYDGVNEAKENIAQPEPIKAMVYWGHAPNSQTRQPELKKAMEKLDTLVIIDPYPTVSAVLHDRTDGVYLLPAATQFEVDGSRTASNRSIQWSEQVIKPMFECKADQEIMYLFAKKFGFAAELCKNIKVEGDKPQAEDILREINRGAWTIAYTGQSPERLKAHMANQQTFDKTTLKAVGGPCDGDYYGLPWPCWGNAEMKHPGTPNLYDPSKPVKDGGLNFRALFPEYKGESLLATDSWPEGSELPAGHPGFTYGMLKKLGWDKDLTADELAVIQKIGGEKADDVAWTIDLSGGIQRVAVMHGAAPFGNGKARAVVWNFPDPVPLHREPLYTPRRDLVEKYPTHADKKMMRLPFLYKTIQDKDVSKEFPIILTSGRLVEYEGGGDETRSNPWLAELQPDMFVEVNPFDANNAGVRAGDYVWVFGPEGGKVKVKARITERVGRGVAFMPFHFGGWFQGKDLRSKYPEGASPIVLGESTNTAQTYGYDSVTGMQETKVTLCRIEKFQA

SEQ ID NO: 13557 - protein, 308 aa, Synechococcus elongatus
MQEAKVAAILGAGAWGTTLAQLLRSNGLEVRQWSRRSETSLAATLAEADLWIMAVSMAGLASVADQVAALQLGDRAIWVSATKGLADLGWRTPSQVLSDRFPLQPITVLSGPNLSKEISQGLPAATVIASRDRHAAAVVQQAFASDRFRVYTNRDPLGTELGGALKNVIAIAVGVCDGLCLGANARSALVTRALAEILRVGAYFGARTETFFGLSGLGDLLATCTSPLSRNYQVGFRLAQGESLAAALTAIAATAEGVSTARVLAQLASREGLELPIAACVAELLDNRISPTTAIERLMARDLKAELV

SEQ ID NO: 13558 - protein, 518 aa, Nicotiana tomentosiformis
MVFPVEAIVGLVTFTFLFYFLWTKKSQKPSKPLPPKIPGGWPVIGHLFYFDDDGDDRPLARKLGDLADKYGPVFTFRLGLPLVLVVSSYEAIKDCFSTNDAIFSNRPAFLYGEYLGYNNAMLFLANYGSYWRKNRKLIIQEVLSASRLEKFKHVRFARIQTSIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHIKKREKIMEVGTEGNEQDFIDVVLSKMSNEYLGEGYSRDTVIKATVFSLVLDAADTVALHINWGMALLINNQNALKKAQEEIDTKVGKDRWVEESDIKDLVYLQAIVKEVLRLYPPGPLLVPHENVEDCVVSGYHIPKGTRLFANVMKLQRDPKLWSNPDKFNPERFIARDIDFHGQHYEYIPFGSGRRSCPGMTYALQVEHLTMAHLIQGFNYRTPTDEPLDMKEGAGITIRKVNPVKVIITPRLAPELY

SEQ ID NO: 13559 - protein, 526 aa, Hordeum vulgare
MGADAAPAPSGSLPDAALDAFEEGFINNVLERPHALPRTADPAVQIAGNFAPVGEQPPVRALTVSGRIPPFINGVYARNGANPCFEPTAGHHLFDGDGMVHAIRIRNGAAESYACRFTETARLSQERAAGRPVFPKTIGELHGHSGIARLALFYARGACGLVDPSHGTGVANAGLVYFNGRLLAMSEDDLPYQVRVTAGGDLETVGRYDFDGQLDCAMIAHPKLDPVSGELFALSYDVIKKPYLKYFYFTPDGTKSADVEIELDQPTMIHDFAITENFVVVPDHQMVFKLAEMFRGGSPVMLDKEKTSRFGVLPKYAKDSSEMMWVDVPDCFCFHLWNSWEEPETDEVVVIGSCMTPADSIFNDTDDHLESVLTEIRLNTRTGESTRRAILPLESQVNLEVGMVNRNMLGRKTRYAYLAVAEPWPKVSGFAKVDLVTGELTKFEYGEGRFGGEPCFVPMDGEHARPGAEDDGYVLSFVRDEDAGTSELLVVNAADMRLEATVQLPSRVPYGFHGTFIGDADLDAQH

SEQ ID NO: 13560 - protein, 251 aa, Synechococcus elongatus
MAIISLAEMMESGVHFGHQTRRWNPRMAPYIYTARNGVHIIDLVKTAQCVETAYRWVRTNAEQGKRFLFVGTKRQAAGIIAEEATRCGSYYINQRWLGGMLTNWATIKGRVDRLKELERMEETGALALRPKKEAAVLRRELERLQKYLGGIKNMRRLPDAVVIIDQKREYNAVQECQKLGIPIVAMLDTNCDPDVVDVPIPGNDDAIRSVKLIVSKLADAIYEARHGAAPVAEEYDYDGAEDEYEDDADEA

SEQ ID NO: 13561 - protein, 286 aa, Prochlorococcus marinus
MDSPSTTANGWIDEHHQGVRYGLQGRVLVDETSPYQRITVIDSSRYGKGLLLDGCWMTAEHQERHYHESLVHPALCSAAQLERVLVIGGGDGGTARECLRYQDVKHLDMVEIDRRVVELSQKHLPSLGSHAWSDPRLQLNLENGIAWVANATESSYDVILIDGSDPAGPAEGLFNQTFFEHCRRILRPGGVFATQSESPEAFRQVHIDTVRLIRQVFGYADPLYGWVPMYPSGWWSWTFAAIDGPRYRNPLPARAAAISAGCEIWSPRWQQGAFEAIPAFIERELT

SEQ ID NO: 13562 - protein, 469 aa, Agrobacterium tumefaciens
MRRPMGAEHGHDRSRRTWKEKREAEAAELGYAEQPYVVIIGGGQGGIALGARLRQLGVPTIIIEKNERPGDSWRKRYKSLCLHDPVWYDHLPYIPFPENWPVFTPKDKVGDWLEMYTRVMELNYWGSTTCKSAQYDETTGEWTVVVDRAGKEVVLRPKQLVLATGMSGKANVPKFPGQDVFKGEQQHSSQHPGPDAYAGKKVVVIGSNNSAHDICAALWEAGADVTMLQRSSTHIVKSDSLMEIGLGDLYSERAVANGMTTRKADLIFASLPYRIMHEFQVPIYDRIREQDAEFYAALEKAGFMLDFGDDESGLFMKYLRRGSGYYIDVGACDLVIDGSIKLKSGVDVSHLTENAVVLKDGTELPADLVVYATGYGSMNGWAADLISRDVADKVGKCWGLGSDTTKDPGPWEGEQRNMWKPTRQDALWFHGGNLHQSRHYSQYLSLQLKARQAGLKTPVYGLQKPHHLS

SEQ ID NO: 13563 - protein, 714 aa, Brucella suis
MFNTHKVEIEWGGRPLTLETGKIARQADGAVLATYGETAVLATVVSAKEPKPGQDFFPLTVNYQEKTYAAGKIPGGYFKREGRPSENETLVSRLIDRPIRPLFVDGYKNDTQVVITVLQHDLENNPDILSMVAASAALTISGVPFMGPISGARVGYIDGEYVLNPNIDEMPESKLDLVVAGTSEAVLMVESEAQELPEDVMLGAVMFGHKSFQPVIDAIIKLAEVAAKEPRDFQPEDLSELEAKVLAVVENDLREAYKITEKQARYAAVDAAKAKAKEHFFPEGVEETEMSAEQFATIFKHLQAKIVRWNILDTGNRIDGRDLSTVRPIVSEVGILPRTHGSALFTRGETQAIVVATLGTGEDEQMIDALTGTYKESFMLHYNFPPYSVGETGRMGSPGRREIGHGKLAWRAIHPMLPAAEQFPYTIRAVSEITESNGSSSMATVCGTSLALMDAGVPIVRPVAGIAMGLIKEGERFAVLSDILGDEDYLGDMDFKVAGTEFGITSLQMDIKIDGITEEIMKVALEQAKGGRVHILGEMAKAISSSRAELGEFAPRIEVMNIPTDKIRDVIGSGGKVIREIVEKTGAKINIEDDGTVKIASSNGKEIEAAKKWIHSIVAEPEVGEIYEGTVVKTADFGAFVNFFGPRDGLVHISQLAADRVAKTTDVVKEGQKVWVKLMGFDERGKVRLSMKVVDQETGKEIVAEKKKEEVDAE

SEQ ID NO: 13564 - protein, 750 aa, Cryptococcus neoformans
MAVSQSHPNIVDGWFREINTQWPGQAMTLKVKQILHQEKSLFQDVLVFESETYGNVLVLDGVIQATERDEFSYQEMITHLPMASHPNPENVLVIGGGDGGVIREVLKHKSVKKVTLCDIDEAVIRVSKQWLPLMSDCYKDSRVEVHIGDGFKFLPEHKNEYDVIITDSSDPVGPAEALFQPPYFQLLKEALKEGGSVSTQAECLWVHLPLIKTLKETCSKLFPVVKYGFTTIPTYPAGQIGIMVCSKDSTRDLTVPLRAVPDTRYYNSEVHRAAFTIPEFGRAMLEDGVNVLPKFSGARPTPTTTKKKVLLLGSGLVAGPAADYIARHNHELTIACRTLASAQDLASGLPNATPMSVDVSSADALRQAIKGHDVVVSLIPYTYHAQVMEAALEEKVHVVTTSYVNPQMRALEQKFKDAGLICFNEIGVDPGVDHLWAIKVFDEVKKAGGKIKSFYSFCGGLVEPAAADNALGYKFSWSPVGVLMALNNDGKYLKDGKVVEVAGKDLMSTAKPYYFTPAYNLVAYPNRDSTVFREFYGLEGVQNLCRGTMRYAGFCEVITAWKEIGLMSDAQVDYLAQGAAPITWIKVVSQLLGVEAKEAAVIEKLKTLKSFETESRVLITKFRDLGLFSEEQVAQRGSVMRALSALLEEKCAFKEGEVDLVLLQHTFEIINADGSEQTITSSLEAYGDRNGGPSAMAKLVGVPCGMAVQFILEGVLNKPGVFAPYDEETCKLFRERLEKEEGITMVEKLV

SEQ ID NO: 13565 - protein, 854 aa, Unknown
  Vibrio sp. Ex25
MSKLKLVVIGNGMVGHRYIEDLVEKADISNMEITVFCEEPRVAYDRVHLSSYFSHHTADELSLVKEGFYEKHGINMLIGERAININRENRIVYSSTGREVQYDKLILATGSFPFVPPIKGHESKDCFVYRTIEDLKAIEACAKNSKSGVVIGGGLLGLEAAGALKALGVETHVVEFAPKLMAEQLDLAGGNQLRQKIERMGVNVHTSKNTLEIAAEGKNARNVMRFADGTELETDFIVFSAGIRPQDKLARQMELELGPRGGVAINDHCQTSDENIYAIGECASWNEMFYGLVAPGYKMATVAVDHLLGNTESKFEGADMSAKLKLLGVKVGSIGDANGRTEGCKSYVYQNEEQEVYKRLIVSEDNKKLLGAVLVGDTSDYGDLLQLMLNEIDLPEHPDALILPAHAGAEKPALGADALPESAVICSCFDVTKGKIAQAVADGHHTLGDIKAVTGAGTGCGGCIPLVTSVLNAELAKSGIEVKNDVCEHFAYSRQELFHLIRIEEIKTFDELLEKYGKGYGCEVCKPLVGSILASCWGEHILKPQLVKLHDTNDNFLGNIQKDGTYSVIPRMAGGEVTPQALGALANVAAEYNLYTKVTGAQRIGLFGAQKDDLPEIWRKLIDAGFETGQAYAKALRMAKTCVGSTWCRYGVQDSVGLGSYIENRYKGIRTPHKMKFGVSGCTRECAEAQGKDLGIIATDAGWNMYVCGNGGMKPRHADLLASDLDKETLIKYIDRFMMFYIRTAAPLQRTSVWMENMEGGVDYLREVIVEDKLGINAQLEADVAKLVDEYECEWTATINDESQLTRFTHFINSDKRDDNVVFVQEREQHRPATFTEKHPEAKGDILHVAITEA

SEQ ID NO: 13566 - protein, 926 aa, Zea mays
RPGQPRHKPFVDTLANPDDDLLQELAACEKRLIACIEGVPAKCSVNCQNAFDGFTAPATEHIIVDKMSSTKPSLTTSTTIYGAPVFDQYCDADLGDNAMELVQRGPVDIERIDLRRGALAGCYGEQSARGHTPSSFNDDLGASLDSVANSSVHGGHGSVLPHLTPICAGTSRIPVPDDRRLDCAEDFDTNHLDKGFESDPVPLPVVYDRYDEPNHNEIVEVLALLEYNEEARITDAIEGLIREATSRTAALESVEHRRRQVLTAAGEVEQEPTEGIINEVEAEEACEHSEVPPTSPPSRPSPTRSSTATSSTTHRSPRRKSSFHARCTSHPTTTARLLHSLPSPNQAEVVESFELESARPPVVYNSHVELGLYSFTPTIFSVEQVIEEEVPVAMPTRCSRMDLNRDAYSVLDLPVVCIVGGPNSNEYGTNRVLHHTISLPDFSQELRGFQAITYYQAIINNLDDAQEQMDMAIATALRKSKQVYVSVSCNMADLFHSHSCSCRWDSALHKPPWPPPVQPVQFVIPGDGAQDWIPPWPSFSGEIEQLELMVLIELGSSPTFFSDRLSPQLLGVQIVGLMVKVANVVELRLLSVTSQQYAYATLPPSCTEEFDATHLNKAKILLNIMGVIIQLNYRRIFVHDGQPLESKPKEPLRIQKMMTGDSVMMDETDDSWFNCHKIKLPADCGYEFQMKYGLIGWLMGALLGYAQGANHKLFSPLTALHPLVVACCDHGSIMDALTTNFMSNNLVQLCGCLLSVAANKGNFSAFPWDPGDDGAVILGVLGCSSYPIKTKWLNYHQKCYRLLSKVAPPPLGSRHTGCVVNAQRGGDQVWMQPLVHDLGQLNGHQQREIQVSSIISDSISATLWKTVEQTNPSHSFTAIVCRAGSGIDMVVGLVSSSLGAVASGQGNFKVLVWDPGGYAYHSLGTS

SEQ ID NO: 13567 - protein, 228 aa, Methanosarcina acetivorans
MCKNMTKEYVKGDLPEKAAILQRDGETYAIAPHIPGGIVYPETLRKIADIAEKYGAAALKVTSAQRIAIVGLKEENLDAAWGELGMSPGAAIGLCVRSIKICPGTTFCKRGKQDSVGLGLKLDKKYHGMQLPSKFKMAVSGCPNSCSETSIKDLGIMGTAKGYNLTVGGSAGPSPRLGDLVAKDLSEEQVLDLVEKIINFYKGYGKPKRLGKVIDEIGIEKFKEEIGL

SEQ ID NO: 13568 - protein, 123 aa, Arabidopsis thaliana
  misc_feature (26)..(26): Xaa can be any naturally occurring amino acid
  misc_feature (39)..(39): Xaa can be any naturally occurring amino acid
  misc_feature (60)..(60): Xaa can be any naturally occurring amino acid
  misc_feature (76)..(76): Xaa can be any naturally occurring amino acid
  misc_feature (105)..(105): Xaa can be any naturally occurring amino acid
MKRSDFETQWEANSEMASFTVYACTXSDVRPVLILKPTXHIYDPAIGMPSMGKKNGGVRXSLETYRGNESSMGAGXSATATAASTWDWSESLMAMIDERMRTVCXGTPFGLSNNHLGLDSVRS

SEQ ID NO: 13569 - protein, 420 aa, Rhodovulum sulfidophilum
MTDRPGAPTRRGFLKAGLAGGGALVAGKAAAEGPDPLITETQPWAQMWGDGVDVTPYGMPIEYESDVIRRNVDWLTADTISSVNFTPIHALDGTITPQGCAFERHHSGAIDLPKEDYRLMINGLVETPLIFTYADLERFPRVNHTYFLECAANSGMEWAGAQLNGAQFTHGMIHNMEYSGVPLRTLLEEAGVKPEGKWIYVEGADASSNGRSIPLDKALDDCLVAFKANGEALRKEHGYPVRLCVPGWEGNMWIKWLRRVEVTTEAIQSREETSKYTDTLADGTSRKWTWAMDAKSVITSPSPQSPITHGPGPLVITGLAWSGRGAIERVDVSLDGGKSWQTARLARPGQKMALARFYLDIDWDGSEMLLQSRAMDDTGYVQPTKNALREIRGLNSVYHNNGIQTWWIKTSGEAENVEVS

SEQ ID NO: 13570 - protein, 259 aa, Unknown
  uncultured marine bacterium
QPNAMGGREVEGMANLLAAHRNLASADDRQEVADYWGVDKISDKPGLTATEMFKALESGEMKAVWIVCTNPLVSLPDARQAERALKNAKFVVVQDISSKSDTADYADLVLPAAGWTEKEGTMTNSDRRISYLPQINEAPGEAIPDTDIPLKFAKAMGWEGFDYDSTEAVFNEHRELTRGTNIDITGLSYDYLKTKGTAQWPFVEGATEGTKRLFEDKVCWTPNQRAQIHTSLAANQSEKLPLDHPPGMSSGRIRDQWHT

SEQ ID NO: 13571 - protein, 735 aa, Geobacillus stearothermophilus
MENQNRQNAAQCPFHGSVTNQSSNRTTNKDWWPNQLNLSILHQHDRKTNPHDEEFNYAEEFQKLDYWALKEDLRKLMTESQDWWPADYGHYGPLFIRMAWHSAGTYRIGDGRGGASTGTQRFAPLNSWPDNANLDKARRLLWPIKKKYGNKISWADLFILAGNVAIESMGGKTIGFGGGRVDVWHPEEDVYWGSEKEWLASERYSGDRELENPLAAVQMGLIYVNPEGPDGKPDPKAAARDIRETFRRMGMNDEETVALIAGGHTFGKAHGAGPATHVGPEPEAAPIEAQGLGWISSYGKGKGSDTITSGIEGAWTPTPTQWDTSYFDMLFGYDWWLTKSPAGAWQWMAVDPDEKDLAPDAEDPSKKVPTMMMTTDLALRFDPEYEKIARRFHQNPEEFAEAFARAWFKLTHRDMGPKTRYLGPEVPKEDFIWQDPIPEVDYELTEAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFFPGRGDATQEQTDVESFAVLEPFADGFRNYQKQEYSVPPEELLVDKAQLLGLTAPEMTVLVGGLRVLGANYRDLPHGVFTDRIGVLTNDFFVNLLDMNYEWVPTDSGIYEIRDRKTGEVRWTATRVDLIFGSNSILRSYAEFYAQDDNQEKFVRDFINAWVKVMNADRFDLVKKARESVTA

SEQ ID NO: 13572 - protein, 259 aa, Unknown
  uncultured marine bacterium
QPNAMGGREVGGLANQLAIHRGFDPDSIKLISEFWQTDNLATRPGLKAIELFEAVERGDIQVIWIMATNPVVSMPDNVFIQRALQKCPLVIVSDVTHDSDITQYADLLLPAAGWGEKQGMVTNSERMLTRQRKFLPSKGEAKPDWQIIAEVGKKLCQRLDKPNAFEFKSESSVFREYAAMTGLNKDTPLLLDLSKYAEISDEEYESWNPVQWGSSRPFADGKFSTENRKARFVVTTAPLIKGESRLWLNTGRQRDQWHT

SEQ ID NO: 13573 - protein, 979 aa, Bacillus cereus
MNNNMVHITIDGKKYTAEPSSTILGVINENGIEHPQICYVPEVDPIQTCDTCIVEVDGKLMRSCSTVVTEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHNQRFIDENVNFFEDFKESLAEYTLEYAEEVTGISQETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDKGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWSYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEISPALAKERGVKTGSLVRLVSPFGALKLRALVTDRVKANELYLPMNSTDNETAINFLTGPAVDTRTNTPAYKQTKVRMEVLEVDGENPMPKANPRNKKRHPQSGIEVHRKWARPGYVHLTDK

SEQ ID NO: 13574 - protein, 261 aa, Nectria lugdunensis
CYISKSHEPYPPKIELSNAGRYLAKTEYSLLDTPIAEGSLDLPGNTTAHGLAAGIRVGFTMRYPESDFKYVKGHHLPRPGRREKLFDQRHLEYQIAKASPSIPVFRLRYADVLNTPASQAPPSASCFYRLPRNQSKVYEVAVIYMRSGYDPSDYPGQEAWDARYHLERSHAIKCPTVLTQLAGTKKVQQILTTPKSPSVPSALSKFIRDDTEDVAELWRTFTNIYPMDTSDAGLEARKKALDPKLCQAYVLKPQREGGGNN

SEQ ID NO: 13575 - protein, 406 aa, Azospirillum brasilense
GFAGDAAARYSSTLGVAAVTYGAGAFNMVNAVAGAYAEKSPIVVISGAPGTTEGNAGLLLDHQGRTLHTQFQVFKEITVAQARLDDPAKAPAEIARVLGAARALSRPVYLEIPRNMANAEVEPVGDDPAWPVDRDALAPAPDEVLAAMRSATSPVLMVCVEVRRYGLEAKVADVAHGLGVRSVTTFMGRGLLADAPTPPLGTYIGVAGDAEITRLVEESDGLFLLGAILSDTNFAVSQRKIDLRKTIHAFDRAVTLGYHTYADIPLDGLVDALLERLPPSDRTTRGKEPHAYPTGLQADDGPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNA

SEQ ID NO: 13576 - protein, 736 aa, Triticum aestivum
GASACSRSRRRDGTPASAATTDTSCESVVTSGQHQQQQQNAVVPRPQRDADNPAGLLAIAEETLAEFLSKATGTAVDWVQMVGMKPGPDSIGIVAVSHNCSGVAARACGLVSLEPTKVAEILKDRPSWYRDCRCVDVLQIIPTGNGGTIELIYMQTYAPTTLAAPRDFWILRYTSGLEDGSLVICERSLTQATGGPSGPNTPNFVRAEVLPSGYLIRPCEGGGSMIHIVDHVDLDAWSVPEVLRPLYESPKILAQKMTIAALRHIRQIAHESSGEMPYGGGRQPAVLRTFSQRLSRGFNDAVNGFLDDGWSLMSSDGAEDVTIAINSSPNKLAGSHVNPSQMFTAIGGGVLCAKASMLLQNVPPALLVRFLREHRSEWADPGVDAYSAAALRASPYAVPGLRASGFMGSQVILPLAHTLEHEEFLEVIRLEGHSLCHDEVVLSRDMYLLQLCSGVDENAAGACAQLVFAPIDESFADDAPLLPSGFRVIPLDAKTDAPSATRTLDLASTLEVGPGGTRAPSDASSTSNTRSVLTIAFQFSYENHLRESVAAMARQYVRTVVASVQRVAMAIAPSRPGGQLEMKNPPGSPEAHTLARWIGRSYRFHTGAELLCMESQSADASLKALWQHSDSIMCCSLKAAPVFTFANQAGLDMLETTLIALQDISLEKILDDDGRKALCSEFPKIMQQGFAYLPGGVCVSSMGRPVSYEQAVAWKVLGDDDAPHCLAFMFVNWSFV

SEQ ID NO: 13577 - protein, 259 aa, Unknown
  uncultured marine bacterium
QPNAMGGREVGGLANQLAIHRGFDPDSIKLISEFWQTDNLATRPGLKAIELFEAVERGDIEVIWIMATNPVVSMPDNVFIQRALQKCPLVIVSDVTHDSDITQYADLLLPAAGWGEKQGMVTNSERMLTRQRKFLPSKGEARPDWQIIAEVGKKLCERLDKPNAFEFKSESSVFREYAAMTGLNKDTPLLLDLSKYAQISDEEYESRNPVQRGSSRPFADPKISTQNRKARVVVTTAPLIKGERRLWLNTGRQRDQWHT

SEQ ID NO: 13578 - protein, 541 aa, Unknown
  marine gamma proteobacterium HTCC2080
MQSSQTTDFDAIVVGAGFAGVALTHYLREAGLTLKVFDRAPDIGGTWAWNKYPGAATDSEGYYYCLTFSKEVLEEWTWSKRYPGWEETQNYLRFVADKFDMWPHLQFNTEITRAEYQADRGIWVVTTGDGATHTCRFFISGMGMISQPQIPNIPGQATFKGPCFHSSRWPEGLEFAGKRVGIIGAGATTVQMLPEVAKTAASVTVFQRTPNFVMPAMQKPMTPEWERDIKENYQEIIDKCRNHVFGMGFNPPSGRTVAESTPEEVQQVFEENWHGSFRWVFETFDDLLATPEANKAAADFIIEKMIKAKVEDPETAELLTPKGYPLFAKRPPLDHGYYEAFNRDNVKLVDIKDYEPIVEITETGVRTTQNHHEFDIIVLATGFKAYTGALEAMDIVGEEGQILRDKWQDQSSSIMGVAVAGYPNFFMVTGPQAPFANLPTSIEQNAQWISECVKKMNAEGKQVFYPSVTAEEEWTNLTAEIHAQTMMAEGDKVNSWMMGANREDRKARVLIFFGGAHVYYDKLKESSDAGFPELAFADSAA

SEQ ID NO: 13579 - protein, 590 aa, Asparagus officinalis
MCGILAVLGCSDDSQAKRVRVLELSRRLKHRGPDWSGLCQHGDCFLSHQRLAIIDPASGDQPLYNEDKSIVVTVNGEIYNHEELRRRLPDHKYRTGSDCEVIAHLYEEHGEDFVDMLDGMFSFVLLDTRNNCFVAARDAVGITPLYIGWGLDGSVWLSSEMKGLNDDCEHFEVFPPGNLYSSRSGSFRRWYNPQWYNETIPSAPYDPLVLRKAFEDAVIKRLMTDVPFGVLLSGGLDSSLVAAVTARHLAGSKAAEQWGTQLHSFCVGLEGSPDLKAAKEVAEYLGTVHHEFHFTVQDGIDAIEDVIFHIETYDVTTIRASTPMFLMARKIKSLGVKMVISGEGSDEIFGGYLYFHKAPNKEEFHHETCRKIKALHQYDCLRANKATSAWGLEARVPFLDKEFMDVAMSIDPESKMIKPDLGRIEKWVLRKAFDDEENPYLPKHILYRQKEQFSDGVGYSWIDGLKAHAAKHVTDRMMLNAARIYPHNTPTTKEAYYYRMIFERFFPQNSARLTVPGGPSIACSTAKAIEWDARWSNNLDPSGRAALGVHDSAYDPPLPSSISAGKGAAMITNKKPRIVDVATPGVVIST

SEQ ID NO: 13580 - protein, 1031 aa, Vibrio vulnificus
MTAFSEILQRRDWENPQSVNIHCLKAHSPLASFRDMAHARDGIHAQRQSLNGQWKFKLFDAPEQVDGQFTQADFNDAEWDEIPVPSNWQLHGYDKPIYANIKYPFDVNPPFVPSDNPTGCYRTRVSFSPEELANTQRIIFDGVNSAFHLWCNGTWVGYSQDSRLPAEFDLTSHLVAGENTLAVMVMRWCDGSYLEDQDMWWLSGIFRDVTLLSKPQHCIEDVFITPDLDACYRDGSLSIVTTIAAPETYQVQVQLFEGTQAVTEPNIARPHNRRIDERGTWNDVVFQTLHLREPKKWTAETPNLYRLVVSLLDENGTHLESEAYPVGFRKVEISEGQLKLNGKPLLIRGVNRHEHHPELGHVMTEEDMIRDICLMKQYNFNAVRTAHYPNHPRWYELCDQYGLYVCDEANIETHGMQPMSRLSSDPQWAHAYMSRYTQMVLRDKNHPSIIIWSLGNESGHGSNHNAMYAWSKNFDPSRPVQYEGGGSNTTATDIIAPMYARVNTLVADEAVPKWPIKKWISLPNETRPLILCEYAHAMGNSLGSFDEYWAAFREFPRLQGGFIWDWVDQGLSQWDENGQHFWAYGGDFGDEINDRQFCINGLIFPDRTVHPTLQEAKYCQRMITVSLQEQTQKACTLLVTNENLFRTTDNEQLNWSLLENGQVIQTGSQVLSVEADSQTRLEIALNFTPKAQAQYHLNTDICLIEATSWAPAGHVVATEQMALRNHAGLAMPTLRTQPAPKLTQNGHAIVVSSLDEKHQWRWDSQSGLLMEWNVDGKAQMLAAPQDNFFRAPLDNDIGISEVDNVDPNAWVCRWEMAGIGQWERHCVQCESETLAHAVVVTTTFAYHFGGDVQAITQWTHTLSNDGEMLLDVDVTLADALPPMPRIGLELQLPLHQTDTPITWQGLGPFENYPDRLAAARFGLHTQTLAQMHTPYIFPTDSGLRCGTQWLQVNELAISGDFQFSVSQYAQQQLAEAKHTHDLLAQERIYLRLDHQHMGVGGDDSWSPSVHKEFQLTEKHYRYQLRFKPASR

SEQ ID NO: 13581 - protein, 268 aa, Unknown
  uncultured marine bacterium
QPNAMGGREVGGLANQLAAHMDFATPNAIELVQRFWQAPNMDRKMVSRPIDMFQAVEQGKIKVLWIMSTNPMVSLPDTEQVRRALEKCELVIVSDCKQSTDTTAYADVLLPALPWSEKDGTVTNSERRISRQRGLLPARGEAKADWWAICQVAGAMGYQSAFSYRSVHDIFREHAALSGFENHGKRDFDISLFSNISEQAYQDLLPIQWPVTKESPNGTARMFTDGRFFTADRKANFIPIDVKEPQVAPDEDWPFVLNTGRVRDQWHT

SEQ ID NO: 13582 - protein, 224 aa, Triticum monococcum
  misc_feature (193)..(193): Xaa can be any naturally occurring amino acid
  misc_feature (219)..(219): Xaa can be any naturally occurring amino acid
DCSSVASADFEGVGLGFFGAGVEGGAVVFEDSAASAATVEAEARVAAGGRSVFAVECVPLWGFTSICGRRPEMEDAVIAVPRFFGLPLWMLTGNNMVDGLDPISFRLPAHFFGVYDGHGGAQVADYCRDRLHAALVEELSRIEGSVSGANLGAVEFKKQWEKAFVDCFSRVDDEIAGKVTRGGGGNVGTSSVXAMGMVDPVAPETVGQRRWSLSSAPLXSCLKL

SEQ ID NO: 13583 - protein, 268 aa, Unknown
  uncultured marine bacterium
QPNAMGGREVGGLANMLAAHMDIENPQHRQWVQEFWDSPTICTEPGLKAIDLFDSMDQGKAKAAWIMATNPLVSMPNRGKITPALENCDCAWCSDCVELNDTLALADVKLPATAWSEKEGTETNSERSISRQRAFKAAPGEAKNDWQIICDVAQKMGYSKGFDSQTPHQIFVEHARLSGVNNFGDRNSHILTLAGLSLQEYQRLKPVQWPVNKRYPDGCKRLFTYGRFFTPSGKALFIPLHPELPEQQTCRDYPLILNSGRIRDQWHT

SEQ ID NO: 13584 - protein, 311 aa, Zea mays
MSSLVFKLFLFVSLFQISISARKLAQDEPNQFQSLKYHKGALLSGKISINLFWYGKFKPAQRAIISDFITSLSHSSSDQPSVATWWKTTEKYYKLAAGDKTPSPSLSLTLKSQILDETYSLGKSLTDRDIRKLASKGDQYDAVNVVLTSADVAVTGFGMSRCGTHGHARGNAGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGNLLVDATTGGSFNAYGANGRKFLLPALYDPTTSDCSTMV

SEQ ID NO: 13585 - protein, 169 aa, Brassica napus
  misc_feature (155)..(155): Xaa can be any naturally occurring amino acid
MDHDLEIFPLLSYALHHSDPASHAPPSLSIQHSLANRYPLLTNPHVISTLIESIPSTITQTLHVFTSLGPRPDPSSVSSARAKIAQIRETDPSSLSPEDAAKEEQIYVTVVKLEEVHEGYEKQLRGLEEKLSEVYASAVESLDGGDEVNEEVLEXLDGGGVERMISLIV

SEQ ID NO: 13586 - protein, 427 aa, Unknown
  Synechococcus sp. CC9605
MTKPLDIPAILLFLATMFGAINHKFVKLPHTIGLMIVALAASLSLIALDLIFPSLGMSVLVNKFLGNIDFNVTLMQGMLSFLLFAGALHVDLDQLLENKWTILAFASFGVLVSSFVIGGGFWLISGAVGLSLPFLICLLLGVMVSPTDPVAVLGVLKTLQVPSPLKAKIAGESLFNDGVAVVLFSVLVSLVFGNGGEEGLETSFQLTSVIWLLTKEALGGLFLGLISGYIAFWLLRQIDDYVLEVLITLALVTGAYSIALHLHLSGPIAMVIAGLLIGNQGTSMAMSETTRMHVETFWELVDEILNSVLFLLIGLKIVFLFQHSSYEIAYPLLISLFIAITLLSLFARFVAIALPVQIKSLNSEVNPGTVQILTWAGIRGGVSVALALSLPSSSESELLLFVTYLVVLFSVAIQGLTIENVIKRYYP

SEQ ID NO: 13587 - protein, 574 aa, Unknown
  Erythrobacter sp. NAP1
MECLVDQGVEFVFGYPGGAVLPIYDELFGDERIRHILVRHEAGAGHAAEGYARATGKPGVVLVTSGPGATNAVTAIADAYMDSIPMVVITGQVPTALIGTDAFQEADTVGITRHCTKHNYLIKDPADLVATVEEAFRIATTGRPGPVVVDIPKDVQIAVPSQSSAYVAPGSHRYAPQMVAPAEQIAEAIELIENAQAPILYTGGGVINSGPEASELLRKLQDLTNAPITSTLMGLGAFPNTHPDWLGMLGMHGTYEANMAMNKCDVMICVGARFDDRVTGRLDAFSPDSKKIHIDIDRSSINKTVPVDIGIVGDCATVLGQLVEAWGTRKPQDLGEWKARIAGWRARECLAYPQRSKKNPEAIMPQKAVERLYALTKDRKPIVSTEVGQHQMWAAQYFGFDEPNKWLTSGGLGTMGYGMPAAIGAQLGCPDALVIDIAGEASIQMNIQELGTASQYRLPIKVFILNNEYMGMVRQWQELTYESRYSNSYSDSLPDFVALAEAYGWKGIRITEEAGLDAGIKAMIDHDGPVIVDCCVAKDANCLPMIPSGAAHTDMLLYGDSVDGTMDDEAKALV

SEQ ID NO: 13588 - protein, 506 aa, Lithospermum erythrorhizon
MALPAIPLAIIIFLIISYKLYQKLRLKLPPGPRPLPIIGNIYQVKPVKFRCFYNWSKTYGPIFSIYYGSQMNVIVSTTELAKEVLKENDQHLADRFRTRSSASMSRGGKDLIWADYGPHYVKVRKLCNVELFSPKRLEAIRPMREDEYTALVESIYKDCTKPELKGKSLLVREYLSSVAFNNITRLAFGKRFMDSNGVVNEQGQEFKKITHDGIKITAKLSIAEYIPWIRWMFKVEQDALDKFAADRDHLTRVIMEEHIKSGNTKQHFVDALLTLQKQYDISEDTIIGLLWDMIAAGMDTATISTEWAMAELVRNPRVQRKAQEELDRVVGPDRIMTEADVPKLPYLQCIVKESLRLHPPTPLMLPHRASANVKIGGYDIPKGSIVHVNVWAIARDPAYWKNPEEFRPERFMEEDIDMKGTDYRLLPFGAGRRICPGAQLAINLITSSLGHLLHQFTWSPQPGVKPEEIDLSENPGTVTYMRNPVKAVVSPRLSAVHLYKRVESDM

SEQ ID NO: 13589 - protein, 525 aa, Arabidopsis thaliana
MGKREKKPNRRRHKGEYSNDAEDFYDQHPPAVASVDEEDEENSDEEEEENDGNESSDLPSKFLLYQQSVQSPKGDISYLQKFFLMYVGGRQPFHFQEDFCGTALLSAEWLKTDTRRTAIGLDFDLDALEWCMDNNISKLGSDVYSRMSLFHGNVLTPLEAKQVKSKSHELIQNISLDDGDDNEDLADPSVVESLEKDGPDSLPKRDIVCAFNFSCCCLHKRSELVSYFKNARDALSKKGGIFVMDLYGGASAEGQLKLQRKFPNFTYTWEQAEFDILSRKTRISLHYHLQKQNRKIRHAFSYSWRLWSLPEIKDCMEEAGFSSVHFWLREMPDASEMRRTDGFGAGRDIKFFSPEFVLIHSVMAEEHRLQEPRLCANNCGFFGSTATQNLCSKCFRDLQHQEQNSSTAKHALTQSLAAVGAAASSSVSPPPPPPADSKEIVEAKSEKRAAAEPEEADGPPQDPKRCLTCRRRVGITGFRCRCGFVFCGTHRYAEQHECSFDFKRMGKDKIAKANPIVKADKLEKI

SEQ ID NO: 13590 - protein, 647 aa, Burkholderia pseudomallei
MKLLLVDNLVMPEEGSLAYLDVHPHLGLLALAAVAEADGHRVRIYDPKRLIRDGTLAYDATLYERASRAILAERPDAVGFTALGCSFLFALNVAALLKRREPDLPVLLGGPHATMLHRQILERFPQFDIIVRYEADEILPAVLDCLEQRTFDVIPGLSWRATGHGAPLRFTDGKPKVEELDRLPIASYDHYPVDDLGLSMLRIEAGRGCPFACTFCSTAGFFQRSFRLKSAERLVHELDILHRRYRVSDFKLDHDMFTVNRHKVMAFCEAVAGRGYRWRASARIDCVDEALLRKMADAGCVNLYFGVETGSERMQTICRKRLDLRLVEPILAAADSFGIETTASFITGYPQECGQDQDDTLDMIGRCARRPSCLTQLHMLAPEPGTPLFDEHGAQIAYDGYGGPYNTRLLGPGDEREVLDHPDIFQTYYYYPAALPRARHIFAVEAVDVLRRAGPIILAYALREFGGRLSRLISAWRRFADETSPGALPDAAGLEAFVAARFGRGHHLHSLFRYALRLSAARAPADVVAEGPYEPDRPCMLAENVGLLEDIHNCEALVDRLRRSNDGAPALGDADVGGLGAYIVRADGEAVTGYWVESGIAAILDLFRAPRSCRAAAQWLAHVTRNDGVDASIFEPLLRRGILVPAR

SEQ ID NO: 13591 - protein, 672 aa, Aspergillus nidulans
MASNFSEDNIKELKYRLEAAAVQCSERCLYQSAKWAAEILDSIIPIDNYDTDPDSPMDITEPRPQNPYLRTQDPVEAALEAQEYHKYLLAKSYFDTREYDRCASVFLPPTISPVSLSTSSPQSKLKSSLRNRKSQGSPHAGLKDNDLKRSPYPKLSQKSLFLALYAKYLAGEKRKNEETEMVLGPADGGATVNRELPDLARGLEGWFAERQEKGVEDQNHGWLEYLYGVILIKGRNEEEARKWLIRSVHLNPFHWGAWQELNDLLASTEDLKQVVEHLPQNIMTLIFHVHCSQELYQATEDTYQTLSELENIFPTSAFLKTQRALLYYHSKDFEEASHIFTDILITSPHRLDSLDHYSNILYVMGARPQLAFVAQVATATDKFRPETCCVVGNYYSLKSEHEKAVMYFRRALTLDRNFLSAWTLMGHEYIEMKNTHAAIESYRRAVDVNRKDYRAWYGLGQAYEVLDMSFYALFYYQRAAALRPYDPKMWQAVGSCYAKMGRIEQSIKALKRALVAGSYYAEDPSQHGGRKILDPETLYQIATLYERLEDEEEAAAYMELTLQQETGGQPDEVSDVSDSEIEDDQSNTASTSGANQRRARRSPNDDEEEAYHGTGPTATTSKARLWLARWSLRHGDLERADQLAGELCQDGVEVEEAKALMRDVRARREAGA

SEQ ID NO: 13592 - protein, 388 aa, Triticum aestivum
  misc_feature (6)..(6): Xaa can be any naturally occurring amino acid
ASGHLXSGSLILMQAEMQFLSPLVPAREVVFFRYCVHNADEGTWSIVDFPADGFQEELLQQQQQTSSLVRCRRRPSGCIIQDAPNGYSRVVWVEHMEVVGEEKPLQPVFKDHVAGGAAFGATRWVSVLQRQCERLASELARSIADQGVIRTPEARTNMMKLSQRMITAFCANISASGSQSWTALSDSTDDTVRITTRKNTEPGQPSGVILTAVSTSWLPFSHQQVFELLADEQQRCQLEILSNGGSLHEVAHIANGSHPRNCISLLRINSASNSSQNVELLLQESSIHPDGGSLVVFATVDVDAIQVTMSGEDPSYIPLLPMGFAIFPATSPSPGATSSDTTSNGETSPGNADEPATGCLLNVGMQVLANAVPSAKLNLSSVTAINSH

SEQ ID NO: 13593 - protein, 897 aa, Unknown
  Bradyrhizobium sp. BTAi1
MTTVDPKLRTVRTACPYCGVGCGVLATPDGSGGAAISGDPVHPANLGRLCSKGSALGETLGLESRLLYPMVRCKHGLERVAWSDALDHVASRLKHIVARDGEDAVAFYLSGQMLTEDYYVANKLMKGFLGSANVDTNSRLCMASSVAGHRRAFGSDTVPGSYEDLDQADLLVFVGSNAAWCHPVLYQRMLANKQGRGAKFVVIDPRRTDTASEADLFLGLKPGTDAALFSGLLVHLADSGALDRDYIARHTSGFDETLARARSLAGSAAATALATGLSETDVAAFFKLFRETPKVVTLYSQGVNQSAQGTDKVNAILNCHLATARIGRPGMGPFSLTGQPNAMGGREVGGLANQLAAHMSFTPPEIDRVRRFWKAPDIATHEGLKAVAMFEAIARGQIKALWVIGTNPAVSLPDADLVRAALKKLELFVVSENVRSNDTVDAGVHVLLPAQAWGEKSGTVTNSERRISRQRAFMAPAGEARPDWWILSEVGKRLGFAQAFNYNSAADVFREHAALSAFENEGSRDFDIGALATLTDEEYEAMAPVQWPARAGKPPEPRVFADGSFFTNDRKARFVAPDVPALRSETTAARPLRLNTGRIRDQWHTMTRTGLSPRLSAHLPEPFVEVHPDDALRYGLMHDGFAKVTTEHGQCILKVVVSERQQRGMLFAPIHWNATNSSHGRVGALVAAHTDPFSGQPEAKATPAAISPYEYVFRGFILSRSELPLPPNLWWVRATVPGGFGYLFADNGDLMRWPAWFKARASDDVADYMDVGGGVYRAASFAGDRIETCMFVGPGHDAGDWNVVKTMFAADSLDDEQRRMLLSGRAPDGTGGGPIVCACFGVGRDTICDAIASGARTPAAIGARLKAGTNCGSCIPEMKRLIAQTATQAADAVKVAS

SEQ ID NO: 13594 - protein, 129 aa, Prochlorococcus marinus
MRILHTMLRVGDLDKSIDFYVNRLGMNLLRKKDYPHGKFTLAFVGYGSEKENSVIELTYNWDKKSEDYELGDKYGHIAIGVKDIHLICQGLENNGCKITTKPKTMKNSTTVLAFVEDPDGYKIELIERD

SEQ ID NO: 13595 - protein, 399 aa, Aspergillus nidulans
MADGIDRRADDKMEFNTSKEVTVAPTFEDMHLKESLLRGIYAYGYESPSAVQSRAIVQICKGRDTIAQAQSGTGKTATFSISALQVIDTVVRETQALVLSPTRELATQIQSVIMALGDYMNVQCHACIGGTNIGEDIRKLDYGQHVVSGTPGRVADMIRRRHLRTRHIKMLVLDEADELLNRGFREQIYDVYRYLPPATQVVVVSATLPYDVLDMTTKFMTDPVRVLVKRDELTLEGIKQYFIAVEKEEWKFDTLCDLYDTLTITQAVIFCNTRRKVDWLTDKMREANFTVSSMHGEMPQKERDSIMQDFRQGNSRVLISTDVWARGIDVQQVSLVINYDLPTNRENYIHRIGRSGRFGRKGVAINFVTSDDVRILRDIELYYSTQIDEMPMNVADLLS

SEQ ID NO: 13596 - protein, 439 aa, Unknown
  Bradyrhizobium sp. BTAi1
MDPRGRRSLDRGLRHAVRLHDFGSLWQRTGSGVGPLSEPLVIVGNGMAAAKLVEELSQTALGRYAIAVIGEEPRLAYNRVLLSSVLAGEAASHEIELKPAAWWRERGVTLKYGARVTRIDVGRRELEVENEENMAFSRLVLATGSLPLRLPVPGADLAGVHTFRDSRDTDVLLSLAAKKSRVVVVGGGLLGLEAAYGLARAGAKVTLLHLMDRLMERQLDASAAALLKVLVERKGIEVLLQASTAAIHGELRVERVELADGRSLAADAVIFAAGIRPNVALAKEAGLAVNRGIVVDDALQSSVPGISALGECAEHRGTCYGLVEPAYEQARVLARHLAGRKAAYQGSVVATNLKVSGVAVFSAGDFVGAPGSEAIVLNDARRGIYKKLVIADGRLTGAVLIGDTQDALWYRDLIRNREPIASIRTEMMFGRAGARPRAA

SEQ ID NO: 13597 - protein, 303 aa, Unknown
  Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLAGGTGITPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 13598 - protein, 264 aa, Symbiobacterium thermophilum
MSVISMKQLLEAGVHFGHQTRRWNPKMKEYIFTERNGIYIIDLQKTVRMVEIAYNAVRQMAADGGKILFIGTKKQAQDAVREEAERCGMFYVNQRWLGGMLTNFETIKKRIARLNELEEIEGTEYWSKLTKKEQAQLLHEKEKLEKNLGGIKGMKSLPDMAFVIDPRRERIAVSELRKLGIPIVAIVDTNCDPDEIDYVIPGNDDAIRAVKLLTSKIADAVIEGRQGVDTSATVDEEEAEVAEETESMESAEDLDADLIEEEAE

SEQ ID NO: 13599 - protein, 708 aa, Chlamydomonas reinhardtii
MAVASTSRPSSARPIVINAASFGVKKTANQLLRELARGSARKSTSRSAVTGATGATCALDIVMVAAEVAPWSKTGGLGDVTGGLPIELVKRGHRVMTIAPRYDQYADAWDTSVVVDIMGEKVRYFHSIKKGVHRVWIDHPWFLAKVWGKTGSKLYGPRSGADYLDNHKRFALFCKAAIEAARVLPFGPGEDCVFVANDWHSALVPVLLKDEYQPKGQFTKAKSVLAIHNIAFQGRMWEEAFKDTKLPQAAFDKLAFSDGYAKVYTEATPMEEDEKPPLTGKTYKKINWLKGGIIAADKLVTVSPNYATEIAADAAGGVELDTVIRAKGIEGIVNGMDIEEWNPKTDKFLSVPYDQNSVYAGKAAAKEALQAELGLPVDPTAPLFAFIGRLEEQKGVDIILAALPKILATPKVQIAILGTGKAAYEKLVNAIGTKYKGRAKGVVKFSAPLAHMLTAGADFMLVPSRFEPCGLIQLHAMHYGTVPVVASTGGLVDTVKEGVTGFHMGALNPDKLDEADADALAATVRRASEVFAGGRYPEMVANCISQDLSWSKPAQKWEGLLEEVVYGKGGVATAKKEEIKVPVAEKIPGDLPAVSYAPNTLKPVSASVEGNGAAAPKVGTTAPAMGAWRATTPSGPSPAAATPKVTTYKPALPATAKPKTAGLKLAGEASTTSTSENGAASNGNGNGASASKTSAAKPLVSAATRKSA

SEQ ID NO: 13600 - protein, 303 aa, Unknown
  Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGPRGMEEGIDAALSAAAAKEGVTWSDYQKDLKKAGRWHVETY

SEQ ID NO: 13601 - protein, 161 aa, Unknown
  marine gamma proteobacterium HTCC2143
MTTIYDFDAETIGGQPAPMENYQGKVLLIVNTASKCGLTPQFKGLEKLYEDLKDRGLEILGFPCNQFANQDPGSNEKIEEFCQMNYGVSFPMHAKIDVNGAKTHPLFKHLKEKAPGFMGTRQIKWNFTKFLVNDEGEVLKRFAPTDTPEQIRSAIEQVLPE

SEQ ID NO: 13602 - protein, 976 aa, Oryza sativa
MAGTRQTTSVPMDNAAVVDAKPLRTLTPMFPAALGLHTFTAKENSSSIVCITPFGPYAGGTEQAMPASIPPMFASPAAPADPNQRQPYAVHLNGAAPANGTANNTGVIPDLQIAVAGTVESAKRKRGRPKRVQDSSVPSAHLVPSAPGGNITAVQTPPSATTDESGKKKRGRPKRVQDVPVLSTPSAPQVDSTVFQTPASAVNESVTRKRGRPRRVQDGADTSAPPIQSKYNEPVLQTPSAVTLPEDGKRKRGRPKRVPDGALIPLSHSGVSIDDDSGEIITGKRGRPRKIDVNLLNLPSLFSDDPRESVDNVLMMFDALRRRLMQLDEVKQGAKQQHNLKAGSIMMSAELRANKNKRIGEVPGVEVGDMFYFRIEMCLVGLNSQSMSGIDYMSAKFGNEEDPVAISIVSAGVYENTEDDPDVLVYTGQGMSGKDDQKLERGNLALERSLHRGNQIRVVRSVRDLTCPTGKIYIYDGLYKIREAWVEKGKTGFNVFKHKLLREPGQPDGIAVWKKTEKWRENPSSRDHVILRDISYGAESKPVCLVNEVDDEKGPSHFNYTTKLNYRNSLSSMRKMQGCNCASVCLPGDNNCSCTHRNAGDLPYSASGILVSRMPMLYECNDSCTCSHNCRNRVVQKGSQIHFEVFKTGDRGWGLRSWDPIRAGTFICEYAGEVIDRNSIIGEDDYIFETPSSEQNLRWNYAPELLGEPSLSDSSETPKQLPIIISAKRTGNIARFMNHSCSPNVFWQPVLYDHGDEGYPHIAFFAIKHIPPMTELTYDYGQSQEVGDCCRTMKQQGAFSVSRCHVIRLAFVWMRMQKRQSIPDIYLFIRCPGHGNSSCTEQFAKSDEMIRAIAFRESSGRYDSSEKCMFCRLINNLDNAHEQIDTAIATALSESKPVYISVGCNLAGLSHPTFSREPVPLFISPRLSNKANLEYAVEAAADFLNKAVKPMMVGGPKFRVAKAKKAFAGIAESSGY

SEQ ID NO: 13603 - protein, 176 aa, Glycine max
  misc_feature (115)..(115): Xaa can be any naturally occurring amino acid
  misc_feature (136)..(136): Xaa can be any naturally occurring amino acid
  misc_feature (143)..(143): Xaa can be any naturally occurring amino acid
  misc_feature (153)..(153): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFLYHEHNRSPXYYDGRYWTMWKLPMFGCADAXKWLKDLXDAKTGYPDGXVRIMGCDTFGSADRELICYNLPR

SEQ ID NO: 13604 - protein, 84 aa, Borago officinalis
MKEQKFGMKEEKWIHEGLITESLPNGMFRVRLDNEDLVLGYVSGKIRRSFIRILPGDRVKIEVSRYDSTRGRIIYRLRNKDSKD

SEQ ID NO: 13605 - protein, 198 aa, Glycine max
  misc_feature (109)..(109): Xaa can be any naturally occurring amino acid
MPMACFSILSPPHPTLTLTLLPPSHSQCGGFTVRVSVALTERLSQHHKTNSIIPSTRAAANGGGFETETAVVEKPQLKTLFQASRGYPSPFGATVRDGGVNFAISSLNXISATLCFFTLSDFQNNRVTEYVPLDPLINRTGGVWHVFLKGDFRDMLYGYKFDGKFSPLEGHYFDSSHILLDPYAKAVISRGEFGALGP

SEQ ID NO: 13606 - protein, 332 aa, Xylella fastidiosa
MCTSSLITSTETFMTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPAAERGSGMVRKAKELAEQHGWFLASQFSNPANPAYHRNTTAAEILRDFAGRRLDHFVSGWGTGGTLTGVGEVLKIARPDITITASEPASAALLQGKEWQPHKIQGWTPDFVPEVLNRSVPHHILSVTDDDAITVARRLAAEEGVFSGISGGATVATALQIAQQAQPGAVILAMLPDTGERYFSTPLFADINEHSDDAWLASLG

SEQ ID NO: 13607 - protein, 476 aa, Xylella fastidiosa
MTANVLFPLFANLHDRAVLVVGGGKVAERKTEALLKVGALPIIGAPSLTASLQHWAETGRITWRQGTFENSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLTGPLQRLLRKQRHAEAEAVLEAALAETPPTGSGSVTLVGAGAGDAGLLTLNALRALNEADIILYDRLVSDTVLQVARRDAEQIEVGKSATGHSVRQEDIHSLMLQHARAGQRVVRLKGGDPFVFGRGGEELEFLRTHNIPYEVIPGITAALACAAYAGIPLTHRDHAQSLCLITAHCQSSLDTLDWAALAQERQTLAFYMGVAGLPTIQQRLCEAGRAETTPFALIENGARAQQRVLTGTLKTLAHTAQTYAVRPPALLILGEVTTLAEHLHWFGTAPLSAPCPPALIL

SEQ ID NO: 13608 - protein, 271 aa, Unknown
  uncultured marine bacterium
QPNAMGGREVGVSQYSSKRTLSLGDPQSYRIVSEFWQTDNLATYAGLKAIDLFDAMNEGKIKAVWIMATNPVVSLPDSEKIKTALEKCPFVVVSDCIADTETTRLADVVLPAQGWSEKSGTVTNSERRISRQRRVLPSPGEAKPDWWILKEVAQKMGFKDQFDYRHEGQIFKEYCEMTALGNETGKARDLCLIGLTKLDEQGYGELTPQQWPVMEYQPEIIEQRMFTNGEFFTESGKAQFIAVEHDKPIADTSVEFPLIMNTGRIRDQWHT

SEQ ID NO: 13609 - protein, 268 aa, Unknown
  uncultured marine bacterium
QPNAMGGREVGGLANMLAAHMDIENPEHRQWVQEFWNSPTICTQPGLKAIDLFDSMEQGKVKAVWIMATNPLVSMPNRGKIFRALENCDFVVVSDCVEQNDTLALADVKLPATAWSEKEGTVTNSERRISRQRAFKAAPGGAKNDWQIICDVAQKMGYSEGFDFQTPHQIFVEHARLSGVNNFGDRDFDISALADLSLKDYQQLKPVQWPVNQRYPDGCKRLFTDGRFFTPSGKARFIPLHPELPQQQTCRDYPLILNSGRIRDQWHT

SEQ ID NO: 13610 - protein, 265 aa, Gossypium hirsutum
MATSAIQQSAFAGQTALKQSNELVCKIGAVGGGRVSMRRTVKSAPTSIWYGPDRPKYLGPFSDQIPSYLTGEFPGDYGWDTAGLSADPETFAKNRELEVIHCRWAMLGALGCVFPEILSKNGVKFGEAVWFKAGSQIFSEGGLDYLGNPNLIHAQSILAIWACQVVLMGFVEGYRVGGGPLGEGLDPIYPGGAFDPLGLADDPDAFAELKVKEIKNGRLAMFSMFGFFVQAIVTGKGPIENLFDHLADPVANNAWAYATNFVPGK

SEQ ID NO: 13611 - protein, 166 aa, Glycine max
MARRPARCYRYCKNKPYPKSRFNRGVPDPKIRIFDLGRKRANVDDFPLCIHLVSNEYEQLSSEALEAARICANKYLVKNTGKEGFHLRVRAHPFHVVRINKMLSCAGADRLQTGMRGAWGKPNGTVARVNIGQILMSVRTRDANRAIALEALRRSQYKFPGRHKII

SEQ ID NO: 13612 - protein, 259 aa, Unknown
  uncultured marine bacterium
QPNAMGGREVGGLANQLAIHRGFDPDSIRLISEFWQTDNLATRPGLKAIELLEAVERGDIEVIWIMATNPVVSMPDNVFIQRALQKCPLVIVSDVTHDSDITQYADLLLPAAGWGEKQGMVTNSERMLTRQRKFLTSKGEAKPDWKIIAEVGKKLCERLDKPNAFDFKSESSVFREYAAMTGLNKDTPFLLDLSKYAEISDEEYEPWNPVQWGSSRPFAAGKFSTENRKARFVGTTAPLIKGESRLWLNTGRQRDQWHT

SEQ ID NO: 13613 - protein, 105 aa, Candida albicans
MSGTGRGKGGKGLGKGGAKRHRKILRDNIQGITKPAIRRLARRGGVKRISALIYEEVRVVLKQFLENVIRDAVTYTEHAKRKTVTSLDVVYALKRQGRTLYGFGG

SEQ ID NO: 13614 - protein, 323 aa, Unknown
  Pelargonium x hortorum
MENFPVIDMEMLNGEERSAAMNMIKDACENWGFFEIKNHGISHELMDKVERLTKEHYAKFMEQRFKEMVASKGLDATQSEIDDLDWESTFFLRHLPTSNISEIPDLEHDYRLAMKEFAERLEKLAEELLDLLCENLGLEKGYLKKAFYGSKGPTFGTKVSNYPPCPKPELIKGLRAHTDAGGLILLFQDDKVSGLQLLKDGRWIDVPPMRHSIVINLGDQLEVITNGKYKSVMHRVIAQTDGNRMSLASFYNPGSDAVIYPAPALIEEENQNPIYPKFVFEDYMKLYAGLKFQAKEPRFEAMKAMPLPMAMDTTPLQGPVATA

SEQ ID NO: 13615 - protein, 587 aa, Lactobacillus plantarum
MMTKMIAGQALVKVLEAWGVDHIYGIPGGSINHTVEGLYLEKADIDYIQVRHEEVGALAASADAKFTGKIGVSFGSAGPGATHLFNGLYDAKMDHVPVLALVGQVPQATMNTNYFQEMDETPMFSDVAVYNRTVTTAGQLPYVINQAIREAYRQKGPAVVIIPENLSAEEIDYQPVSTPNTVSDTFEQRVDPQAITATLKMLKAAKHPLVYAGRGLLGAKADLVKFSEQFNIPVMNTVPATGVIPTNHPNAIGTFGRLGSKSGFEALQHADLILFLGSEFPFASFWPKGIKIIQVNNNSFDIGKMVPIDYAVISDAQAYLQAMIATGETLPETAWLTTNRQNKRNWDKWLQQLAADDHDGLAPEAVMHKVASMVGPRDTYGVDTGNVSEWAVRGLPMDQEQRFALSGLFATMGFGLPAGMAGALSVPDSQAWSFSGDGGFAMVAPDIITEARYGLPVINVIFSNQRFGFIYREQVDTKQHLYGVDLTDADWAKVADGLGGIGFTVQNNQEVETVFDQIKALQAKGNKRPIVVNAVIKNDDPIGTAYMPLDPELYGQAEVDAYAKANHIDIKEQPSLGALLRAQGDQL

SEQ ID NO: 13616 - protein, 261 aa, Unknown
  uncultured marine bacterium
QPNAMGGREVGGLANQLAVHRTFDAESIKQVQTFWDSPEIATQPGLKAVELFEAVERGEIKVLWIMATNPVVSLPDNQLVKRALEVCPFVIVSDITADSDVAHYADLLLPAAGWGEKQGMVTNSERRLSRQRQFQTPPGEAKSDWWAISQVGQALCTLENTRNGFAFSSERAVLREYAAMAGMNADSPLKLDLSQYANLTEQEYEEWVPTQWGGESPFADGVYSHPDGKARFVVTSESPMRLERTKGWWLNTGRQRDQWHT

SEQ ID NO: 13617 - protein, 369 aa, Zea mays
MATGQEHVAAPAPAVEETPEKKQASTTELPAPSGWTKKLAPTRGGRGGRFEVIFVSPTGEEIKSKRQLTQYLKAHPGGPASSEFDWGTSDTPRRSARLSEKVKATESPEGEKTPKRARSSSKRGKKEEKVDAEDANEAGEDGAAAEGKGTDVEMKDAENAEDEKKDVPSAEKTEEVDDKKDAENVEMKDAAEKTEEVDDKKEEAPAVDAAEKNEEGDDKKEEEPPAEKTVEKEVVPAVDAAENTEQSTGGQAQPNDVGAPESENKGDGKPAESELAPTAFVDEAVPLVIVGEEKTEDSQAAEPTVTSLASSEGEKKENGGATEPAAPPPADADKGAENSGQVNTAPQEPTAANCDKGQIQPGASAVRCT

SEQ ID NO: 13618 - protein, 277 aa, Solanum tuberosum
MFQTLKNDFQICEEIGRGRFGTVYRCFSPATGESYACKSIDKNLLIDSTDRECLDKEPKILQLLSGNPNILHLYKVYEDDDFLHMVTDFCPNSDLYERVSSGSLSESAAAAILTQLVSAISYCHHMGVAHRDIKPDNVLFDSENRLKLADFGSAEWFAGCEGRMMSGVVGTPYYVAPEVLMGKEYNEKVDVWSVGVILYIMLSGVPPFYGETPTETFQAVLRGNLRFPTRNFRSVSPEAKDLLRKMICKDVSRRFSAEQVLRHPWVINGGETRSMAD

SEQ ID NO: 13619 - protein, 259 aa, Unknown
  uncultured marine bacterium
QPNAMGGREVGGLANQAAIHRGFDPDSIKLISEFWQTDNLATRPGLKAIELFEAVERGDIQVIWIMATNPVVSMPDNVFIQRALQKCPLVIVSDVTHDSDITQYADLLLPAAGWGEKQGMVTHSERMLTRQRKFLPSKGEAKPDWQIIAEVGKKLCERLDKPNAFEFKSESSVFREYAAMTGLNKDTPLLLDLSKYAEISDEEYESWNPVQWGSSRPFADGKFSTENRKARVVGTTAPLIKGESSLWLNTGRQGDQWHT

SEQ ID NO: 13620 - protein, 740 aa, Streptomyces antibioticus
MENETHYAEAVIDNGAFGTRTIRFETGRLAKQAAGSAVAYLDDDTMVLSATTASKNPKDQLDFFPLTVDVEERMYAAGKIPGSFFRREGRPSEDAILTCRLIDRPLRPSFKKGLRNEIQVVATIMALNPDHLYDVVAINAASASTQLAGLPFSGPYGGVRVALIRGQWVAFPTHTELEDAVFDMVVAGRVLEDGDVAIMMVEAEATEKTVQLVKDGAEAPTEEVVAAGLDAAKPFIKVLCKAQADLAAKAAKPTGEFPVPSSTTRTTSEALSAAVRPELSAALTIAGKQDREAELDRVKALAAEKLLPEFEGREKEISAAYRPWPSSSSAERVIKEKKRIDGRGVTDIRTLAAEVEAIPRVHGSALFERGETQILGVTTLNMLRMEQQLDTLSPVTRKPYMHNYNFPPISVGETGRVGSPKRREIGHGALAERAIVPVLPTREEFPYAIRQVSEALGSNGSTSMGSVCASTMSLLNAGVPLKAPVAGIAMGLISQEINGETHYVALTDILGAEDAFGDMDFKVAGTKEFVTALQLDTKLDGIPASVLAAALKQARDARLHILDVMMEAIDTPDEMSPNAPRIITVKIPVDKIGEVIGPKRQMINQIQEDTGAEITIEDDGTIYIGAADGPAAEAARATINGIANPTSPEVGERILGSVVKTTTFGAFVSLLPGKDGLLHISQIRKLAGGKRVENVEDVLGVGQKVQVEIAEIDSRGKLSLIPVIEGEEAASDEKKDDAEQ

SEQ ID NO: 13621 - protein, 369 aa, Zoysia japonica
MAAASTPNGDPPVRSLATTVPVQAVLFDIDGTLCDSDPLHHVAFQELLLEIGYNNGVPIGHGFFQVVNHGIDQEPLAEAHRCMDNFFTLPLPEKQRAQRRQGESCGYASSFTGRFACKLPWKETLSFRYSSNPSSPDLVVDYFVEKLGEDYRHHGAVYARYCSEMSRLSLEMMGILGESLGVGRDHFRRFFQPNESIMRLNYYPPCQRPLETLGTGPHCDPTSLTILHQDHVGGLQVFTDGRWRSIRPHAGAFVVNIGDTFTGALQRPVPKLLHRAVVNSLVPRKSLAFFLCPEMDKVVCPPEGLVEAGMPRAYPDFTWRTLLDFTQRRYRADMRTLEVFSNWLRHGQDKTPPTSLIHRSKIVTVHHPS

SEQ ID NO: 13622 - protein, 137 aa, Arabidopsis thaliana
MQEIEHTTDFKNHTLPLARIKKIMKADEDVRMISAEAPVIFAKACEMFILELTLRAWIHTEENKRRTLQKNDIAAAISRTDVFDFLVDIIPRDELKEEGLGVTKGTIPSVVGSPPYYYLQQQGMMQHWPQEQHPDES

SEQ ID NO: 13623 - protein, 279 aa, Brassica napus
  misc_feature (261)..(261): Xaa can be any naturally occurring amino acid
LMLILSVIVFCFWKRRQKQAKSAETPIVKKQVLMNRMVLPRQRNLSGDNQVEDLEVPLIEFEDVLIATEHFSDCNKVGKGGFGVVYKGRLLDGQEIAVKRLSEMSAQGTNEFINEVRLIGRLQHINLVQLLGCCVDEGEKILIYEYLENLSLDSHIFVLSRRCMLNWQMRFDIINGIARGILYLHHDSSIRIIHRDLKASNILLDKDMTPKISDFGMARIFGRDETEANTRKVVGTYGYMSPEYALDGIFSIKSDIYRLQXFGVLLLEIISGQRNKGFY

SEQ ID NO: 13624 - protein, 658 aa, Arabidopsis thaliana
MSSLISFNFLFLFSFLTSSFTASAQDPFYLNHYCPNTTTYSSNSTYSTNLRTLLSSLSSRNASYSTGFQNATAGKAPDRVTGLFLCRGDVSPEVCRNCVAFSVNQTLNLCPKVREAVFYYEQCILRYSHKNILSTAITNEGEFILSNTNTISPNQKQIDGFTSFVSSTMSEAAGKAANSSRKLYTCTPDLTRADCLSCLQSSINGMALSRIGARLYWPSCTARYELYPFYNESAIETPPLPPPPPPPPPRESLVSTPPISSSSLPGKSGNSTVLVVAVVVLAVLLFIALVGYCFLAKKKKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQIQLDWMQRYNIIGGIARGILYLHQDSRLTIIHRDLKASNILLDADINPKIADFGMARIFGLDQTQDNTSRIVGTYGYMAPEYAMHGQFSMKSDVYSFGVLVLEIISGRKNSSFGESDGAQDLLTHAWRLWTNKKALDLVDPLIAENCQNSEVVRCIHIGLLCVQEDPAKRPAISTVFMMLTSNTVTLPVPRQPGFFIQCRAVKDPLDSDQSTTTKSFPASIDDESITDLYPR

SEQ ID NO: 13625 - protein, 168 aa, Triticum aestivum
  misc_feature (23)..(23): Xaa can be any naturally occurring amino acid
  misc_feature (39)..(39): Xaa can be any naturally occurring amino acid
  misc_feature (51)..(51): Xaa can be any naturally occurring amino acid
  misc_feature (107)..(108): Xaa can be any naturally occurring amino acid
  misc_feature (112)..(112): Xaa can be any naturally occurring amino acid
  misc_feature (121)..(121): Xaa can be any naturally occurring amino acid
  misc_feature (123)..(123): Xaa can be any naturally occurring amino acid
  misc_feature (129)..(129): Xaa can be any naturally occurring amino acid
  misc_feature (138)..(138): Xaa can be any naturally occurring amino acid
  misc_feature (142)..(142): Xaa can be any naturally occurring amino acid
  misc_feature (145)..(146): Xaa can be any naturally occurring amino acid
  misc_feature (156)..(157): Xaa can be any naturally occurring amino acid
MPNLECRMYEQRFPEVDAAVMIXVKHIADMGAYVSLLEXYNNVEGMILFSXELSRRRIRSISSLIKVGRQEPAIVLRVDRDKGYIDLSKRRSPRRRRGPCEGQLQQXXSVHXIMRTFPEPXNXLRGIYXRIRWRYTAXTHHXSFXXIVADPSTSIXXKRNGLGKSISP

SEQ ID NO: 13626 - protein, 517 aa, Nicotiana tomentosiformis
MLSPIEAIVGLVTFTFLFYFLWTKKSQKPSKPLPPKIPGGWPVIGHLFHFNDDGDDRPLARKLGDLADKYGPVFTFRLGLPLVLVVSSYEAVKDCFSTNDAIFSNRPAFLYGDYLGYNNAMLFLANYGPYWRKNRKLVIQEVLSASRLEKFKHVRFARIQASIKNLYTRIDGNSSTINLTDWLEELNFGLIVKMIAGKNYESGKGDEQVERFKKAFKDFMILSMEFVLWDAFPIPLFKWVDFQGHVKAMKRTFKDIDSVFQNWLEEHINKREKMEVNAEGNEQDFIDVVLSKMSNEYLGEGYSRDTVIKATVFSLVLDAADTVALHINWGMALLINNQKALTKAQEEIDTKVGKDRWVEESDIKDLVYLQAIVKEVLRLYPPGPLLVPHENVEDCVVSGYHIPKGTRLFANVMKLQRDPKLWSDPDTFDPERFIATDIDFRGQYYKYIPFGSGRRSCPGMTYALQVEHLTMAHLIQGFNYRTPNDEPLDMKEGAGITIRKVNPVELIIAPRLAPELY

SEQ ID NO: 13627 - protein, 950 aa, Unknown
  Azoarcus sp. EbN1
MNAPTNPVRFELDGREIDAQPGETILLAARRAGVDIPHLCYTDGMRADGNCRACVVEIDGERVLAPSCCRAPKPGMKVKATSERARASQRLVLELLRADVPAAAEKPDSELAHWCDELGVTDSRFAPRAQPQPDRSHPGIAVDLAACIQCTRCVRACREVQVNDVIGLARRGADTAIVFDFDDAMGTSSCVGCGECVQACPTGALLPAALADFPGTSADAAVPRPGGPFAAKPEAGALPVEPAAPLAKPAMRAIDSLCPYCGVGCQMTYHVAGDGPAAKIVHVEGRDGPANAGRLCVKGRYGFGYPRHAHRLTTPLIRKPGIPKAVDLDPSNPLAAFREATWDEALDFAAAGLARIKAAHGPHALAGFGSAKGSNEEAYLFQKLVRVGFGTHNVDHCTRLCHASSVAALLEGIGSGAVSNPVRDVEFADVIVVIGANPASNHPVAASFMKNAVERGAKLVLMDPRETPLARHAHRFLQFRPDADVTLLLSLACVIIDEGLTDDAFIAARTTGFDAFRTAALAFPPERVEAITGIPAETVREVARLYARSPNSMIFWGMGISQHIHGTDNSRCLIALALMTGQIGRRGTGLHPLRGQNNVQGASDAGLIPMMFPDYQHVADPAVRAKFETLWGTKLSDRPGLTVVEIMDAALAGDIRGMYIEGENPAMSDPDLAHARAALAGLDHLVVQDLFLTETAMLADVILPASSLMEKTGSFTNTDRLVQLSQPVLPLPGDARPDWWIIQSIAQRLGLAWDYAGPAEIFDELRRALPSYAGITWAALETEGAVVAPKFAEDEPSQPVLFEADFPTPSGRARFVAVGPLPAAELPDADYPMVLTTGRVLEHWHTGSMTRRADVLDALEPLPWCSVHPDDLAAQAIESGARVRLETRRGAIVLEARADEAVQRGSVFMPFCYVEAAANLLTQPALDPFGKIPEFKYCAVKLSAESRAQA

SEQ ID NO: 13628 - protein, 552 aa, Gibberella zeae
MTEPENFEDDLFADLYDDNDAPKPAPAAPVAAPAAPPAPEVQPPTNNTHDNDDHNATYQHQDVAGDEYMTQDQDDDDDDVDFNLGGGGGGYGSHTGQAGMHDDDQAPPYGTVHKASAKEDGKMFIGGLNWETTDQSLRDYFAQFGEVVECTVMRDSSTGRSRGFGFLTFKDAKTVNIVMVKEHFLDGKILILLQIDPKRAIPRDEQEKTSKIFVGGVSQETTDQEFKEYFAQFGRVVDATLMMDKDTGRPRGFGFVTFENEAGVDACINVPLEIHGKPIEVKKAQPRGNLREEEEASRRGKFRKDGDQSNQGSMGQQMGNNNGMTPQVMAQYFQRMQQYFTMMQSQMAMSRGMPMNPAMWQNMMQMQQMQQQMMGGRGGGANAQNMMQNMNPQMAQQMQQQMQQMMQQQGQQGGQDAGSGSASPTASTNGGAGRGYDNNNNFNQYQQQQPQGGRRGGRGGYGGHGGGHGGYNMGGGGGAPTSWEGMYDDVPQPNPNQGPGSFNRAGSVGGSSDPQHAPPANAPTGPKNAGKPGANYRGGGRGGNRGFHPYSR

SEQ ID NO: 13629 - protein, 500 aa, Xanthomonas axonopodis
MMSEEILVNVTPRETRVAVIENGMLQELHIERGWRRGVVGNIYKGKVQRVMPGMQAAFVEVGLERAAFLHANDVVRLAPAPASVVDTEETPIPPPPPASVPIVELLRDGQEIVVQVVKDPIGTKGARLTTQISIPSRYLVLLPQSKVVGVSARIEDEAERLRLKTIVSEVSAQHGGFGYIIRTNAEGQPAEALAEDIAYLSRVWNVVERRGREAPPCSIIYEDLSLPLRAVRDLIRRDVEKVKVDSNETFVQLQAFVAKYMPVLAERLELYTGDRPIFDLYGVEDEIGRALNKQVPLKSGGYLVIDQTEAMTTIDVNTGSFVGQRNLEETVFRTNLEAAQAVARQLRLRNLGGIIIIDFIDMDDSEHRRQVLRTLEKALARDHAKTTVYEFSPLGLVEMTRKRTVESLERQLSETCGQCGGRGTIKTAETVTYEIFREITRAVRQFDAARLLVIASSKVVARITDEESAAVAELEEFLGKSIRFQSDDQYLQEQFDVVLL

SEQ ID NO: 13630 - protein, 549 aa, Unknown
  Malus x domestica
MWDLNDSPDQRPRGEESEGCSSQKTSADGDEEKRKRVGSVSNSSSSAVVIEEDGSDQEEDQDDGPTKLAKKQGGGGGKIFGFSVAHEESMDSDPPATVTRQFFPVELDYSSSSNLDVMGPAEGGGSIPPPPSTSSSFPRAHWVGVNFGQSDSGSPGNPPPAGEASHQPMKKSRRGPRSRNSQYRGVTFYRRTGRWESHIWDCGKQVYLGGFDTAHAAARAYDRAAIEFRGVEADINFSIEDYEEDLKQMRNLTKEEFVHVLRRQSTGFPRGSSKYRGVTLHKCGRWEARMGQFLGKTYVYLGLFDTEVDAARAYDKAAIKCNGKEAVTNFDPSIYDNELNSSESSGVIAADHNLDLSLGSTNSKKNNQALGNDHHSQNVAMEHQHSVSMQLDANWRSQGLRPKLNIQRDRSRDDIDAQRRDGYSESEAMQLLLRTNLQSQAPAEVHKYGQFNRRLTAGDIQMSHNFPPNFNSPNYHHIQFPSSSEGGGRIGSDLSLSTSDHQQQWQSATPTSNLFATAAASSGFPPQLRPLPTQNSWLQKNGFHTLARR

SEQ ID NO: 13631 - protein, 389 aa, Unknown
  Shewanella sp. MR-7
MEKAIRNFLSQESAGGILLLVAVALAMLMANSPLAGLYQGFLGTEVQVRVGALDLHKPLLLWINDGLMALFFLLIGLEVKRELLEGALSSVAQASLPTFAAIGGMLVPAGIYLLFNYGDPVTQAGWAIPAATDIAFALGIMALLGSRVPVALKVFLLALAIIDDLGVIVIIALFYSTDLSTISLIIASIAIVGLVALNRKGVTALAPYGVLGLVLWVAVLKSGVHATLAGVIIAFCIPLRAKDGSSPSEHLEHSLHPWSTFLILPVFAFANAGVALGNMSLNTLISPVPVGIALGLMLGKPIGVMLFSYAAVKLRLAQLPNGIGWKQIAPVAAMCGIGFTMSMFIASLAFEQADPMYGDLARLGTLIGSIIAALIGYFWLSKVLPKQGV

SEQ ID NO: 13632 - protein, 442 aa, Mycobacterium avium
MPALLWFRRDLRLHDHPALSAAADSDEVLACFVLDPRLQRSSGPRRLQFLGDSLRVLRDELDGRLLVTRGRPDIRIPEIAKAIGASSVHVSEDFTPFGKRRDARVRAALASVPLVATGSPYLVPPGRVTKPDGSPYQVFTPFLRRWRDTGWRPPAKTGAASARWLDPARLGITACEIPDPGATLDLAAGEAAARNQWKSFVDNGLANYADDRHRPDIEGTSRMSAHLKFGTIHPRTLVADLDLRTAGARAYLRELAFRDFYADVLHHRPASAWRNWNSAFDAIRTDTGDEAGRRFEAWKAGETGFPFVDAGMRQLRQTGFMHNRVRMTVASFLVKDLHLPWQWGAHWFLQQLVDGDLANNQHGWQWCAGCGTDAAPYFRVFNPAAQGEKFDPSGDYIRRWVPELRCADDPHLRTGERPPGYPAPIVDHATERAEALRRYRSM

SEQ ID NO: 13633 - protein, 431 aa, Escherichia coli
MVSLEKNDHLMLARQLPLKSVALILAGGRGTRLKDLTNKRAKPTVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 13634 - protein, 603 aa, Achromobacter xylosoxidans
MAATDNRKVVEGVHKMTPSEAFVETCVANGVSEMFGIMGSAFMDAMDIFAPAGIRLIPVVHEQGAAHMADGYARVSGRHGVVIGQNGPGISNCVTGIAAAYWAHSPVVIVTPETGTMGMGLGGFQEANQLPMFQEFTKYQGHVCNPKRMAEFTGRVFDRAMSEMGPTQLNIPRDYFYGEIECEIPKPMRVDRGHGGEASLQAAVELLKTAKFPVILAGGGVVMGDAVEEAKQLAERLGAPVATGYLRNDAFPAKHPLWAGPLGYQGSKAAMKLIAQADVVIALGSRMGPFGTLPQHGMDYWPKAAKIIQIEADHTNLGLVKKIAVGINGDAKAVAAELSRRLADVTLGCDATKAARADTIATEKAAWEKELDGWTHERDPYSLDMIEEAKGERTPTGGSYLHPRQVLRELEKAMPARVMVSTDIGNINSVANSYLRFDEPRSFFAPMSFGNCGYALPTIIGAKCAAPDRPAIAYAGDGAWGMSMMEIMTAVRHDIPVTAVVFHNRQWGAEKKNQVDFYNRRFVAGELESESFSDIAKAMGAEGIVVDHIEDVGPALQKAIDMQMKEGKTCVIEIMCTRELGDPFRRDALSKPVRMLDKYKDYV

SEQ ID NO: 13635 - protein, 159 aa, Coprinopsis cinerea
MPRSAETASFKVIGMDLLSGECPPDKISLMISHLTRVTVKKFDDFTLYFLAFNHEGRDLSPEEKEASRFAREGVLELTHNHGTENDPEFKGYASGNSDPGRGFGHIALAVDDVEKACARFEQLGVHFKKKPSDGKMRHIAFILDPDGYWIEIVPNKLTL

SEQ ID NO: 13636 - protein, 956 aa, Unknown
  marine gamma proteobacterium HTCC2143
MPKSSAYSGFVSNMKRMLINATQPEELRVGLVDGQRLYDLDIENRTRVQMKDNIYKGTITRVEPSLEAAFIDFGADRHGFLPLKEISRDYFYRQPSDVQGRFKIRDVVKEGTEVIVQVDKEERGNKGAALTTFISLAGRYLVLMPNNPRAGGISRSIEGEERSDLKDALNNMAIPKGMGAIVRTAAVGRSAEELQWDLDYQAQIWDAIKKAAEDQPAPLLLLQDSNVIIRAIRDYLREDIDQVLIDAEEAYTDAMNFVTRIMPHYESRIRLYQDPVPLFNRYQIESQIETAFQRDVDLPSGGSIVIDPTEALVSIDINSARATKGGNIEETALQTNLEAADEIARQLRLRDMGGLIVIDFIDMSAAKNQRAVENRMRDALNIDRARVQVGRISRFGLLEMSRQRLRPSLGETSAKVCPRCTGQGTIRDTKSLSLSILRLVEESASKERSAEIRALVPVNVASYLLNEKRQPIHDIELRTGVRVVIAPIPQLETPHFELQRLRDDEIGKDVEISYKMQTEIADETSIQVQQKAAAPQQAAVQSIAPPAPAPLAAAKANIAPDTATKSPGLLSKIIGFFTGGDKDDEKKDEQKKPEKRESTNRRPQNRGGQQNNNRNRNRNRNKSRNESRNESNDRNEGNDRGTKDGNRNAAPQQKKTHDKVEPREAPAANESHEDKPQRRPSNRRPRSSQRRRNRGPNTENNEIENTSNELPKTPEAVNNGQDLQQLEPAIDHPVVAPIAAVSEVAEVSEVSAVAEVAEVAQVAEVAEVSEVVEVAEVAEVTEISEVAEVAEVIVAPVTEVELIVESTPETVIVDQQETPASDEILEPDTTAEAPSVDNAVVETEMEPLEAAIANTASSAIAEPPVEEEAVVTDNAANTALTEAPTESGTAEASPTSAEAPVGRASNDPRLTPKTIDAVEIETEHLDTIPKAPAAAAEPDSEKAAPSRAPNDPRHKR

SEQ ID NO: 13637 - protein, 396 aa, Unknown
  Synechococcus sp. CC9605
MRVSNAATEHCNEALFTVVASGPHVGSQPSVVQTYTVGMNQFSALFKRLGASGAKILSVNGVEVERQASPVATTPAPAKKTAKKPAKKAVTSTAPKKKPHADVPVNTYKPKTPFMGTVTGNYSLLKDGAIGRVQHITFDLAGGEPQLKYIEGQSIGIIPEGEDANGKPHKLRLYSIASTRHGDNLEGNTVSLCVRQLEYKNDAGEQIYGVCSTYLCDIEPGTKVKITGPVGKEMLLPDDEDANIIMLATGTGIAPMRTYLRRMFEPREQEANGYKFRGKAWLFMGAPKTANLLYDEDFLHYEKEYPDNFRYTKAISREQQNAKGGRMYIQDRVLEHAEEIFAMIEDPKTHVYMCGLRGMEPGIDEAMTAAAAAKGLDWAELRPQLKKADRWHVETY

SEQ ID NO: 13638 - protein, 372 aa, Cytophaga hutchinsonii
MKKKALFIDRDGTIITEPADEQIDSLEKLVFLPRVLTALSKIAVETDYELVMVTNQDGLGTNSFPEETFWPAQNKMLKTLEGEGIVFKRIHVDRSFPKDNLPTRKPGIGMLTEYMNGTYDLENSFVIGDRVTDVQLAKNLGTKAIYITPSTKALDWGLGELKYALATDDWMEIYKFLVKSERIARVNRKTNETDITIYLDLDGEGKGVMNTGLGFFDHMLDQLCKHSGIDLSVEVKGDLHIDEHHTIEDTALALGEAFLLALGSKRGIDRYGFLLPMDEALAQVAIDFSGRSWLVWDAEYKREKIGDMPTEMFFHFFKSFCDTAKCNLNIKVEGDNEHHKIEATFKAFAKAIKAAIRKDPANTRIPSTKGVL

SEQ ID NO: 13639 - protein, 201 aa, Hyphomonas neptunium
MRLAILALAAPFLAAACAEATAGQPTANAPAAPTEFQAEEPAPAMSATQFTSITGQPLDLTALGAKAILVVNTASRCGYTPQYAGLQKLYEANKADGLVIVGVPSNDFGGQEPGTEEDVKSFCEINYGVTFPLTKKYAVTGASQHPFYTGAIKTLGDPALPKWNFHKILVSADGTPLKAYASSVKPDDSGLAADIEAALGI

SEQ ID NO: 13640 - protein, 280 aa, Unknown
  Synechococcus sp. CC9605
MSSWIDEEHRGVRYGLRGEVLVEETSPFQRISVIRSERYGRGLLLDGCWMTAEQQERHYHEALVHPALCSASSIARILVIGGGDGGTARECLRHPDVQWLDMVEIDGRVVELSQEHLPDIGGSAWSDPRFQLTVGDGIAWAAQADDQSYDVVLVDGSDPAGPAEGLFNRAFFENCRRLLKPGGVFGTQSESPEAFRDVHIAMVRLLREVFDHADPLYGWVPMYPSGWWSWTFAAMGTPRYCTPDLERSQAIAAGCEIWSPRWQRGAMDAIPAFIERELQS

SEQ ID NO: 13641 - protein, 633 aa, Arabidopsis thaliana
MSYYSSFFFLFLFSFLTSFRVSAQDPTYVYHTCQNTANYTSNSTYNNNLKTLLASLSSRNASYSTGFQNATVGQAPDRVTGLFNCRGDVSTEVCRRCVSFAVNDTLTRCPNQKEATLYYDECVLRYSNQNILSTLITTGGVILVNTRNVTSNQLDLLSDLVLPTLNQAATVALNSSKKFGTRKNNFTALQSFYGLVQCTPDLTRQDCSRCLQLVINQIPTDRIGARIINPSCTSRYEIYAFYTESAVPPPPPPPSISTPPVSAPPRSGQSSVFFLSCFSCFKDFHCVTGDDITTADSLQLDYRTIQTATDDFVESNKIGQGGFGEVYKGTLSDGTEVAVKRLSKSSGQGEVEFKNEVVLVAKLQHRNLVRLLGFCLDGEERVLVYEYVPNKSLDYFLFDPAKKGQLDWTRRYKIIGGVARGILYLHQDSRLTIIHRDLKASNILLDADMNPKIADFGMARIFGLDQTEENTSRIVGTYGYMSPEYAMHGQYSMKSDVYSFGVLVLEIISGKKNSSFYQTDGAHDLVSYAWGLWSNGRPLELVDPAIVENCQRNEVVRCVHIGLLCVQEDPAERPTLSTIVLMLTSNTVTLPVPRQPGLFFQSRIGKDPLDTDTTSKSLLGSVDDASITDIHPR

SEQ ID NO: 13642 - protein, 281 aa, Parvularcula bermudensis
MTRRFTLAAVQYAPGLAADPLGAAEAWIRRAAESGARLILLPELFAGPYFCKTQEEPHFRTAHPLTAHPVLARLAPLAKALNVTLPLSLFEREGPHHYNTVVVIGPDGQQKGHYRKSHIPDGPGYQEKYYFRPGNTGFRTWAVEDASFGVGICWDQWFPEAARAMALQGAEFLLYPTAIGAEPQDPTLDTAMRWRRAMQGHAVANAMPVVAVNRIGDEEGQRFYGTSFICDQSGDIVAELGREEEGVISASFDLDALAEERAAWGFFRDRRPDLYHALCEA

SEQ ID NO: 13643 - protein, 747 aa, Oryza sativa
MEMEMEDNKAPSPPSPMESDVAEEKRKREDDASSSAVLAAANNTGGAQHPMWKTSLCSFFRRRAASSADGCSHGDSCRYAHSEEELRPRPDGTWDPTSDRAKKLRKVAADEVEEEVVTIDDKALDKCLVGLPRGWANDRLKTFLQDKARTNYSSILPPALLLGISYATAKKKKGMTVGFVTFENIEQLKNAIEVLTENQSGGKEIKIADANRRSHQKLHTEKPVSDNGVTTENGTSVDVPPGETSAPEAAISNKKSVRDAVTPLAHMSYNDQLEHKNNSVAQILKRLTRNARKACPTGIPLPDWVFKSKEIGGLPCKLEGILESPVINGYRNKCEFSVGFSLEGKKTVREGRCRAQAVAQNAETQISEVMLIVQVCSTGVDDAVMKDEFDKLTVALQQGAATCSPPLPLTTIVVQDHKGISNAAPADCPLIPLLVPKVDQSEGTVDKTRIHDHIGNLWFSISPTAFFQVNTLAAERLYTLAGDWANLNSGTLLFDVCCGTGTIGLTLAHRVGMVVGIEMNESAVSDAERNALINGVSNCRFVCGKAEDVMGSLLTEYLGSPQQDIPVSEGAVSGTVKDEEVIDSSKNSGENLDSSMQKNDNGKSQQLGDAPADSSSSAIDEIKGNSNDRVGNGLEGSHDEYNEVAGEDIHGEASLINESVDLKVSDCLEDRKTSDDGSSISNNDVTAATACQFEDIVAIVDPPRVGLHPTDQAYTLNLIGDQGIEDSSTNSTSSVNPKRGQGVPVFI

SEQ ID NO: 13644 - protein, 400 aa, Deinococcus radiodurans
MTLIESSREPGDKLAVLSCRCDKSVTVHRVHWAHQRNHNQAGRVKFAAPGGRFLGGWPFFFGLEQFSELRRRRNSTATRSILRPARWFALAPLAKKRCTLFVKCSRVQSPGPALFMVGVMNTQQGAQDLTGRRILITGATGGIGLETARELAGRGAQVVIVGRDPGRTARVAAEVGAAGTLLADLSELVQVERAAAEYRERFGELDVLVNNAGALHRERQESREGIELTWALNHLAPFLLTRELLPLLRRSSETRRVPARVVTVASAAHVVGRIRFDDPEFRRGYAAWPAYAQSKLANILFARELARREPSVLSVSLHPGMVASGFGKNGGGRFAQAYGLLDRFSLTPEQGAQTSLHAVSAPVHTGGYYANARRVTPAPQALDDGAAARLWALSEGYLQV

SEQ ID NO: 13645 - protein, 894 aa, Tilia platyphyllos
  misc_feature (342)..(342): Xaa can be any naturally occurring amino acid
  misc_feature (380)..(380): Xaa can be any naturally occurring amino acid
  misc_feature (444)..(444): Xaa can be any naturally occurring amino acid
MAASVDNRKFRRLEPALNGVFTPLKPGPTLTHRPVKHVFVDHAYDSSSEDEENEINLYKNMIIKSNNELEPSILDTRDEATADNWIERNPSMVRLTGKHPFNSEAPLNRLMHHGFITPVPLHYVRNHGPVPKASWDDWTVEVTGLVKKPMKLTMVQLVNEFQSREFPVTLVCAGNRRKEQNMIKKTIGSNWGAAGISTSVWRGVLLCDVLKRCGIFSKKHRALNVCFEGAEDLPGGGGPKYGTSIKKEFAMDPSRDIILAYMQNGERLAPDHGFPVRMIIPGFIGGRMVKWLKRIIVTTKESESYYHYKDNRVLPSHVDAELANAEAWWYKPEYIINELNIXSVITMPCHDEILPINSWTTQMPYTLRGYAYSGGGKKVXRVEVTMDDGETWQVCTLDHPEKPNKYGNFWCWCFWSLEVEVLDLLGAKEISVRAWDETLNTQPXKLIWNVMGMMNNCWFRIKTNVCKPHKGEIGIVFEHPTLPGNQSGGWMTKARHLEKSIDANPTLKKSVSSPFMNTDSKTFSMSEVRKHNSADSAWIVVHGNIYDCTRFLKDHPGGADSILINAGTDCTEEFDAIHSDKAKKLLEDYRVGELITTGYASDSSMSSPNNSVHGASNMSFLAPIKEDAPTRPVALVPREKIPCKLVEKTSISHDVRLFRFALPSDDQVLGLPVGKHIFLCVTIDDKLCMRAYTPTSTIDEVDHFDLVVKVYFKGVHPKFPNGGLMSQYLDSLPLGSLLDVKGPLGHIEYTGRGNFSVHGKPKFAKKLAMLAGGTGITPIYQVIQAILKDPEDETEMYVVYANRTEDDILLKEELDGWAKKHDRLKVWYVVQESTRKGWEYSLGFITERILRDHIPEGSKDTLALACGPPPMIQFAVQPKLEKMNYDVKDSLLVF

SEQ ID NO: 13646 - protein, 416 aa, Unknown
  Azoarcus sp. EbN1
MNAPVEHAIAKQHLIDPEICIRCNTCEETCPIDAITHDNLNYVVNFDICNGCLACVPPCPTGAIDSWRNVERAKPYSLEEQFKWDVLPDTTELDNVDAPFAVARPDDELPAEVQHITEVATAGQGGPALAPWSASHPYVNLYAPTRPITATVTGNYRLTDADASSDIHHVVLDFGSTPFPVLEGQSIGIIPPGTDDKGRPHLLRMYSVASPRNGERPHYNNLALTVKRVTEDHEGKAARGVASNYVCDLKKGDKVQVTGPYGSTYLMPNHPASSIMMICTGTGSAPMRAMTERRRRRIAQNEGGELVLFFGARAPSELPYFGPLQKLPKDFIDINFAFSRVPGEPKKYVQDSIRERADKVFRMLNDDNCYIYICGLKGMESGVLEAFRDICRANGADWEALQPKLLANARFHVETY

SEQ ID NO: 13647 - protein, 536 aa, Nocardia farcinica
MAELLIGGVVMLIVIAGAATVGPKLGVAAPLILVAVGIVGSVVPFVPEVEIDPEWVLEGLLPPLLYSSAVAMPTMNFRRDFGAIGGLSVVLVVLTAVTLGVFFAWAIPGLSLAWGIALGAVISPTDAVATSIIRQAPVPRRVVAILDGESLLNDATALVLLRTAIAATAAAFSFGAAVGTFAWSVLVAVVVGGVVGWANLAVRHRVADATVNTVISFTVPFVASVPTELLGGSGLVAAVVAGIVTGYRAPRMLSARHRLSDSQNWRTIEVVLEGIVFLTMGLHLSGIVAEVHREHAGIGSALLVAVGALVLGLLVRAGYVGLLLAALAHRARRSVALQPRIRQFGERLARRVAEGEPAGRSIPERRVRRAGSRVRRALADIDYFLAQPLGPREGFVVVWAGMRGAITVAAAQTLPADTPNRPLLIFVAFAVATLSLLCQGATVGPLVRRLLGPARPGDDLRDERASVLELLRTVSAGVPRDPSASPKQHRLAVLSAQRAAILDARDDGAFDAEVLQAALSNIDAAQIALEMRGGPV

SEQ ID NO: 13648 - protein, 331 aa, Gibberella zeae
MGIVDQPQSKGQESTPGDFAAVQKSIIDLLNQPDYDDGSAGPVLVRLAWHSSGTYDKVTDTGGSNGAGMRYEAEGGDPANAGLQNARVFLEPVKRLHPWITYSDLWTLAGVTAIHAMGGPEIDWLPGRTDFVDDSKLPPRGRLPDAAQGAEHIRHIFYRMGFNDREIVALSGAHNLGRCHTANSGFEGKWVNNPTRFSNQYFRLLLSETWTEKTIPESGLLQFSSVDQDTEEELMMLPTDIALTTDSEFSKYVQLYAKDKDVFFQDFKKAFAKLLELGIARNSEGKVINTDNQKGGYRSAPKKSDSTPATSGQPGASKTGGCPVMHHKAKL

SEQ ID NO: 13649 - protein, 496 aa, Hordeum vulgare
MDRARNFMPGPNQELLDAKPLRSLAPMFPAPMGVNINQSSTPPLVVVTPVGQFPTGFGAGSLPAFGPFASFSATANTFSPAGTSANVPIDVTPVSAYKTRPSGVTPLNDDDEPYSVAQTSASERKAKRPAGLAADGSNGVKFKHPKPIYKNHVAGKLLAFLPTSYSTPREAVEAVHMTFEALRRRHLQMDETQDVSRRADLKAGAIMMASEIRANAGKRVGTAPGVEIGDIFYFRMELCIIGLHAPSMGGIDYMSAKFGNGEDSVAICIVAAGGYENDDDDTDTLVYSGSGGNSRITEERHDQKLERGNLALERSLHRKNEIRVVRGFKDPAALAGKIYIYDGLYRIQESWKERTKFGINCFKYRLQREPGQRDGAAIWKRTQRWIQNASTRGTVIQHDLSSGAETFPVCVVNEVEHEKGPGHFTYTTQVKYPRPLSSMKALQGCGCQSVCLPGDANCACGQHNGGDLPYSSAGVLVCRKPVIYECGEACMPAGRL

SEQ ID NO: 13650 - protein, 205 aa, Unknown
  Halobacterium sp. NRC-1
MTEDSHDLVIAGSGIAGLSAAVYAARADLEPLVLEGDEPGGQLTLTTDVENYLGFPDGVGGMDLVQRGKEQAEQFGAQFEHGRIEAADLDGQPLELSLSTGDTLYTRSLIVATGASARWVGAENEDELMGAGLSTCATCDGAFHRGDDVLVVGGGDSAMEEALFLAKFADSVTVVHRREELRASEIMADRARDHDDVQFRWNTEL

SEQ ID NO: 13651 - protein, 166 aa, Oryza sativa
  misc_feature (160)..(160): Xaa can be any naturally occurring amino acid
TRLKSKELTRRRRRSLAFSAAPSSPPSLSMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRXIRGERA

SEQ ID NO: 13652 - protein, 783 aa, Cryptococcus neoformans
MTTNLYAIAGPSKPTTPTSTPSPRSEPPSPLKSLTSLPTNPLNSHGTSTPNTLTNQLSSTGIGISKPGLSVDENGEVMKVPAFLNKLYTMVSDPEVDDLIYWGESGDSFFVPNAELFGRELLPRWFKHSNFSSFVRQLNMYGFHKVPHLQSGALKNETPIELWEFANPYFKRGQPQLLTKVTRKNNRPSNSGVGPSSSVGGSGAGGGMSTRSASAAAASGSASGQIQQAISQGHEAGNHSTSGKYLITDGTTPGSVPPSHTSAGPLIAPQTLDLSAINSGIAAIRQTQASIATDLRKLQASNEALWRQAYETQEKQRKHEETIDLIVSFLERLFGTEGEGLKGLKEAMRRGVGVRRDRDGREGRDSRDSRFAEDDDGGQKKRRRVGIDRMIEGGTGDGTGEHGEIESPTSDDRLVEIGSNSEYSIPSVKRTSSSSHPISLGQLGSSRFTALPSEDPSPSASGPGSTSYEGLHTTQTNARGAGADVNVTDPTLGMNHLSPLSDTDPLLPSSSNALAPYSSHLPFPSSNSNQSNSFNPSNPSSAWASNPSQPLLSPTSAAAAAHAYNLDPSLLQTTIGSLLQSPAAAQMFLNSLSASAQGQALASHSHPHNPSPLNPNPNGNASTSASASAHGMNTGGMGTGSGTKDVDPTLALFSPLPSHSSLTSQSNDLLKSYSDALTVGEGVDNLQESIDSLVRSMGLDLPNGGSSVGVDVGDGAGVGTETGEGDGEFNVDEFLQGLAKEGEEEGEREVEGDGGVSSSGAGAGAENGRKEDVIAQSGLKSES

SEQ ID NO: 13653 - protein, 85 aa, Triticum aestivum
  misc_feature (9)..(9): Xaa can be any naturally occurring amino acid
  misc_feature (17)..(17): Xaa can be any naturally occurring amino acid
  misc_feature (22)..(22): Xaa can be any naturally occurring amino acid
  misc_feature (42)..(42): Xaa can be any naturally occurring amino acid
  misc_feature (71)..(71): Xaa can be any naturally occurring amino acid
  misc_feature (74)..(75): Xaa can be any naturally occurring amino acid
TKPIVSELXNKDFDSYXLSESXLVIYSQKIVIKTCGTTMLLXTIPRILELAEELCMPLAAASTRGMVIFPXHSXXHRSFSEEGDA

SEQ ID NO: 13654 - protein, 412 aa, Clostridium thermocellum
MFNLNEISKIDPEVAKAIELEVNRQRNKIELIASENFVSKAVIEAMGTPLTNKYAEGYPGKRYYGGCEFVDIIENLAIERAKKIFGAEHANVQPHSGAQANMAVFFAVLNPGDTILGMNLSHGGHLSHGSPVNMSGKYYNVISYGVRKEDCRIDYDEVRKLAKEHRPKLIVAGASAYPRIIDFKAFRDIADEVGAYLMVDIAHIAGLVAAGLHPNPVPYAHFVTTTTHKTLRGPRGGLILCGNEHAKMIDKAVFPGIQGGPLMHVIAAKAVSFAEVLTDEFKQYQQQIVKNAKTLANALMEKGIDLVSGGTDNHLMLVDLRNKGLTGKYVQHILDEVCITVNKNGIPFDPESPFVTSGIRIGTPAVTARGMKEEDMVEIADLINLTITDYENSKEKVKERVRMLCEKYPLYQ

SEQ ID NO: 13655 - protein, 248 aa, Hordeum vulgare
AFGDGMGWDDEDELDQQSMDASSLGVSASLENAAVGAPGGGGGGGNGKGKKKGMPAKNLMAERRRRKKLNDRLYMLRSVVPKISKMDRASILGDAIDYLKELLQRISDLHSELESAPSSAALGGPSTANTFLPSTPTLQPFPGRIKEERCPPAPFPSPSGQQATVEVRMREGQAVNIHMFCARRPGILLSTMRALDSLGLDIEQAVISCFDGFAMDVFRAEQCREGPGLLPEEIKAVLLHCAGLQNAM

SEQ ID NO: 13656 - protein, 298 aa, Ustilago maydis
MRFYKKELPDVDEVVMCQVQQIAEMGAYVKLLEYDGAEGMILLSELSRRRIRSIQKLIRVGRNEVVVVLRVDKEKGYIDLSKRRVSPEDVIKCEEQFTKSKAVHSIIAHVAGKLSREVEELYDTIVFPLHEKYGHAFDAFKLAILDMDKTFEGIQMDDDVRKELYANIARRMTPQPVKIRADVEVTCFGYEGIDAVKKALRAGEAVSTEAIPIKIKLVAPPLYVLITNSTDKVGGIALMEQALEKITESIRANGGDVDIKMKPKTVSEVEDQELEQLMAHFEKQNAEVEGDEDSEGDD

SEQ ID NO: 13657 - protein, 192 aa, Hordeum vulgare
KNLMAERRRRKKLNDRLYMLRSVVPKISKMDRASILGDAIDYLKELLQRISDLHSELESAPSSAALGGPSTANTFLPSTPTLQPFPGRIKEERCPPAPFPSPSGQQATVEVRMREGQAVNIHMFCARRPGILLSTMRALDSLGLDIEQAVISCFDGFAMDVFRAEQCREGPGLLPEEIKAVLLHCAGLQNAM

SEQ ID NO: 13658 - protein, 419 aa, Sulfolobus solfataricus
MEELLTSNLLVQQVKKLYKVGELLGLDSETIDVLSQPERVMQVKIQIRSSDGKLRTFIGWRSQHNSALGPYKGGVRYGPNVTQDEVIALSMIMTWKNSLLLLPYGGGKGGIRVDPKKLTLKELEDLSRKYVQLIHKYLGSDVDIPAPDINTNPQTMAWFLDEYIKITGKVDFAVFTGKPSELGGIGVRLYSTGLGVATIARDAANKFIGGIEGSRVIIQGFGNVGFFTAKFLSEMGAKIIGVSDIGGGVINENGIDVNRALEVVQSTGSVVNYLEGKKVTNEELLISDCDILIPAAVENVINKFNAPKVRAKLIVEGANGPLTADADEIMKQRGVIVIPDILANAGGVVGSYVEWANNRSGGIISDEEAKKLIVDRMINAFNTLYDFHKRKFADQDLRTVAMALAVDRVVGAMKARGLL

SEQ ID NO: 13659 - protein, 376 aa, Burkholderia pseudomallei
MAKRDYYEVLGVAKNASDDEIKKAYRKLAMKYHPDRNPDSKDAEEHFKEAKEAYEMLSDGQKRAAYDQYGHAGVDPNVGAAGAQGFGGFADAFGDIFGDIFGQAAGGGRARGGPQVYRGADLRYSMEITLEQAAHGYDTQIRVPSWAACGVCHGSGAKPGTKPETCPTCHGQGTVRMSQGFFSIQQTCPKCHGTGTYIPEPCVHCHGSGKVKETKTLEVKIPAGIDDGMRIRSAGNGEPGINGGPSGDLYVEIHIKPHAVFERDGDDLHCQMPIPFTTAALGGEIEVPTLAGRASFTVPEGTQSGKTFRLRGKGIKGLRSSIAGDLYVHVQVETPVKLTDQQRDLLKQFEKSLAEGGPRHSPQSKSWFDRVKSFFE

SEQ ID NO: 13660 - protein, 436 aa, Unknown
  Erythrobacter sp. NAP1
MSTQPNHTTDPMHGFWHDNLATSDPEIADAIDKELKRQQDKIELIASENIASKAVLEATGSVFTNKYAEGYPGKRYYGGCDYADVVETLAIERAKQLFGCNFANVQPNSGSQMNQAVFLGLLQPGDTFMGLDLNSGGHLTHGSPVNMSGKWFNPVSYGVTEGDELIDMDAVAATAREHKPKLIICGGTAYSRVWDFAAFREIADEVGAVLLCDMSHISGLVAGGAHPSPFPHCDIVTSTTHKSLRGPRSGIILWNDEKFTKPLNMAVFPGLQGGPLMHVIAAKAVAFREALQPEFKTYAHRIVENARALAASLEENGLRIVSGGTDNHSMLVDLTAKDVTGRAAEAGLDRAWLTCNKNGIPFDTRSPFVTSGIRLGTPAGTTRGFGPVEFRKVGELIARVVDGLSKNGPEGDAQIEEQVRGEVAKLCADFPVYPGQ

SEQ ID NO: 13661 - protein, 555 aa, Yarrowia lipolytica
MAQSFTTFKQASDLPAWQKLQTLYDSKGKSLPVKQLFKEDPERFNKLSHTFTNFDDSKILFDFSKNIVDDEILAQLVELAKEANVYGLRDELFEGDKINFTENRAVFHPALRNRANVAMDVDDKNVAPEVDDVLAHMKEFSEQVRSGEWKGYTGKEITDIVNIGIGGSDLGPVMVSEALKPYAKKGLRAHFVSNIDGTSIAEEVIKQLNPETTLFLIASKTFTTAETITNATSAKTWFLETAKDTKHVAKHFVALSTNKEKVVEFGIDEANMFPFASWVGGRYSVWSSIGLSVAIYVGFDHFNDFLKGAEAVDKHFKEAPPEKNIPLLGGLLSVWYNNFFNAQTHLIAPFDQYLHRFPAYLQQLSMESNGKGVTRSNEYVKYSTGPVLFGEPATNAQHSFFQLVHQGTKLIPADFILAAQSHNPIDHNLHQRMLASNFFAQSEALMVGKTQEQVEAEGTPADLVPHKIFLGNRPTTSILTQLITPATLGALIAYYEWVTFTEGAVWNINSFDQWGVELGKALAKKIQPELENKSEIDAHDGSTNGLINQYKAWAA

SEQ ID NO: 13662 - protein, 670 aa, Unknown
  Candidatus Kuenenia stuttgartiensis
MCGIAGLIDLSGKAIDPEILKSMSDVIRHRGPDDEGYVLIDQATSRFQTYAGHDSPSDIQEFNPNFKSSTTAFAGNLGLSHRRFSIIDLTAAGHQPFYDNDRSCCVVFNGEIYNYIELRAELESRGHIFRSHSDTEVLLEAYKAWDVECFTRFNGFWALALYDFRKKRLILSRDRLGKRPLYWVRNDSRIYFASEIKSLLKVPENARNKKVNQEAIWYWCSSGLRDLNLSTCFEGIFSLPSASWVIVDENFPNKLKTFWKVPEKRMSENDIGISEAATLVRETLMEAVRIRLRADVPIALELSGGLDSSAILALTAQIHPERITTYTVRFHDPRTNEEPFARSVAKHYNVDYRVIDPPSQTFWQHILAFTYLQEEPYHSPNLQTSQDIWSHMRGEGIKVTLTGAAGDEMFAGYSRYYAKAQRENLQTGHYLQFIENALLWSERRYNFKTMALSLIRSPIRYLFNNLMPQASRVRQRNRNYLRNISISQRQCNTETLTETLYSDITNALIPYWLRSGDKTLMGMPFEGRCPFLDYRVVEIATQLPITYLIRHGWHKWILRKALEDYLPSDVLWRKQKMGFPFPYQTFYENSRKIIDLILSHADNPFIELSNKEKFQKDWRAISFILWYEMFFNENLTLFKKIESMINQSCTTTDSKYTPEFLSSCEVTSIT

SEQ ID NO: 13663 - protein, 124 aa, Arabidopsis thaliana
  misc_feature (23)..(23): Xaa can be any naturally occurring amino acid
  misc_feature (119)..(119): Xaa can be any naturally occurring amino acid
RGFPGRTTPVRATMVVQLTGLKXSVFFPVTGRANTAITSITGNGGGVSCLKGWPPIGKKKLETFFNLPALRDVKWVKEVDSLFRTRGIPGVESKWEHGFGSRGHGTTPGYYDGRSWTLXKLPLF

SEQ ID NO: 13664 - protein, 96 aa, Bradyrhizobium japonicum
MAKEELIQFEGLVTEILPDARYRVQLDAGHEIVAYTAGKMKKNRIKTLAGDRVTVEMSPYDLEKGRLIFRHKDERPATSGGPPRGGAQRGGQFRRR

SEQ ID NO: 13665 - protein, 451 aa, Arabidopsis thaliana
MIPDASPKGKPKVEVTDDMQPREDWDIRDAEFDFLELNEAFAEMAANPVEVAINSQEPYSARIKKVEKEINELAEKICNLGIKESDTGLAPPNQWDLVSDKQMMQEEQPLLVATCTQIISPNTEDAKYVVDIKKIGKYVVGLGDKASPTDIEAGMRVGVDQKKYQIQIPLPPKIDPSVTMMTVEEKPDATYSDIGGCKEQIEKIREVVELPMLHPEKFVRLGIDPPKGVLCYGPPGSGKTLVARAVANRTGACFIRVVGSELVQKYIGEGARMVRELFQMARSKKACILFFDEIDAIGGARFDDGVGSDNEVQRTMLEILYQLDGFDARGNIKVLMATNRPDILDPALLRPGRLDRKVEFCLPDLEGRTQIFKIHTRTMSCERDIRFELLAGLCPNSTGADIRSVCIEAGMYAIGARRKSVTEKDFLDAVNKVVKGYQKFSATPKYMAYYI

SEQ ID NO: 13666 - protein, 154 aa, Unknown
  Synechocystis sp. PCC 6803
MPLPTSLTTLDGTPLAPEVIADKVVLFVNVASKCGLTPQYSGLVALDKAYGEKGLVIIGVPCNQFGAQEPGSPEEIKDFTKTKYDVDFTLLEKQDVNGPNRSPLYQFLVGDGEDISWNFGKFLIGRDGQVVARFDPQTKPDDTNLKAAIEKALG

SEQ ID NO: 13667 - protein, 1014 aa, Unknown
  Synechocystis sp. PCC 6803
MSPSQPHPPIATFEPESFLILVVDDVKENIYVISELLEGEGYSTTFVTSGPEALQRVTQAQPDLILLDLMMPGMDGLEVCDRLKQDPQTRDIPVIFLTASNEKQDLLQAFAKGAVDYVTKPFSPPELLARVKTHLELKQTRDNLHHTLLEQARTAEALACTSTRLGILVQNMQAGVLMTDAQGTIVVVNPEFARLFNLGFPADLLLGKNLTAIAPRINGLISHGQGVTHNFLAIESPEPLLKVELALEDGRFFERDYVPIMLGDSSQGHFWLYRDISQRKQVEMIQGQSLEMERRMRQQLAEQNQELVAATTAAEAANRSKSEFLATMSHEIRTPMNAIIGMTGLLLDTDLTTQQKYFAQTIRNSGETLLTLINDILDFSKIEAGKLDLEVYPFDLGQCLEEALDVVVPSARQKSLTLIRRFLTPIPPNLQGDVTRLRQILVNLLSNAVKFTEAGQVKVTVEVVDHDAAKGEYQICFAVQDTGIGIAPNQQQALFQAFSQGNSSITRRFGGTGLGLAICVRLTALMGGTIWAESNGCVVGNPPELWQIGQPTIEGSTFYFTVNLTVLPSCAYSVHNLRHSLFIGRSVLVADYDEGRGTRMRNLLASWRLQAEQITFSSPAKLGEDLKSRLTQKNYGALILHCPYPEGRGKQFTDFDLGKITTWAPTEQDIPVLVATDIYLSPGERYSGDKPPVQAWIKSPINPDELENTLVDVLGQTEPPTLVSTEAISGPLFPYSSSNLTILLAEDNLINQQVAKLLLKKLGYPVDVVNNGQEALSALAKGDYDVVLMDVEMPEMDGLTATEHIRRSQGRSERPWIIAVTAYSMEGDRERCLASGMNDYVSKPIRLEALQQALQVAATALQSTSQDRMATVSCVSAFEAKPSPSSPCPEDPAGTTLPPIDQDIICSLRDLDRENGQLILREIIDIYCQTAPELLQRIKLAIANQDWGNLSSAAHTLGSSSANLGAVLLAQQAKTLENLTRQRDSRAMDPGHFPTLAASYERVQGELKTMLDRL

SEQ ID NO: 13668 - protein, 136 aa, Haemophilus somnus
MRILHTMLRVGDMDRSIHFYQQVLGMRLLRTSENTEYKYSLAFLGYDDEENSSVIELTYNWGVSKYEMGTAYGHIAIGVEDIYATCKAVKEAGGKITREPGPVKGGKTVIAFVEDPDGYKIEFIENKMAQAGLGNQ

SEQ ID NO: 13669 - protein, 160 aa, Picea abies
YNEEAWEKKAPNFLPKDPYDLAIARFWAAFVDDKLFPCIRGVFIGQGEQLQKAAEDSVANFLLIEEALRANNRFSGKTYFGGDEIGLVDIALGSMSAFLKAIEKATDTVLIDPEKMPLLSAWMDRFCESDGVKEVMPDPANELEIVVARRAKFTTPPAVN

SEQ ID NO: 13670 - protein, 255 aa, Elymus abolinii
LDNIMRLTGITGIVNGMNVSEWDPTKDKFLAVNYDVTTALEGKALNKEALQAEVGLPVDRKVPLVAFIGRLEEQKGPDVMIATIPEIVKDEDVQIVLLGTGKKKFERLLKSVEERFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 13671 - protein, 221 aa, Schizosaccharomyces pombe
MARRPARCYRYCKNKPYPKSRYNRAVPDSKIRIFDLGRKRAGVDEFPLCIHLVSNEYEQITSEALEAARICANKYLVKIGGKDSFHLRVRAHPFHVVRINKMLSCAGADRLQTGMRHAFGKPNGLVARVNIGQVLMSVRTKDSSRATAIEALRRCQYKFPGQQRIIVSKKWGFSQYARDEYIEKRSRGEIIPDGCYAKFLNKRGSLQEKLDLFPEASFNLA

SEQ ID NO: 13672 - protein, 384 aa, Nocardia farcinica
MARDYYGLLGVARNATDQEIKRAYRKLARELHPDVNPDEAAQARFKEVSTAYEVLSDPEKRRIVDMGGDPLESGGGAGGFSGAGFGGLGDVFEAFFGGMSGAGGGQRKPRGRVQPGADSLLRTRLSLAECAVGVTKHLTVDTAVLCDACHGSGTHGNSKPVRCETCGGAGEVQSVQRSFLGQVLTSRPCPTCRGAGETIPDPCHKCGGDGRVRARREIAAPIPAGVANGMRVRLAAQGEVGPGGGPPGDLYVEIVEQPHDVFVRDGDDLHCTIRVPMVDAALGTTVVIDTILDGPTELTIPPGTQPGEVSVLRGHGMPKLRSGVRGDLLAHLDIVIPTKLDGKQTELLRKYKALRDRDRAEVMSAQSEHNSGLFARLRASFSGR

SEQ ID NO: 13673 - protein, 396 aa, Mycobacterium smegmatis
MTDYSQARAVVVGGSIGGLTTALLLRDSGFHVDVFERTPTALDGRGSGIVLQPDTVRWFQERSSQDLGDLQTATRFVQYLDRSGDVVHREPATWTYTSWGTFYRALLADFGTEHYHYGEYACGFDQDEAEAVVRFVSGRTAAADLVVFADGITSAARERFDPDATLRYAGYIGWRGTVALSALSEPTRNTLRDAITYDVVPHSHITMYPIPGEDGLGESQRLMNYVWYRNVPAGPELTEMLIDKRGFGGSVSVHPGQVQDRYVDAIRADAAELFAPAVAETVVRTEQPYLQVLSDVRSTRMAMGRVALIGDAACASRPHAAAGTAKAAADAWTLAGALAASDGDIAAALRKWEPAQLQLSDSLLRRVVDMGDRSQFHNTWWPGDPDLRFGLYGPGH

SEQ ID NO: 13674 - protein, 194 aa, Thermus thermophilus
MREATVERATAETWVRLRLGLDGPTGGKVDTGLPFLDHMLLQLQRHGRFLLEVEARGDLEVDVHHLVEDVGIALGMALKEALGDGVGLERYAEAFAPMDETLVLCVLDLSGRPHLEFRPEAWPVVGEAGGVNHYHLREFLRGLVNHGRLTLHLRLLSGREAHHVVEASFKALARALHKATRRTGEGVPSTKGVL

SEQ ID NO: 13675 - protein, 547 aa, Zea mays
  misc_feature (128)..(128): Xaa can be any naturally occurring amino acid
MGLGAAVALALGDPPADYASIAAVGLFVALMCVCIVVGHLLEENRWMNESITALFIGLGTGAVILFASSGKHSRVLVFSEDLFFIYLLPPIIFNAGFQVKKKQFFRNFITITLFGAVGTLISFTVISXLGALGLISRLNIGALELGDYLALGAIFSATDSVCTLQVLSQDETPFLYSLVFGEGVVNDATSVVLFNAIQNFDPGNISSAKLLNFIGSFLYLFGSSTILGVASGLLSAYTIKKLYFGRHSTDREVSIMMLMAYLSYMLAELLDLSGILTVFFCGIVMSHYTWHNVTESSRVTTKHAFATLSFISETFLFLYVGMDALDIEKWKIVGQTYSPVKSIALSSTILALVLVSRAAFVFPLSFVSNLTKKTPNGKISFRQQVIVWWAGLMRGAVSIALAYNKFTRSGHTQQPSNAIMITSTISVVLFSTIVFGLLTKPLIRLLIPSRHLSREPSALSEPSSPKSFFEQLAANSPGHPDLENGISLRRPASLRFLLVSPARSVHHYWRKFDDSFMRPVFGGRGFVPFVPGSPTESSLPLLPGNEN

SEQ ID NO: 13676 - protein, 571 aa, Aspergillus nidulans
MCGIFACHHHPDVQAFKPTALRMAKAVRHRGPDWSGSFIADKTILCHERLCIVGVDSGAQPLVNDDESLALAVNGEIYNHRIVRKTLDVEYNYKTHSDCEVIIPLYMKYGLDAPKHLDGMFAWVLYDKKEDRVIAARDPIGICSFYIGWSSQTPGAVYFASELKSLHPVCDKVEAFPPGHVFDSKSGEFSRYFQPSWWDPTNVPSTPVDYKAIRESLTRSVRKRLMAEVPYGVLLSGGLDSSLVASIAQRETLRMQKASSGVKSEANGELVGIDDENELSTVNSFQQLQSFSIGLPGAPDTEAAMEVAKFLGTKHHALTFTIEDGLNALSDVIYHLETYDVTTIRASTPMYLLSRKIKGLGVKMVLSGEGSDEIFGGYLYFHAAPNKEEFHKETVRRVKNLHLADCLRANKSTSAWGLEARVPFLDKAFIETSMSVDPQEKMITKDRIEKYILRKAFDTSDEPDVEPYLPDKILWRQKEQFSDGVGYSWIDGLKDHAELHVTDEMMKNPKPEWGDDIPTTKEAYWYRMMFDEHFPSYCASTVERWVPTWSKQSDPSGRAIATHNAKYDDAE

SEQ ID NO: 13677 - protein, 251 aa, Glycine max
ILNTTFKAHQVAEAPKTDPEFWKSLFPVAVAHTIGHVAATVSMSKVAVSFTHIIKSGEPAFSVLVSRFLLGESFPVPVYLSLIPIIGGCALAAVTELNFNMIGFMGAMISNLAFVFRNIFSKKGMKGKSVSGMNYYACLSILSLAILTPFAIAVEGPQMWAAGWQTAMSQIGPQFIWWLAAQSVFYHLYNQVSYMSLDQISPLTFSIGNTMKRISVIGSSIIIFHTPVQPINAFGAAIAILGTFLYSQAKL

SEQ ID NO: 13678 - protein, 526 aa, Unknown
  Burkholderia sp. 383
MHSDARPDSPRPSGSPPAKPTLHRALQARHLRMIAIGGSIGTGLFVASGASISQAGPGGAMLAYMVIGLMVYFLMTSLGEMAAFMPVSGSFATYGAKFVDEGFGFALGWNYWYSWAVTLAVELVAGQLVMNYWFPHVPGVWWSALFLTLIFALNALSVRGFGEAEYWFALIKVLTVLAFVGVGLLMIFGIMQGGPSAGWGNFTIGDAPFAGGWATMLGVAMIAGFSFQGTEMIGVAAGESENPRTTIPRAVSQIFWRILLFYVFAIFVIGVLIPYTDPSLLKSDVTDIGVSPFTLVFRHAGLAFAAGVMNAVILTAVLSAGNSGMYASTRMLYNLAVEGRAPKIFAKLSRGGVPRNALYATTAVGALCFLTSLYGDKTVYLWLLNTSGMAGFITWLGIAVSHYRFRKGFLKQGYRLDQLPYRSKWFPFGPLFAFALCAVVALGQDYQAFFSDKIDWVAVAATYIGLPFFLAIWLGYALVRKCRLVRYEDMEIAPWIERNATPEPAPQAETGYAGYVARPANPTPGA

SEQ ID NO: 13679 - protein, 99 aa, Thalassiosira pseudonana
MATYKVTLISEEHDINATIDCNDDVFVLDAAEEAGIDLPYSCRAGACSTCAGKVSDGTIDQSEQTFLDDDQMGAGFVLTCIAYPKSDCTILVHQEDELY

SEQ ID NO: 13680 - protein, 550 aa, Lotus japonicus
MGATATPFASFNSQTTTTSTKDSYRSFSTHTFSTAFRRQPPPPPPSSFRRKPLKLITMAQQQQHLTLAPVNGNGSITAPATTLLFDQQLLQKIADDALVWASLHGLVMGDKSVQRSGTVPGVGLVHAPFALFPTLFPESQWRQACDLAPIFNELVDRVSLDGKFLQESLSRTKEVDEFTSRLLDIHSKMLAINKKEEIRLGLHRSDYMLDEKTKSLLQIELNTISSSFAGLGSLVTELHRYILSRYGKLLGLDSGKVPANNAATQFAEGLARAWTEYNDPRAVIMIVVQAEERNMYDQHFLSAVLRDRHQIAIVRKTLAEVDREGEILPDGTLSVDGQRIAVVYFRAGYTPVDYPSESEWRARLLMEQSSAIKCPSISYHLVGTKKIQQELANPGVLERFLENKGDIAKLRECFAGLWSLDDYDITRKAIEKPELFVMKPQREGGGNNIYGNAVRETLLKLQQAGSQEDAAYILMQRIFPTLSAAVLMRNGCWHKDHAVSELGIFSTYLRNKDRVVMNNQSGYLMRTKISSSDEGGVAAGFAVLDSVYLT

SEQ ID NO: 13681 - protein, 558 aa, Unknown
  Rhodococcus sp. RHA1
MNTGISDVDHTYDWVAEPVGARIDVRPTRSCRARVPAAPSGGNVDSTVPGHTDSSGLGKGLKRRHMNLIALGGVIGAGLFVGSGVVIGGAGPGAIISFLIAGIITLLIMRMLAEMAVARPVVGSFYVYARQALGRRAGFATGWMYWYFFVIVVAVEAIAGGRILQLWLPMIPLWLLSLGLMLLLTATNMVSARSYGEFEYWFSSIKVVAIVLFLGMGALWITGLWPDSTPGLGNLVNHGGFTPLGWGAVLAAVVPCVAFYTGAEIVTIAAAESEEPKRAVAHAMRSIVVRIVTFYVGSILVVVTIQPWNTESVGVSPYAAVLEVLGIPGVATIMNFIVLTAVLSCLNSALYTTSRMLFALTRNGDAPKFFTTLSRNGVPRRAILLGTTVGYVSVACTYVWGDVVFGFLVNSYGAVALFVYLLIAISQVVLRRRLEREDPAALQLRMWLFPWLSYATIALMATVILAMAFLPTTRSQFLMSGLTLIVILISYEVRKLLGKGGRDDESLSGAPPIGSADESVAEAEKRIESVETLGGSDIELLAAAQQEPHTHRHQRRQS

SEQ ID NO: 13682 - protein, 490 aa, Unknown
  Rhodococcus sp. RHA1
MTSTPPPVQSQDSGLGKGLKKRHMNLIALGGVIGAGLFVGSGVVIESAGPAAIVSFLIAGIITLLIMRMLAEMAVARPVVGSFYVYAREALGNRAGFSVGWMYWYFFVIVVAVEAIAGGRILQLYLPSAPLWILSLGLLVILTCTNLVSARSFGEFEYWFSSIKVIAIVLFLGLGALWITGLWPDATPGVANLVSHGGFAPLGWGAVLAAVVPCVAFFTGAEIVTIAAAESAEPKKAVARAMRSIVVRIITFYVGSIFVVVAVVPWSTEAVGVSPYAAALSALHIPGVATIMNVVILTAVLSCLNSALYTSSRMLFALTRNGDAPHMFTRLSGGGVPRRAILAGTVIGYASVIAAFVSPDLVFSFLVNSYGAVALFVYLMIAISQVALRKKLEARDPEALSLKMWLFPWLSYATIVLMGAVIAAMAVLPTTRSQFWLSVVTLAFILIGYEFRRRSRTSAERLDTVTPPAASPGDGSDAEQLVGVVTREQP

SEQ ID NO: 13683 - protein, 606 aa, Streptomyces coelicolor
MPTHSVPRPEYPRPQFTRRDWLNLNGAWQFETDRGDSGLERGLLDRELRDEILVPFPPESELSGIGDTDFLEAVWYRRALTLPAAWAGRRVLLHFGAVDHDTTVWADGREVARHRGGFTPFTADLGDIAGAGEEVVITVRARDPKSGPQARGKQAIKYANHDCNYTRVTGIWQTVWLEPVPETHLRRPRVTPDLAGSAFHLELPLSGNRPGYRVRAVLGDADGEVSRAEARADLDLAPRLHLPVPDDRRREWGPEDPHLYDLRLELLDAAGQVVDSAESYAGLRAVGLRGRAVLLNGRPVFQRLVLDQGWYPDGLMTAPTDEALVRDIELAMAAGFNGARLHQKVFEERFLHHADRLGYLVWGEFGDWGCETGGSSGDNQKPDASYVAQWLEALERDYSHPSIIGWCPLNETYQKLHDRITQLDDVTRAMFLATKAMDTTRPVVDASGYAHRVAETDIYDSHNYEQDPAAFRELMSGLAKDAPFVNAHESGAPYSQPYRGQPYFVSEFGGIWWDPEAAAAQSGEDRTVSWGYGERVRNEDEFHERFAGLTEVLLGDRDMFGYCYTQLTDVFQEQNGIYRFDRGEKLDIARVRAAQLRPAAIEEPEA

SEQ ID NO: 13684 - protein, 468 aa, Parvularcula bermudensis
MRYFPAFFDLRGRAVIVVGGGELAVRKLRLLMKADPFVTVVSAEDNSAVAAAFGDRVRRVARPLLPADLTPRPALIVIATEDEAAARVALDLAHQAGIPVNAVDRPAQCDVVIPSIVERGEMAIGISTGGAAPVLGRRVRERLEALLPARLGDLIAFAAERRDAVAHAVPASRRRGFWERLFDGPAAEAVLAGDQAAAETAFTQALSSVDEGQQQGHVAIIGAGPGDPELLTLKALRYLQEADVVLYDNLVSDAVLELIRRDAARHYVGKKRADHALPQEEIATLMIAHARQGARVVRLKGGDPFIFGRGGEELEALRAAGVAATIVPGITAAAGCAAATGIPLTHRGLSQAVTFVTAEAGKGGAPDINWSALAALRHTVAVYMGVRRAGQVANALIAAGRGGATPVAVIERGTLPEQRIIRTHLSALCAGVAHHEIKGPALLIIGEVAALADDGALREIVAQGGLAA

SEQ ID NO: 13685 - protein, 338 aa, Heterocapsa triquetra
PAVSPPTPARTSAMGNACSEGCFAGFASPDPRVKELKALEGDLKNLINTLNCNPILVRLAWHDSGTFDQRIQGWPQCGGANGAIRFDPEMNFGANAGLAKAKGYLDKFVEKYPSLSWADMIQMASAVSIEMAGGPKIPMKYGRVAVTSPDQCVGSASREGFEGNAGLPDPIPGGNGKFPCGATGPAAHLRNVFTKKMGFTDQEIVALSGAHTIGRAYKERSGTCPFGYMDASASKYSKSSCIVRKDGKAGIGMPGGAAWTKNWLTFDNSYFTKFKEAMEDDHLLWYPTDECLHQDPAFRPIFMKYAESQAAFFEDYAKAHKKLSELGAKFDPPNGITI

SEQ ID NO: 13686 - protein, 300 aa, Isochrysis galbana
KPHVAMDDQMYVNAVKSDIRKALVNQKGNSCPLAVRLAWHASGTYSKHDDTGGSYGATMRFPPEKEDGANAGLDIERDILQEVKRQHPDLSYADIWTLAGAHAIEIAGGPPIEHKLGRTDAQDGSACPAVGRLPDASQGAEHLREVFYRMGFNDEDIVALSGAHTLGRCHKTRSGFDGPWTHEPLKFDNSYFKNLLDLEWKPRQWDGPLQYEDPSHTLMMLPTDLALKTDPKFKEYVVAFAKSETVFRSAFKRAYEQLLCLGCPAHVVPSAAPVAMQSREEADGSLEFAQAARAAGGDPA

SEQ ID NO: 13687 - protein, 272 aa, Methanosarcina acetivorans
MARDRRDYYYHQAKEEGYRSRASFKLKQINEKHNVIKRGDSVVDLGAAPGGWLQVAKQLSGGKVLGVDLQRIAPIEGVETIQGDINADSTIKKIIRAVGEKGADVVLCDAAPNLSGNWSYDHARSIELTTSALECAKKILKPKGNFVVKVFQGDMFNDYLEKVRDNFVHVKAYSPQASRSQSAEIYVIGKKFLTAPLRRGDKFVVDIEKLGSGGDGAVLIEGFVVFVKEVEVGEKVRIKIADVKPNFAFADVEERLEKAEDSENLGNSEKAE

SEQ ID NO: 13688 - protein, 424 aa, Deinococcus radiodurans
MQAVTEVMTSIWPFVQAHPEYAEHALLERLIEPERVISFRVTWVDDAGQVQVNRGYRVQHSSSIGPYKGGMRFHPSVNLSILKFLAFEQTFKNALTTLPLGGGKGGSDFDPKGKSDGEVMRFCQALMTELWRHLGPDTDVPAGDIGVGGREVGYLAGMMKKLANHAGGVFTGKGLSYGGSLLRPEATGYGTVYFVEHMLRDQRMEMEGLRVSVSGSGNVAQYAIEKALHLGAHVLTASNSGGTVVDEDGFTYDKLAVLMDIKNERRGRVEDYAREVGAEFRPGVRPWDVPVDVALPCATQNELGADDARTLIAGGVRVVAEGANMPCDLAAIQAFEEAGVLYAPGKATNAGGVATSGLEMSQNAQRLSWTREEVDQRLRSIMSAIHDSCLEYGRRPDRHVSYLDGANIAGFVKVATAMREQGVL

SEQ ID NO: 13689 - protein, 158 aa, Unknown
  Malus x domestica
MEGKVFTEEQETLVVKSWGVMKKNAAELGLKFFLKIFEIAPSAQKLFSFLRDSDIPLEKNPKLKPHAMSVFVMTCESAVQLRKAGKVTVRESTLKRLGGVHFKSGVVDEHYEVTKFALLETIKEALPEMWSPEMKNAWGEAYDQLVAAIKSEMKPPLN

SEQ ID NO: 13690 - protein, 335 aa, Leptospira interrogans
MKIGVIGSGSFGTALGSLLADKGYEVTLWCRNDSQVESINRNHINNKHLPNFTLPEKLTASKDLRNVVQGKDMIVSSPPSHALSEVLREIKEYLPEKVPIVSASKGIENGTLRLVSEIFESELPEKYHSYLSYLSGPSFAKEIIQKVPTIVSIASKNETTARKVQEIFSFLYFRTYWTPDVIGVEVGGSLKNVIALAAGVSDGLGFGQNTRAALITRGLNEITKIGLKLGADPMTFLGPSGMGDLILTCCGEQSRNRTVGFRLGKGETLEQILSSMNEVAEGVKTTQSAYELSQKLGIEMAITNEVYKMLYEGKNPREVVKDLMKRDLKREGVSV

SEQ ID NO: 13691 - protein, 173 aa, Pseudomonas syringae
MSLHELNTLPGVTANPEAATRQFVFNHTMLRVKDITKSLDFYTRVLGFSLVEKRDFPEAEFSLYFLALVDKAQIPEDDAARNEWMKSIAGILELTHNHGTESDDTASYHNGNSDPRGFGHICVSVPDVKVACERFESLGVDFQKRLSDGRMNSLAFIKDPDGYWVEIIQPTPL

SEQ ID NO: 13692 - protein, 520 aa, Pseudomonas syringae
MLDANLKAQLKSYLERVTRPIEIVASLDDGAKSQEMLALLNDVISVSKDVTLNDSGTDARTPSFSLSSPGHDISLRFAGIPMGHEFTSLVLALLQVGGYPPKVSAETIEQVRALEGEFHFETYFSQSCQNCPDVVQALNLMAVLNPGIKHVAIDGALFQDEVTDRKIMSVPSIYLNGELFGQGRMGLEEILAKIDTGAGARQAEKLNAKQAFDVLVVGGGPAGSAAAVYAARKGIRTGVAAERFGGQVLDTMAIENFISVQHTEGPKLAVALEEHVKQYEVDIMNLQRADKLIPGAAGELHEVKFASGASLKAKTLILATGARWREMNVPGEQQYRNKGVAYCPHCDGPLFKGKRVAVIGGGNSGVEAAIDLAGIVSHVTLLEFDVQLRADAVLQRKLHSLPNVTVITSAQTTEVTGDEQKVNGLRYKNRTTGEEITVPLEGIFVQIGLLPNSEWLKGAIELSPRGEIVVDSRGETSVPGIFAAGDVTVAPYKQIIIALGEGAKASLSAFDHLIRTSAPA

SEQ ID NO: 13693 - protein, 593 aa, Unknown
  Frankia sp. EAN1pec
MCGLSGELRFDGREADVAAVGRMTAAMEARGPDGVGLWATGPVAFGHRRLKIIDLSERGAQPMVDTALGLTAVFNGCIYNYQELRDRLVDAGYRFFSTSDTEVILKAYHHWGPRCVDHFAGMFAFAVYERDTGRLVLVRDRLGIKPLYVTRDPHRLRFASTLPALLAGGGVSSDIDLVAFHHYLSFHSVVPPPHTILTGVRKLPQATIRTVEADGTTRDEVYWRPDSTRQEEHASWTADDWRDAIGERLRTAVRRRMVADVPVGVLLSGGLDSSLIVALLAEAGQRDLATFSVGFEAAGGESGDEFHYSDIIARRFGTDHHQIRVPGDRLLPAIDAAVAAMSEPMVSHDCVAFYLLSQEVARHVKVVQSGQGADEVFAGYSWYPPLATVPRGDAVDAYLRVFADRPHAELPAMVESHHLIEGDASRHFVAERFAEPGAETSVDAALRIDSTVMLVDDPVKRVDNMTMAAGLEARTPFLDHELVELAAACPPELKLASGGKGVLKDLSRPLMPVDVIDRPKGYFPVPAIRHLGGPFLARVADALTDPVARGRGLFRKDWVDEMLADPNSNRTTLGANALWQAALLEMWLQTQGV

SEQ ID NO: 13694 - protein, 172 aa, Brassica napus
  misc_feature (162)..(162): Xaa can be any naturally occurring amino acid
FGAIVEHCKDLRRLSLSGLLTDKVFEYIGTYAKKMEMLSVAFAGESDLGMHHVLSGCDSLRKLEIRDCPFGDKALLANASKLETMRSLWMSSCSVSFGACKLLGQKMPKLNVEVIDERGPPDSRPESCPVERVFIYRTVAGPRFDMPGFVWNMDQQHSTMRXFARQMVTTKK

SEQ ID NO: 13695 - protein, 294 aa, Saccharomyces cerevisiae
MKTLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPGGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 13696 - protein, 177 aa, Solibacter usitatus
MTDPKLRILISAEKIQERIRELGEKISADYPTGNLHMICILKGAIFFMTDLARAMKRDVQIDFMGISTYGKGKTSSGEVKVTKDLDISLEGADVLIVEDIVDSGVTLNYLMHLLDQRKPHSIRIAALLDKPERRLRPVHVSYVGFEIPDQFVVGYGLDYAEKYRNLDDVCVLDDPGA

SEQ ID NO: 13697 - protein, 458 aa, Deinococcus radiodurans
MWTWVCFRLEAPRVTDMLTAFALLLSVTAVLAFLNERFFRLPTTVGVTLAGALSSMLLIALDALGLTGPRGWAAGLLETLDFTDFVLNGILSILLFAGALGLDARQLLRQRFSILTLAVFSTLLSTFLIGFAAYGIFGLVGLNVPLLWSLLFGALISPTDPVAVLDLLKRAAVPKRIETLIAGESLFNDGVGVVIFLVIAGMAGIGHSHGTGSVVGALELFGREALGGMAFGALLGAIGFLMLREIEQHAVEVLITLALVVGGYVAASALGVSGPLAMVVAGLVISAGRDVAFGEETREHIESFWETTDQVLNILLFAFIGLDVLLTETTGPQIVAGLLLVVASLLARWISVALPFPLIRRHEDYGPYTVRLLTWGGLRGGIAISLVLGLPQTPYRTHLVTATYIIVLFSIAVQGLTIMPLVHKAVAASPDSAGPDSAGPGGGQEDGENAGRQLSSET

SEQ ID NO: 13698 - protein, 181 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 13699 - protein, 266 aa, Glycine max
MLIKCLAAISSSYTTTSNSLLVFASSSLSSPAKTKFLPSLSRFSIKRPYFLSQTYPRIAVNKPSMNLLNRLGFGSARATENMDSSIPQGPDDDIPAPGQQFAEFGAGCFWGVELAFQRVPGVTKTEVGYTQGLVHNPTYEDVCTGTTNHSEVVRIQYDPKNCSYETLLDMFWSRHDPTTLNRQGNDVGTQYRSGIYYYTPEQEKAAKESLEQQQKQLNRKIVTEILPAKKFYRAEEYHQQYLEKGGRFGFKQSASKGCNDPIRCYG

SEQ ID NO: 13700 - protein, 798 aa, Aspergillus nidulans
MSSQGITRKRPAPGTSPAVHPQLGQLPNYPPTSGSPLSNDQFLQWGQNPSPNTVAPGSFPDANTYNTGALPASAHDISGVSTANNQVARRTPSTQIVNRSRSYEQPPAPLSDPSNVPSEPGGWSESLEELYKRALAAKREAQAKRKQIPPFVQKLSSFLDESKNTDLIRWSDDGNSFIVLDEDEFAKTLIPELFKHNNYASFVRQLNMYGFHKKVGLSDNSMRASERKNKSPSEYANPYFKRGHPDLLWLIQKPKNTAGQGTKSGKGYVRVKTEDAENENEDFGDENAGASRDDGARNRQLSLVAQQPSLPKDQFATVYRELQAIRQQQQIISSTINKLRREHEQLYAQAANFQEQHTRHENSINAILTFLATVYNRSLQGQEGQNLANSFAGAISQDQGNVVDMGDGYSFGPLGAPSMNSPGGPRSMKKQPLLLKAPPGSERHGRAATLSPAATAYDRSQSRNNSRQTSTSQSGQVEEVFDNNSPRSKETSSSQAQQYPQRDIMSVIQNANARNGIPTSYSDFPNVLSSLETSNGNVPLTSNQRADMLRLMANESGTNDSGVTVSQNNALISPVPPPMPNNYSARLADTRSEIDNLMKMQAEQDRSVQNLTNLLQPLSPSGTIPGIGSDGTIPPPPLELDQIFNNDYFTDFGDYDQQNRANVDLGDSTGAGQAPPSTEPPAPPDDIAIKHDGNDLFDFDHLAGEGELFAGTNNQSSPGYFPQFDSGYGHSAANTTGASTGVSGSGRVVETLTDSESTSPSNTVDDPTHYSADVFDAGDGSQGGKSSSGGGSKRRRKA

SEQ ID NO: 13701 - protein, 296 aa, Saccharomyces cerevisiae
MITTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPGGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 13702 - protein, 382 aa, Unknown
  uncultured proteobacterium
MSKRDYYETLGISKGATAEEIKKAYRRKAKELHPDRNADNPASEGLFKEANEAYEVLKDSNKKAAYDRYGHAAFEGGMGGGGGGRPGGQGDFSSAFSDVFDDLFGDFMGGRGGGGRQRAARGADLRYNMHVTLEEAFRGLQKTINVPTAVSCANCSGTGAASGSAPATCGTCSGMGKVRAQQGFFTVERTCPSCSGAGQVIKNPCSSCHGAGRVEKDRALSVNIPAGVETGTRIRLSGEGEAGARGGPQGDLYIFIEVADHQIFEREGNNLFCNVPVSMTSAALGGDIEVPNIDGGRSRVKIPSGSQSGRQMRLRSKGMPSVRGGGVGDMFIELQVETPVNLTARQKEILKEFEALSSDNSPESQGFFKKVKRFWDGVKGQE

SEQ ID NO: 13703 - protein, 179 aa, Leuconostoc mesenteroides
MDNDIQEVLYDQESIQKAAERLGKQITQDYAGSTPLFLSVLKGAYLWTADLLREVDLYAELEFIKISSYHGGVSSSDEITLVTDVRSDVRGRDVIILEDIVDTGQSLLFLKELLAKRGAKSIKVATLLDKIEGRKVEVDADYAGFNVRNEFVVGYGLDYEEHYRNLPYVGILKKEVYTK

SEQ ID NO: 13704 - protein, 605 aa, Nicotiana attenuata
MEERSSTRLPTGSYTNDNTVWECVIPYITESRDRDAVSLVCKRWWQIDAITRKHITMALCYTAKPEQLSRRFPHLESLKLKGKPRAAMFNLIPEDWGGYVTPWVVEITKSFSKLKALHFRRMIVRDSDLELVAMNRGKVLQVLKLDKCSGFSTDGLLHICRSCRNLRTLFLEESSIVENDGEWVHDLAVNNTVLENLNFYMTDLVQVRAEDLELIARNCKSLVSMKISECELANLLGFFRAAVALEEFGGGSFNDQPEPVPENGYNEQLEKYAAVVSPPRLCQLGLTYLGKYEMPILFPIASRLTKLDLLYALLDTAAHCFLLQRCPNLEILETRNVVGDRGLEVLGQYCKRLKHLRIERGADDQEMEDEQGAVTHRGLTDLAKGCLELEYMAVYVSDITNEAFENIGTYLKNLCDFRLVLLDREERITDLPLDNGVRALLRGCYKLRRFALYVRPGGLTDVGLSYVGRYSPNVRWMLWGYVGESDEGLLKFLKDVLTCKARSERLLFSERALALAAMQLKSLRYLWVQGYRASSAGRDLLAMARPFWNIELIPARRVVSSEGNNGETIVAEHPAHILAYYSLAGQRTDFPDTVRPLDPNSLLAE

SEQ ID NO: 13705 - protein, 255 aa, Bothriochloa bladhii
  misc_feature (137)..(137): Xaa can be any naturally occurring amino acid
  misc_feature (143)..(143): Xaa can be any naturally occurring amino acid
  misc_feature (253)..(253): Xaa can be any naturally occurring amino acid
CELDNIMRLTGITGIVNGMDVSEWDPSKDKYIAVKYDVSTAVEAKALNKEALQAAVGLPVDSKIPLVAFIGRLEEQKGPDVMAAAIPELMEEDVQIVLLGTGKKKFERMLMSAEEKYPDKVRAVVKFNAALAHHIMXGADLLXVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWENVLLSLGVAGXEP

SEQ ID NO: 13706 - protein, 1403 aa, Arabidopsis thaliana
MVHSESSILSSLRGGDGGGIPCSKDELAINGSYTDPMGRRKSKRFKVAAESEFSPDFGSITRQLRSRRMQKEFTVETYETRNVSDVCVLSSQADVELIPGEIVAERDSFKSVDCNDMSVGLTEGAESLGVNMQEPMKDRNMPENTSEQNMVEVHPPSISLPEEDMMGSVCRKSITGTKELHGRTISVGRDLSPNMGSKFSKNGKTAKRSISVEEENLVLEKSDSGDHLGPSPEVLELEKSEVWIITDKGVVMPSPVKPSEKRNGDYGEGSMRKNSERVALDKKRLASKFRLSNGGLPSCSSSGDSARYKVKETMRLFHETCKKIMQEEEARPRKRDGGNFKVVCEASKILKSKGKNLYSGTQIIGTVPGVEVGDEFQYRMELNLLGIHRPSQSGIDYMKDDGGELVATSIVSSGGYNDVLDNSDVLIYTGQGGNVGKKKNNEPPKDQQLVTGNLALKNSINKKNPVRVIRGIKNTTLQSSVVAKNYVYDGLYLVEEYWEETGSHGKLVFKFKLRRIPGQPELPWKEVAKSKKSEFRDGLCNVDITEGKETLPICAVNNLDDEKPPPFIYTAKMIYPDWCRPIPPKSCGCTNGCSKSKNCACIVKNGGKIPYYDGAIVEIKPLVYECGPHCKCPPSCNMRVSQHGIKIKLEIFKTESRGWGVRSLESIPIGSFICEYAGELLEDKQAESLTGKDEYLFDLGDEDDPFTINAAQKGNIGRFINHSCSPNLYAQDVLYDHEEIRIPHIMFFALDNIPPLQELSYDYNYKIDQVYDSNGNIKKKFCYCGSAECSDLLLMMTPETPEAKLYKILTGFTGFYVLEKSSVTERRLIGKDDSDPNQIPNPIHHHHQTQNKNRTAIDNKGSGFTKYNHPQGQNHHHTVDIPTGVDHFRRRSARARSGSISSFFPSNLLSSLSSYRPVIARFLRKLLRYTLRARLICFHLRFLLLLAVPPLYIFFLVINLRIFLRLVFVIIALSFILSISLRFALPHLTSIRLFVARLLTFIPARFSSSQPSTDRVVWSIGSKPVAENNKTNSGSWVQKYGTNDMYEGEFHRGKCSGSGVYYYSMKGKYEGEWIDGKYDGYGVETWSKGSRYRGQYRLGLRHGIGVYTFYTGDVYAGEWSNGQCHGCGVYTSEDGSRYDGEFKWGVKHGLGSYHFRNGDAYAGEYFADKMHGFGVYHFANGHKYEGAWHEGRRQGLGMYTFRNGDTQAGHWEDGVLSCPTEQTIRPGSSFTISHSKVVDAVEQARKAAEKAHEVVKVEERIKRAVMAANRAANAARVAAVKAVQSQTFHRNDGDLETNYESGLEKLCMSRRSLALSLFSEPSDGTPNSYSTSSIHRVGTSSLNFPTVLTSPNSNSLPFNSILATELAEVFAVLTHFHLLDLLPKTGTISGPLTDNISTDSETM

SEQ ID NO: 13707 - protein, 296 aa, Saccharomyces cerevisiae
MIVEKLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPQGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 13708 - protein, 255 aa, Capillipedium parviflorum
  misc_feature (84)..(84): Xaa can be any naturally occurring amino acid
  misc_feature (108)..(108): Xaa can be any naturally occurring amino acid
  misc_feature (146)..(146): Xaa can be any naturally occurring amino acid
CELDNIMRLTGITGIVNGMDVSEWDPSKDKYIAVKYDVSTAVEAKALNKEALQAAVGLPVDSKIPLVAFIGRLEEQKGPDVMAXAIPELMEEDVQIVLLGTGKKKFEXMLMSAEEKYPDKVRAVVKFNAALAHHIMAGADLLSVTXRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWENVLLSLGVAGGEP

SEQ ID NO: 13709 - protein, 762 aa, Symbiobacterium thermophilum
MPPGAPDGPGHRRRTNVTASFSMELGGRTMTLETGRLAKQASGSVLVNYGDSVVLCTAVGSATPREGVDFFPLTVDYEERMYSVGRIPGNWFRREGRPTSKAILWARLTDRPIRPLFPEGFRNDVQVVCTVLSVDPDHPVEIMGMIGASAALTISDIPFEGPIGGVIVGLVDGQFVINPTAEQQERSEMHLVVAGTEHAVLMVEAGAKEVPEQTMLDAILFGHEVIKNTIIPTIKQMQAEVGKPKREVVLFNPPPELEQAVREAATVRLREAVRNPDKLAREEAVAAVGEAVQAELAEQFPESEKHIAYLLKKVLKEEVRRAIIEEGIRPDGRSLTEIRPIECAVDLLPRPHGSGLFQRGQTQVLSICTLGTLGDMQKLDDLTLEETKRFMHHYNFPPYSVGETRPLRGPGRREIGHGALAERALEPVIPPEEEFPYTIRVVSEVLESNGSSSMASVCGSTLALMAAGVPIKAPVAGVAMGLVEDPETGRYAVLTDIQGIEDALGDMDFKVAGTKKGVTALQMDMKISGTSREILEKALMQAREGRMFIMEKMLACISEPRKELSPWAPRIITMKISPEKIRDVIGKGGSTINKIIEETKVGHTKVEIDIQDDGTIYIAAVNLEAGERARQMIEALVKDPEPGMIYTGRVTRLMQFGAFVEILPGKEGLVHISELSDKRVARVEDVVNIGDEVTVKVTEIDRLGRINLSIKDAMPKQAASQPSGRPEARQPQPKPGQGKPGPAKAGAGRPGPGKPGPGRHGR

SEQ ID NO: 13710 - protein, 255 aa, Chrysopogon fulvus
CELDNIMRLTGITGIVNGMDVSEWDPSKDKYIAVKYDVSTAVEAKALNKEALQAEVGLPVDRNIPLVAFIGRLEEQKGPDVMAAAIPELMEEDVQIVLLGTGKKKFERMLMSAEEKYPDKVRAVVKFNAPLAHHIMAGADLLSVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWEDVLLSLGVAGGEP

SEQ ID NO: 13711 - protein, 254 aa, Elymus abolinii
DNIMRLTGITGIVNGMDVSEWDPTKDKFLAVNYDITTALEGKALNKEALQAEVGLPVDRKVPLVAFIGRLEEQKGPDVMIAAIPEILKDEDVQIVLLGTGKKKFERLLKSVEEKFPGKVRAVVRFNAPLAHQMMAGADVLAVTSRFEPCGLIQLQGIRYGTPCVCASTGGLVDTIVEGKTGFHMGRLSVDCNVVEPADVKKVATTLKRAVKVVGTPAYQEMVKNCMIQDLSWKAPAKNWEDVLLELGVEGSEPG

SEQ ID NO: 13712 - protein, 978 aa, Bacillus cereus
MAEQTVRVTVDGKECSTSGEKTILQLFNESNLEHPQICHVPEVDPIQTCDTCIVEVDGKLMRACSTKLENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDNGVSINDSSCVSCGQCVTVCPCNALMEKSMLGEAGFMTGLKPDVLNPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSEYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSTMLEKYTLDYTEEITGISKENLKEMARMVCEADGTCILWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPSSNPRDKKRNPQNGVEIEQKWQRKQYVSLVD

SEQ ID NO: 13713 - protein, 376 aa, Unknown
  Bradyrhizobium sp. BTAi1
MAQETSRPRIGEGRIGSSLCAAIGVLSVAAVLCLRYPAFLTTPELRVHYDVELLRLTLAIAMVIGAWLGVVGIVLGGPRLQAAIGLSALFLATLLGGPYVPTPDFLQPRFYLGLDWLVLDLFFTGAAFVLLEWIFPRVRPEQGPLSPGWKLDLAYFGVNHLLIGIFLVVSTHFAHDAFAWAISPSLQAHVVALPAIVRFVLVILAADAVEYISHRAYHEVPWLWRIHAVHHSPEHMDWLSGSRLHFLEPLATRALVLVPIVLLGFPQDTIFAYLVFISVQSVLIHSNIKMDVGWLRYVIVTPQFHHWHHASDAEALDKNYAAHTPLFDMLGGTWHLPKDRWPVNYGTVKPIPGGMLGQFMHPFVGPVKEFLEHRDP

SEQ ID NO: 13714 - protein, 253 aa, Chrysopogon gryllus
CELDNIMRLTGITGIVNGMDVSEWDPSKDKYIAVKYDVSTAVEAKALNKEALQAEVGLPVDRNIPLVAFIGRLEEQKGPDVMAAAIPELMEEDVQIVLLGTGKKKFERMLMSAEEKYPDKVRAVVKFNAPLAHHIMAGADLLAVTSRFEPCGLIQLQGMRYGTPCACASTGGLVDTIIEGKTGFHMGRLSVDCNVVEPADVKKVATTLKHAIKVVGTPAYEEMVKNCMIQDLSWKGPAKNWENVLLSLGVAGG

SEQ ID NO: 13715 - protein, 105 aa, Robinia pseudoacacia
HYTWHNVTESSRITTKHAFATLSFVAEIFIFLYVGMDALDIEKWRFVSDSPGTSVAASSVLLGLILVGRAAFVFPLSFLSNLAKKSSSDKITFREQVIIWWAGLM

SEQ ID NO: 13716 - protein, 255 aa, Coix aquatica
CELDNIMRLTGITGIVNGMDVSEWDPSKDKYITVKYDVSTAVEAKALNKEALQAAVGLPVDRKIPLVAFIGRLEEQKGPDVMAAAIPELMDEDVQIVMLGTGKKKFERMLTSAEEKYPDKVRAVVKFNAALAHHIMAGADLLAVTSRFEPCGLIQLQGMRYGTPCACASTGGLVDTVIEGKTGFHMGRLSVDCNVVEPADVKKVATTVKRAIKVVGTPAYEEMVKNCMIQDLSWKGPAKNWENVLLSLGVAGGEP

SEQ ID NO: 13717 - protein, 568 aa, Parvularcula bermudensis
MSEIDTFNPSRDEFAEMFEASVVDRETFEQTVVKGTITAIEKDVAIVDVGLKTEGRVPLREFGDPSKDPVAVGDQVDVFIDRIENAHGEAVISRDRARREEAWERLEHNFEDDDRVEGVIFNRVKGGFTVDLGGAVAFLPGSQVDIRPVRDAGPLMNIPQPFKILKMDKRRGNIVVSRRSVLEEDRAEHRQEVVRDLNEGDERDGVVKNITDYGAFVELAPGVDGLLHVTDMSWSRVNHPSEVLNVNDTVSVKIIKINPETSRISLGMKQLQPDPWDGVAAKYPIGGKFHGKVTNITDYGAFVELEDGIEGLVHVSEMSWVKKNVPPSSIVSSGQEVDVMVLEVDEQKRRVSLGLKQTLSNPWESFAEKHPIGSIVEGEVKNITEFGLFIGIDDDMDGMVHLSDLDWDRQGDDAIRDYQKGDMVKAKVLDVDPDKERISLGIKQVANDPMDAIAELNRGDDVTCTVTAVENGGIEVRVGSDGGPKAFIRKSDLSRDRNEQRPERFAVGDKIDARVIALDPQSRRLSLSIKAREIAEEKEAVEQFGSADSGASLGDILGAALKDTEDAG

SEQ ID NO: 13718 - protein, 820 aa, Clostridium thermocellum
MKAVIMAGGEGTRLRPLTCNRPKPMVPVVNKPVMEHIIELLKKHGFTDIAVTLQYLPDMIKDYFGDGSDFGINLRYYVEDKPMGTAGSVKNAEEFLDDTFLVISGDALTDIDLGKAVEYHYSKGSMATLVLKKVDIPLEYGVVVTDENGRITRFLEKPSWGEVFSDTVNTGIYILSPEVLKYFNKNEMFDFSKDLFPMLLKENKPMYGYITDEYWCDIGDLMAYSKAHMDVLDGKVKINIPGNKIKDRVWVGEGTVIEENVVIEEPCVIGANTRIKKDSVIGSYSVLGDNNIIGERSGIKRSILWKNNVLETNTQLRGTVVCSKVNIKEGVFAFENSVIGDDTQIGKNAVIKPSIKIWPNKIVEGGTEVNSNLVWGSKFVRSIFGFRGVAGEINVDITPEYASKLGAAYGAIFKGKGKIGVSSDDSAAAKMLKMSFMSGLLSAGLKVLDFGVLHLPVARSAVRFYGADGGIHISTSSTNFGRLTVDFLDKNGSNIKREVERKIENAFQREDFSRCEGEAIKDVEVIPDYTKYYLRNIINNTRSKDFGYRIALNSLSGFILETVGNLLETFGCTVEKTSLDLRNAKTMRNGNKSAEMTYFTDMIKMGNYDLGVSIEDTSEKMMLVDNNGRIVSDDMFTALISLIVFKTVQGGTVVVPISTSSVVDKLAEQNNGKVIRTKTSPQDIMNKMLGNETKENVYEQFTLHFDAIAGLVKILDFMKSENYSLSDLVNMIPDFYVSEKEVECSWNVKGKVIRQIIQENEGQSIETLEGVKIFKDGGWVLVLPDAEQPVCRIKSESYSAEFAEELTNFYVNKVREISQK

SEQ ID NO: 13719 - protein, 700 aa, Clostridium thermocellum
MYKTFSMELAGRTLTIETGKLAQLANGSVLVRYGDTVVLSTATASATPREGVDFFPLSVDYEERLYAVGKIPGGFIKREGKPSEKAILTARVIDRPLRPLFPKDLRNDVAIVNTVLSVDQDNSPELAALLGSSIAVSISDIPFNGPVGAVILGLIDGEVIINPTEKQKEISQMYVTLAGTRNKIVMIEAGANEVPDEVMLDAIKKGHEEIKKIVDFIDGIVKEVGKPKFEYESAEVPEEIFNAVREYAYDKMREAVLAVDKQVRDKNIDDLTKEITEHFAEVFPEMEPAIKEAIYKLEKKVVREYILEEGRRVDGRRLDEIRPLSAEVGLLPRVHGSGLFTRGQTQVLSSVTLGAMGDVQILDGIDTEETKRYMHHYNFPGFSVGEAKSSRGPGRREIGHGALAERALEPVIPSEEEFPYTIRVVSEVLMSNGSTSQGSVCGSTLALMDAGVPIKKPVAGISAGLVVDENNPDRFVTFMDIQGIEDFFGDMDFKVAGTKDGITAIQVDIKIDGLTEEIIKQAFELTRKGRLYIIDNVLLKAIPEPRKQMSKYAPKIISTTINPDKIREVIGPGGKMINKIIDETGVKIDINDDGRVYIFSSDIQAGKRARSMIEAIAKDIEPGQVFLGRVIRVTSFGAFVEFLPGKEGLVHISKLDKKRVERVEDIVRVGDQILVKVIEIDKQGRVNLSRKDAMEDEWDK

SEQ ID NO: 13720 - protein, 343 aa, Datura metel
MEVISTNTNGSSLLKNGVITMNGHHNGNSDHRNGGTTAHDNGRKLLGNSNSIKPGWFSEFSALWPGEAFSLKIEKLLFQGKSDYQDVMLFESATYGKVLTLDGAIQHTEDGGFPYTEMIVHLPLGSIPNPKKVLIIGGGIGFTLFEVLRYSTVEKIDIVEIDDVVVDVSRKFFPYLAANFNDPRVTLVLGDGAAFVKAAQAGYYDAIIVDSSDPIGPAKDLFERPFFEAVAKALRAGGVVCTQAESIWLHMHIIKPIIANCRQVFKGSVDYAWTTVPTYPTGVIGYMLCSTEGPDVDFKNPVDPIDKDETHANSELGPLKFYNADIHKAAFILPSFARSMIES

SEQ ID NO: 13721 - protein, 292 aa, Oryza sativa
MSGELKRDYEIGEEIGRGRFGVVHRCTSRATGEAFAVKSVDRSQLADDLDRELAELEPKLAQLAAAGNPGVVQVHAVYEDDAWTHMVMDLCSGPDLLDWIRLRRGAPVPEPVAAAVVAQLAEALAHCHRRGVAHRDVKPDNILLDVVDDGIDGGGTPRARLADFGSAAWVGESGGSAEGLVGTPHYVAPEVVAGGEYGEKADVWSAGVVLYVLLSGGALPFGGETAAEVLASVLRGSVRFPPRLFAGVSPAAKDLMRRMMCRDTWRRFSAEQVLGHPWIVSGGGARAMEQPT

SEQ ID NO: 13722 - protein, 1453 aa, Coprinopsis cinerea
MKIFHSNGSWRHVAISLDCTVAQLNKELFAKAKWDSDRKDRLYLSEGGRERLLGPTERPAKIVKRRLTLAGYLPIDGLDTLGLEDLPFLFRFSYKSQLLGPPEEDLNFESFDFIDLTGRSLRTIPVLLHQNADSIVSLKLSRNPMLEIPLDFIQSCSLLRDLRLSNMAMKKVPQSVQYSSTLHRLDLSSNRIADLTDAYLDHIPNLLELNVMNNKLEKLPWHFGRLRCLVTLNISNNRFTEFPKEVFQMKNLRTLDVSFNTIKVIPEELGQLAELEHFLLVGNQISKFPDQARELHNLSMLDCRRNSVSDLTIVLMLPKIQQVYADHNAISSLDLSIGPNMKGLDVSHNDITQLSLIPGPVGRSPYSLTSLDLSYTKLSSLDDLALGTLTSLKTLKLDHNTIRSIPDTLGELSWLETLTVSDNRLDSLPDSIGRLQKLETLDAHNNSLSELPQSLWNCASLTRINVTSNFLGSWHDPPVSSDVGIDDASSLYLARKGSTASTTSTSGLPPLVHSLERLYLGENRLTEESIHPLMIFKELRVLNLSFNELQELPPIFFRNMTQLEELYLSGNKLTSIPTEDLHRMTRLSTLFLNGNRLQTLPQELGKLKDLSILDVGSNMLKYNINNWEFDWNWNFNKKLKYLNLSGNNRLQIKSESSRNSASHNRTSRLDFASLGRQTLAGFKELASLRVLGLMDVTIATTGTDASVDIPDETDIRRVRTSPSTVNGMAYGIADSLGRNDVLNMLDLVREFPASPGEPKPNKAIFAMFGRCQPPKGLLPGTSPNKLSKFLHDHFTEVFIRQMNELPEKKGGVSDALRRTFLELNQKLWEHIHQLKRKNSQATPMPAPNGTLVNSGFDPGLLNIGATSVVLYVVDKRIYVANVGDAVAVLSRAGVAHRLSHRHHPYDREETAHIRSAEGWVSPNGLINDQVEVSRSFGHFNLVPVVRAAPDIFSQPLGDRDEFIIIANRGLWEFVPHQTAVDIARTVAHIDPMIAAQKLRDFAISYGADGSTMIMVIMVSDLFKDPRSRQPTLDNIVLPAKVPKRKKEERIPGNRHLPPEVDAPTGHIAIAFTDIRNSTHLWEVNPGMPTAMHLHNHLLRYHLRRCGGYEVKTEGDSFMVSFPTALAAVWWCVTVQKELLNVSWPLEILECEDGKEIRDEAGNIIARGLSVRMGIHCGVPVCETDWITNRMDYFGSMVNRSARVNSHAQGGQIMVSADVLREINARIYDKVEEQTEYSRNQPQDAIDGIREIGISLIPVGEVKLKGFEFTEMLTAVYPKGLEHRHGMKDANVSGAASRIQFSVPQTKELGILCLRLEALSGGYLFKTPPPARKGSIASQTASLLPGAGPHPGSSSNTTEEATSNEAEAEPQGPPVIVADPETLLPPINDQISDADLMRIIDWFAMRIENAVNMLAHRYCPPNMDRVNFINALIEGEQLDARTLEYISGILKRIS

SEQ ID NO: 13723 - protein, 305 aa, Oryza sativa
MEFTPKITGKTTSMSGELKRDYEIGEEIGRGRFGVVHRCTSRATGEAFAVKSVDRSQLADDLDRELAELEPKLAQLAAAGNPGVVQVHAVYEDDAWTHMVMDLCSGPDLLDWIRLRRGAPVPEPVAAAVVAQLAEALAHCHRRGVAHRDVKPDNILLDVVDDGIDGGGTPRARLADFGSAAWVGESGGSAEGLVGTPHYVAPEVVAGGEYGEKADVWSAGVVLYVLLSGGALPFGGETAAEVLASVLRGSVRFPPRLFAGVSPAAKDLMRRMMCRDTWRRFSAEQVLGHPWIVSGGGARAMEQPT

SEQ ID NO: 13724 - protein, 119 aa, Alternaria tenuissima
STGGKAPRKQLASKAARKSAPSTGGVKKPHRYKPGTVALREIRRYQKSTELLIRKLPFQRLVREIAQDFKSDLRFQSSAIGALQESVEAYLVSLFEDTNLCAIHAKRVTIQSKDIQLRP

SEQ ID NO: 13725 - protein, 349 aa, Rhodospirillum rubrum
MNQIIDHIAVIGGGAWGTALAQTSRRAGRRVTLWAREPEVARAINATHENPDFLPGVSLDPGLHATADLAEALRGAEAVLVVCPAQALRPVLTTARPLWPGRAPMVICAKGVEQGSGARMSEVATAVLPEAPLAVLSGPTFAREVAEGRPTAVTLACADGALAEALVLALGTRTFRPYASTDVVGAEIGGAVKNVLAIACGVVEGLGLGDNARAALLTRGLAEITRLGRALGARSETLSGLSGLGDLILTATSMQSRNFSLGFALGQGRTLDQVLGERRSVAEGVHTASAVVALAARWAIEMPICAAIHGVLSGDYDVTSAIESLLSRPLRVEGGSESQIHPTAKTATP

SEQ ID NO: 13726 - protein, 196 aa, Triticum aestivum
GELGPTSHAPGRHGRGISVVAEVSHCVHLVSWEKENVSSEALEAARIACNKYMTKHAGKDAIHLRVRVHPFHVLRINKMLSCAGADRLQTGMRGAFGKPQGVCARVAIGQVLLSVRCKPNNAIHATEALRRAKFKYPGRQKIIESRKWGFTKFNRNDYLKFKSEGRILPDGVNAKLLGCHGRLANRAPGQAFLSAA

SEQ ID NO: 13727 - protein, 136 aa, Candida glabrata
MARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKNDIKLARRLRGERS

SEQ ID NO: 13728 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATNPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 13729 - protein, 158 aa, Pyrus communis
MEGKVFTEEQETLVVKSWGVMKQNAADLGLKFFLKIFEIAPSAQKLFSFLRDSNIPLEKNPKLKPHAMSVFVMTCESAVQLRKAGKVTVRESTLKRLGGVHFKSGVVDEHYEVTKFALLETIKEAVPEMWSPEMKNAWGEAYDQLVTAIKLEMKPPLN

SEQ ID NO: 13730 - protein, 249 aa, Brassica napus
MASAQLTIRKIVGIIGNAIALCLFLSPTPTFRRIVKKKSVEEYSPIPYLATLINCLVWVLYGLPMVHPDSTLVVTINGAGILIEVVFITIFFVFSGRPKQRLVIAAVLAGETLFVAILSVLVFTLQHTTKERTMSVGIVCCVFNVMMYASPLSVMKMVIRTKSVEFMPFWLSLAAFLNAGVWTVYALMPLDPFIAIPNGIGCIFGLAQLILYATYYKSTKKMMAERQPMIGLSSVVVRIGSEKVAQPSA

SEQ ID NO: 13731 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCLRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 13732 - protein, 432 aa, Tropheryma whipplei
MPSVLIAHLSQYQSSQAVQVRGWVEAVRDQKNIQFVIIRDESGAPLQLLYVRSGKSDCIAEKISSLSIGSFVRASGVLKHNERVKLRGLEVEINNLDVVSTALPSPIAHDSSIDKRLDWRFLDLRNERNNLIFRIQTCFLHALRTWWVRNGFIEINTPKLMASSSESRAELFSLKYFDRIGYLAQSPQFFKQMSQAAGFGKVFEIAPVYRADPSFTSRHATEYTSIDSELSWIESHEDVMNMQEELLTYSICDVLERHSEEIRGVFGLNLCPPKRPFVRVTLEQALNISARSGHISQRHDLDPEAERRVGKWALDNHASDFVFVTNYPVSVRPFYHMRENENITKSYDLLFRGIEIATGAQREHRYDVLVDQAREKGLDLSELGYYLDFFRYGMPPHGGFGAGLARIIMALLRLGSIKESTFLFRGPNRLLP

SEQ ID NO: 13733 - protein, 370 aa, Narcissus pseudonarcissus
MTIMNTSPIGFEGFEKRLEITFSEASAFVDPHGRGLRALSRSQIDSILDLARCTIVDHLSNKDFDSYVLSESSLFIYPHRLILKTCGTTKLLLSIPKILDLASELSLPIQSVKYSRGSFIFPEAQPTPHRNFSEEVSALDHFFGNLASGGNAYVIGDPSSPNRNWHIYYATQKPELPTVTLEMCMTGLDSEKASIFFNSPGNANNAQSKKMTKLSGISNIIPEMEICDFEFEPCGYSMNAICGSAHSTIHVTPEDGSSYASYEAMGFNPAELDFGGLVERVLECFGPADFSVAVTIFGGRGQAGSWGREVDSYGFRCVDLVEQELAGGGLLMYQSFTAGVGRMGSPRSTLHCWDGEEIEEKKAEDKKRRF

SEQ ID NO: 13734 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCKRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 13735 - protein, 259 aa, Coccidioides immitis
MTTFLETSRPSEAIGYSFSKESGSNKQHGFYPYTDNGGSTLGITGPDFAILAGDTRSVSGYNINTRFAPKIFKIGADETGEGGHIILSVVGFSADGQALKERLDAIVKMYEYHHGKRMSVKACAQRLSTILYSKRFFPYYVHAILGGLDEDGKGALYSYDPVGSYEREYCRAAGAAASLIMPFLDNQVNLKNQYVKSAEHGGELVQVTPEPLSRATALELVRDAFTSAVERHIEVGDGLQTMIITADGIEEVITPLKQD

SEQ ID NO: 13736 - protein, 542 aa, Ipomoea tricolor
MAFGLSSLLQNSELFTSDHASVVSMNLFVALLCACIVLGHLLEENRWVNESITALIIGLCTGVVILLLSRGKSSHLLVFSEDLFFIYLLPPIIFNAGFQVKKKQFFVNFMTIMLFGAIGTLISCSIISFGAVKIFKHLDIDFLDFGDYLAIGAIFAATDSVCTLQVLSQDETPLLYSLVFGEGVVNDATSVVLFNAIQSFDMTSFDPKIGLHFIGNFLYLFLSSTFLGVGIGLLCAYIIKKLYFGRHSTDREVALMMLMSYLSYIMAELFYLSGILTVFFCGIVMSHYTWHNVTESSRVTTRHSFATLSFVAETFIFLYVGMDALDIEKWKFVKNSQGLSVAVSSILVGLILVGRAAFVFPLSFLSNLAKKNSSDKISFRQQIIIWWAGLMRGAVSIALAYNKFTTSGHTSLHENAIMITSTVTVVLFSTVVFGLMTKPLINLLLPPHKQIASGHSSMTTSEPSSPKHFAVPLLDNQHDSESDMITGPEVARPTALRMLLRTPTHTVHRYWRKFDDSFMRPVFGGRGFVPFVAGSPAEQSPR

SEQ ID NO: 13737 - protein, 254 aa, Elymus caninus
  misc_feature (6)..(6): Xaa can be any naturally occurring amino acid
  misc_feature (50)..(50): Xaa can be any naturally occurring amino acid
DNIMRXTGITGIVNGMDVSEWDPTKDKFLAVNYDITTALEAKALNKEALXAEVGLPVDRKVPLVAFIGRLEEQKGPDVMIAAIPEIVKEEDVQIILLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 13738 - protein, 554 aa, Zea mays
MITGTDFYHVMTAMVPLYVAMILAYGSVRWWRIFTPDQCSGINRFVALFAVPLLSFHFISTNNPYTMNIRFIAADTLQKLIVLALLTAWSYLSRRGCLEWTITLFSLSTLPNTLVMGIPLLKGMYGDFSGSLMVQIVVLQCIIWYTLMLFMFEYRGARILITEQFPDTAGAIASIVVDPDVVSLDGRNDAIETEAEVKEDGKIHVTVRRSNASRSDIYSRRSMGFSSTTPRPSNLTNAEIYSLQSSRNPTPRGSSFNHTDFYSMVGRSSNFAAGDAFGLRTGATPRPSNYEEDPQGKANKYGQYPAPNPAMAAQPAKGLKKAANGQAKGEDGKDLHMFVWSSSASPVSDVFGNGAAEYNDAAAVKEVRMAVASPRKVAADGRKERGEDFAERDDFSFGNRGAAERDAEAGDEKAAAAAAAAQGNAGAVAAPAAMPPTSVMTRLILIMVWRKLIRNPNTYSSLIGLIWSLVCFRWNFEMPAIILKSISILSDAGLGMAMFSLGLFMALQPRIIACGNKVATFAMAVRFLTGPAVMAAASFAVGLRGTLLHVAIVQ

SEQ ID NO: 13739 - protein, 255 aa, Cymbopogon flexuosus
CELDNIMRLTGITGIVNGMDVSEWDPSKDKYIAVKYDVSTAMEAKALNKEALQAEVGLPVDSKIPLVAFIGRLEEQKGPDVMAAAIPQLMEEDVQIVLLGTGKKKFECMLMSAEEKYPDKVRAVVKFNAALAHHIMAGADVLAVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWENVLLSLGVAGGEP

SEQ ID NO: 13740 - protein, 518 aa, Desulfotalea psychrophila
MMPYPQQRLHKEYSNSIVWIGMSTDILINSRSYEVRLALVENGNLSEFHMQRPTEKGLMGNIYKGKVVRVLPGMQAAFVDIGLERTGFLYVDDVSFLPENLEVGCPARNASTNPRTQGIRIEDLLSEGQNIIVQVTKDPIGTKGARLTCHITLPCRNLVFIPQTDHIGVSRKIDDETLREELKKQIEEIRPEGVGFIVRTVAEHATREELEADMEFLLILWDEIIVKISHAKSPELIHEDLDITLRSVRDFFTIDVDRLIIDDEKDYKKLLGFVKTFAPQLHNKISLYTDPIPLFDAYNIEVEIAKAIEKKVWLRSGGYIIIESTEALSVIDVNTGRFVGKNNLNDTIFKTNIEAAKEIADQLRLRNIGGIIIIDFIDMESAEHREQLYETFQEAVKKDKSRINILKLSEFGLVQMTRKRSSENLYQLMCESCHYCSGEGMIKSRRTICYDIFRKLSRHTNKNHGTTVTLRVHPRIADILENEEELTLGTVEKDIGRRIIVASSKDLHIEKYEIIWQQ

SEQ ID NO: 13741 - protein, 255 aa, Cymbopogon jwarancusa
CELDNIMRLTGITGIVNGMDVSEWDPSKDKYIAVKYDVSTAMEAKALNKEALQAEVGLPVDSKIPLVAFIGRLEEQKGPDVMAAAIPQLMEEDVQIVLLGTGKKKFERMPMSAEEKYPDKVRAVVKFNAALAHHIMAGADVLAVTSRFEPCGLIQLQGMRYGTPCACTSTGGLVDTVIEGKTGFHMGRLSVDCNVVEPADVKKVATTLNRAIKVVGTPAYEEMVKNCMIQDLSWKGPAKNWENVLLSLGVAGCEP

SEQ ID NO: 13742 - protein, 77 aa, Fouquieria splendens
MKEQKWIHEGLITESLPNGMFRVRLDNEDLILGYVSGKIRRSFIRILPGDRVKIEVSRYDSTRGRIIYRLRNKDSKD

SEQ ID NO: 13743 - protein, 255 aa, Cymbopogon martinii
  misc_feature (203)..(203): Xaa can be any naturally occurring amino acid
  misc_feature (221)..(221): Xaa can be any naturally occurring amino acid
CELDNIMRLTGITGIVNGMDVSEWDPSKDKYIAVKYDVSTAMEAKALNKEALQAEVGLPVDSKIPLVAFIGRLEEQKGPDVMAAAIPELMEEDVQIVLLGTGKKKFERMLMSAEEKYPDKVRAVVKFNAALAHHIMAGADVLAVTSRFEPCGLIQLQGMRYGTPCACASTGGLVDTIIEGKTGFHMGRLSVDCNVVEPADVKXVATTLKRAIKVVGTPAYXEMVKNCMIQDLSWKGPAKNWENVLLSLGVAGGEP

SEQ ID NO: 13744 - protein, 359 aa, Zea mays
MRTLLPVAAGRGTVACAATPVPRRSLLLSTAAAGAALQPEQVAGTRPLRLTRSEASAVAKPRTLADEAISWAKKDNRRLLHVVYRVGDLDKTINSSARPCWSDDPITQCRFYTECLGMKLLRKRDIPEEKYSNAFLGYGPEESHFVVELTYNYGVDKYDIGEGFGHFGIAVEDVAKTVELIRAKAGKVIREAGPVKGGETVIAFVEDPDGYKFEIIERPGTPEPLCQVMLRVGDLDRAISFYEKACGMELLRKRDSPEYKYTVAMMGYGPEDKDAVLELTYNYGVTEYAKGNAYAQIKQIAIGTDDVYRTAEAAKLSGGQVVREPGPLPGINTKITAILDPDGWKLVFVDNMDFAKELE

SEQ ID NO: 13745 - protein, 255 aa, Cymbopogon obtectus
  misc_feature (146)..(146): Xaa can be any naturally occurring amino acid
CELDNIMRLTGITGIVNGMDVSEWDPSKDKYIAVKYDVSTAMEAKALNKEALQAEVGLPVDSKIPLVAFIGRLEEQKGPDVMAAAIPQLMEEDVQIVLLGTGKKKFERMLMSAEEKYPDKVRAVVKFNAALAHHIMAGADVLAVTXRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNGEDVLLSLGVAGGEP

SEQ ID NO: 13746 - protein, 338 aa, Haemophilus somnus
MNDNSPSPTPITVIGAGAYGTALAIAFSRNGYPTYLWGHHPQHCQRLRNERKNQAFLPNIHFPDSLYVEDNLAQAIQHSRELLIVVPSHVFGDVIMQIKPHLRSDQRIAWATKGLERNTGRLLQEVVEEHVGYGYPLAVLSGPTFAKELAAGMPTAITLASNNEQFALEFQERIHCSKHFRVYINQDMIGVQLGGAVKNVIAIAAGISDGMGFGANARTALITRGIAEISRLGISLGANPNTFMGTSGLGDLVLTCTDNQSRNRRFGLMLGQGFDCTTAINELGPVIEGFYNTKETFLLAQQQGVEMPITEQVYQILFCGKKPEDAAITLLGRKRKRE

SEQ ID NO: 13747 - protein, 255 aa, Cymbopogon commutatus
CELDNIMRLTGITGIVNGMDVSEWDPSKDKYIAVKYDVSTAMEAKALNKEALQAEVGLPVDRKVPLVAFIGRLEEQKGPDVMAAAIPQLMEEDVQIVLLGTGKKKFERMLMSLEEKYPDKVRAVVKFNAALAHHIMAGADVLAVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWENVLLSLGVAGGEP

SEQ ID NO: 13748 - protein, 284 aa, Picea mariana
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGGGGAGHFVMEQFIPEQAVISDSSISSVKTEVCSGSGGTVVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 13749 - protein, 600 aa, Rhodobacter sphaeroides
MLDQSESLALASLVAELERALVAQDAEAVADCFLETGFWRDLAAFTWNIKTCEGKGEIRAMAGAQLGAIGPQALALDPAETVSSADGVTEGWLTFETATGRGMGHIRMKDGKVWTLLTALHELKGHEEPRRLRRPMGAEHGHDPHRKTWKEKREEEARRLGYEEQPYVLIVGGGQGGIALGARLRQLGVPTIILEKNERPGDSWRRRYKSLCLHDPVWYDHLPYIPFPDNWPVFAPKDKIGDWLEMYTKVMELNYWSSSTARSARYEEAAGEWTVVVDRNGEEVVLRPKQLVLATGMSGKANVPSFPGQDIFRGEQQHSSQHPGPDAYKGKKVVVIGSNNSAHDICAALWEGGADVTMVQRSSTHIVKSDSLMEVCLSGLYSEQAVAQGIDHEKADMIFASVPYRIMHEFHIPQYEEIQRRDADFYDALRKAGFLLDFGDDGSGLFMKYLRRGSGYYIDVGACDLVIDGSIKLKSGSDVSHLTEEAVVLKDGTELPADLVVYATGYGSMNGWAADLISPEVADKVGKCWGLGSDTTKDPGPWEGEQRNMWKPTMQEALWFHGGNLHQSRHYSRYLALQLKARQAGIETPVWGLQPPSHLR

SEQ ID NO: 13750 - protein, 553 aa, Aspergillus oryzae
MPAFSQATDLSAWKELQEHHTAVGRNIVLKEAFEKDPQRFEKFSRTFKNTVDNSDILFDFSKNFLTEETLSLLVKLAKEANVEELRDAMFKGEHINFTEDRAVYHAALRNVSNEPMQVDGKSVVEDVNSVLEHMKEFSEQVRSGEWKGYTDKKIDTIINIGIGGSDLGPVMVTEALKPYGAPGMKLHFVSNIDGTHIAEALKDSNPETTLFLIASKTFTTAETTTNANSAKKWFLETAKDESHIAKHFVALSTNEAEVTKFGIDKKNMFGFESWVGGRYSVWSAIGLSVALYIGYDNFHQFLAGAQAMDKHFREAPLEQNIPAIGGLLSVWYSDFFGAQTHLVAPFDQYLHRFPAYLQQLSMESNGKAITRSGEYVKYTTGPILFGEPATNAQHSFFQLLHQGTKLIPSDFIMAAESHNPVEGGKHQRMLASNFLAQSEALMVGKTPEQVKTEGAPDNLVPHKTFLGNRPTTSILAQKITPSTLGALIAYYEHLTFTEGAVWNINSFDQWGVELGKVLAKKIQQELETSGAGAGHDASTSGLLAAFKQKANLA

SEQ ID NO: 13751 - protein, 301 aa, Sulfolobus solfataricus
MFGWHWLLEWQTPYEFHGHLIEKVLAEEKTPYQHVTLVEFTRFGKGLIIDGKVQSTLYDEHIYHELLVHPLLLSLTKPPKSVLILGGGEGATLREVLKYKSVEKAVMVDIDEKVIEFAKKYLYEWHQGAFEDKRTNLVITDGLKFIKETKEKYDAIILDLTDPIKNSTSYMLYTKEFYEKLREILNERGGIVTQATSPSFSLEVYVTIYNTIKEVFKEASASYTYMASFDGLWGFVYGGVRPDLLSEDEVDSKINERIDGQLRFYDGYSHKISFSLPKNIKSEFQKITKISTEKDPIYVPA

SEQ ID NO: 13752 - protein, 565 aa, Alkaliphilus metalliredigenes
MEKISNMIKGEMNLENLMFCYQCEQTMGGKACTKNGVCGKTPEIANLQDLLIYQLKGIACYAKPLMEMEQSLDEEIIKFVEDSLFTTLTNVNFDLETHMKLLKESQKIKETLREQAPKGQYPDAATYNLSITKEEMLKDAVVAGIMYDKDLDENIRSLRSTILFGLKGVSAYGHQARFINYQSDKVNEFYFLGLEATTNDQLTVEDLIGFTMKTGEMSVEAMRVLDEANTTTYTNPAPQKVNVNTKKGPFIIISGHDLRDLEMLLQQTEGKGVNIYTHGEMIPAHGYPSLNKYKHLVGNFGSAWQNQQKEFDGVPGCILMTTNCLMRPRASYKDRLFTTNVVGFDGVKKIDVKEDGTKDFSEIINKALELGGFEEDQEVKEILVGFGHHATLSHAGTIVNAVKEGAIKHFFLIGGCDGAKPGRNYYTEFAEKVPKDCVILTLACGKYRFNKLDFGTVAGLPRLLDVGQCNDAYSAVQIAAALADAFETDINSLPLTIVLSWYEQKAVADLLALLSLGIKGMYLGPSLPAFISPNVLQYLVDNFDIKPISNVDEDLSNALGDVEYA

SEQ ID NO: 13753 - protein, 285 aa, Schizosaccharomyces pombe
MNIASDNTKPIVLFVVKGGERNITDQRTLEYELLNRFHVISKRIDIAELTSLIHDKSSNKLYMKTSFTTYEVAVVYYRVGYALDDYPSQERWDMRLTIENTLAIKCPSISTHLAGSEKIQQVLAESNALERFLEGDELQAVRSTFADMYPLDDTPRGKEGIKLAFEKPEDFVLKPQREGGGNNTYGKDIPGLLSKMPQEEWDSYILMRYINAVPSQNYILKGERPEKFDVVDEIGILGTIVWNINTDEVVQNGQSGFICRTKPKKTNEGGVATGYASLSSIELSE

SEQ ID NO: 13754 - protein, 316 aa, Triticum aestivum
LPPRVSAGTAGPSRILCDLNVDPVAPPPPPPDDLMADTMGHCAPGGCASAAGGPEHAALERHVLAALRELMMLMKQGEPMWQPAALGGEVLDHQLYRATTLPGLLELPPPGFTANGTRDTGLVMCTGADLVRIFMDENCWSETFPDIVASVSADNIGHGCICQGGVILMKAGLRVLSPGVSSCDVKFVRQCQMIEQGVWAVVDVSLDANGTSELRAWNTGLPGACRVLPSGCLIKDMNNGYCKVAMIVNAEYDKGFMRPPLRPLLSSGHTFSARRWLTSLQRRCEFLAQRLSPAYGISRAGGAITPEGRNNVLELA

SEQ ID NO: 13755 - protein, 237 aa, Glycine max
  misc_feature (194)..(194): Xaa can be any naturally occurring amino acid
MSSSSTSFSPDQHLSPSDQLCYVHCNFCDTVLAVSVPCTSLFKTVTVRCGHCTNLLSVNMRGLLLPSANQLHLGHSFFTPQNLLEEIRNAPSTNMMMNQLPNPNDLVMSTMRGGPEETPKPPSANRPPEKRQRVPSAYNRFIKDEIQRIKAGNPDISHREAFSAAAKNWAHFPHIHFGLMPDNQPVKKANGSSXKQRTCLWKEGFFRTLMEGGSPPTRGGFNIGGALGSGGVTPACL

SEQ ID NO: 13756 - protein, 84 aa, Yarrowia lipolytica
MAGGRGLRKGINKPTIRRLARRGGVKRISSNIDPDSRDIVKDVIKQVLGDALFYTHHARRNTVTGVDVVHALKRQGRPLYGFDA

SEQ ID NO: 13757 - protein, 98 aa, Aphanizomenon flos-aquae
MATYKVTLIDAEGTTTTIDCPDDTYILDAAEEAGLDLPYSCRAGACSTCAGKLVTGTIDQSDQSFLDDDQVEAGYVLTCVAYPTSDVTIETHKEEDLY

SEQ ID NO: 13758 - protein, 99 aa, Nostoc muscorum
MATVYKVTLVDQEGTETTIDVPDDEYILDIAEDQGLDLPYSCRAGACSTCAGKIVSGTVDQSDQSFLDDDQIEKGYVLTCVAYPTSDLKIETHKEEDLY

SEQ ID NO: 13759 - protein, 477 aa, Unknown
  Synechococcus sp. WH 8102
MTTPRVLFWHRRDLRLTDNLGLAAAAAISPAVTGVYVLDPQVISPSEHLLPMAPARLWFLIESLIELQQRWRDAGSRLLVVEGDPVQLLPQLAERIAAEAVVWNRDVEPYARERDRQVAQRLQADGRKVVVDWDQLLIAPELLKTGGGDPYRVYGPFLRNWRGQVQAKQPVTVPAPAGLVDLDPAAVPSGEPLMARRDSHGFKGTELCPCRPGEAAAMQQLTSFCDGALFGYEPDRNFPGVVGTSYLSAALSVGTLSPRQAWSAAQEAREQARSEEQLHAIAVWEQELCWREFYQQALFHFPELSDGPYREQWRRFPWENNEDWFDFWREGQTGMPIIDAAMRQLNQTGWMHNRCRMIVASYLVKDLICDWRWGERAFMELEVDGDLAANNGGWQWSASSGMDPKPLRIFNPATQASKFDAAGDYIRQWVPELRHVNTKDLLSGEIGALERRDYPEPLVNHKTQQAKFKALYATIRS

SEQ ID NO: 13760 - protein, 851 aa, Oryza sativa
MALLQFGGTLAPKLGEKPQLLPRSPALTRVIYADPRFLVSKSGSGGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGRAARNRPMQGDDEAYNLVLNFKEAVFGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTLVMSKKGVPLLGKSNARGDQLKHQTILIVIEIDIVQNIGRQAAAAVAGGVGEKARWWWLCRRRGVAATGWAVVHGRISGWLMAVATLFAGDGPGGGGLHEGRRMMILDNFETSGRRRRQRGSRALHDLRLPNPSRLLARRPRLPSPRLPLAPISILLAEVAPASSCSRRIRILIHPIRPRPRISSPRPPLAPIPILRAEVAPGVLLLPPHRRSPEIGEKLSDIDGRLDYPLLNKELVLDVKRLWQDPAIQETYLRGSILQLPDCAQYFMENLDRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEVPLSVCEWFKDYQPIAPGKQEVEHAYEFVKKKFEELYFQSSKPDRVDRVFKIYRTTALDQKLVKKTFKLIDESMRRSREGT

SEQ ID NO: 13761 - protein, 324 aa, Pseudomonas syringae
MQLGIIGLGRMGGNIARRLMLNGHTTVVYDRDEASRNALANDGSTAVADLKELVGALARPRAVWVMLPAGAPTEETIQTLSQLLDADDVIIDGGNTFYKDDIRRAQELTEKGLHYVDVGTSGGVWGLERGYCMMIGGEAAVVERLDPLFATLAPGLGSIERTRDRTSTDDRAERGYIHSGPAGSGHFVKMIHNGIEYGMMQAFAEGFDLLKQKNSELLPPEQRFDLNTADIAEVWRRGSVVSSWLLDLTADALATDPHLDAFSGSVADSGEGRWTIEAAIEQAVPVPVLSSALFARFRSRQTSSYADKMLSAMRFGFGGHKEPK

SEQ ID NO: 13762 - protein, 441 aa, Magnetospirillum magnetotacticum
MSAAAASMVGGQGTVVAAGGLLVLCMGLWATGLVAEIVTALMFFALAMLLELAPAQTVFSGFASSAFWLVTSGMVVGLAMNRTGLGDRLARRLAAQLPASYPGFVAGLVAFSFLLAFVMPSNLGRIALMVPVVIALCDAFGLEAGRPGRTGAVLAFGIATPMLSAAILPANVPNLVMAGTAETLFGIHLGYLPYLFLHAPVLGFVKGALLVACTVLLFPDRLDGKRPELPPLPPLSGEERRLAAILTVMLGLWLSDGWHGIPPAWIGLAAAVICLLPGVGVLSPQSFGEIPLKTCFYVAALFGLTGIVNETGLGADLGHALLGLAPLEPGAPARNFATLTGLSIGFLFAATANGAPALYTALAEEFSRASGFDLMSVLMVQVVGYSTLFLPYQAPPIVMAMDLGRVSLRDATKLTLATGIVSFLAATPLAYLWFRLTGGLA

SEQ ID NO: 13763 - protein, 99 aa, Nostoc muscorum
MATYKVRLFNAAEGLDETIEVPDDEYILDAAEEAGLDLPFSCRSGSCSSCNGILKKGTVDQSDQNFLDDDQIAAGNVLTCVAYPTSNCEIETHREDAIA

SEQ ID NO: 13764 - protein, 98 aa, Cyanidium caldarium
ASYKIHLVNKDQGIDETIECPDDQYILDAAEEQGLDLPYSCRAGACSTCAGKLLEGEVDQSDQSFLDDDQVKAGFVLTCVAYPTSNATILTHQEESLY

SEQ ID NO: 13765 - protein, 604 aa, Medicago truncatula
MITLTDFYHVMTAMVPLYVAMILAYGSVKWWKIFSPDQCSGINRFVALFAVPLLSFHFIASNNPYKMNLRFLAADTLQKLIILCLLAIWSNFSKRGCLEWTITLFSLSTLPNTLVMGIPLLKGMYGEFSGSLMVQIVVLQCIIWYTLMLFMFEFRGARLLISEQFPDTAGSIVSIHVDSDVMSLDGRTPLETDAEIKEDGKLHITVRKSNASRSDIYSRRSQGLSSNTPRPSNLTNAEIYSLQSSRNPTPRGSSFNHTDFYSMMGGGNGRNSNFGANDVVNNYGLSANSRGVTPRPSNYEEEANNNAKKFKNYPAPNPGMFSPTNNNNGSKNLGSNVSVNAKKSNGQSQQKQEDLHMFVWSSSASPVSDVFGGHDFGAHDQKEVKLNVSPGKVEGHRETQEDYLEKDEFSFGNKGMEREMNQHEGGEKGGDGKSKVMPPASVMTRLILIMVWRKLIRNPNTYSSLIGLTWSLVSFRYHIEMPAIIAKSISILSDAGLGMAMFSLGLFMALQPKIIACGNSIAAFSMGVRFLVGPAVMAAASFAVGLKGVLFHVAIVQAALPQGIVPFVFAKEYNVHPDILSTGVIFGMLIALPITLVYYILMGL

SEQ ID NO: 13766 - protein, 785 aa, Oryza sativa
MTTLPTAILLLLLLLALPPPSAVVALTADGLALLALKAAVTDDPLSVLSSWSESDPDPCRWPGVTCSNVTAAGGEPRRRVVGVALAGKNLSGYIPSELGSLLFLRRLNLHDNRLAGGVPAALSNASSLHSLFLYGNRLTGALPAALCDIPRLQNLDVSRNALSGGLPGDLRNCRSLQRLILAGNSFSGEVPAGIWAEMASLQQLDISSNGFNGSIPADLGELPRLAGTLNLSHNRFSGVVPPELGRLPATVTLDLRFNNLSGAIPQTGSLASQGPTSFLNNPGLCGFPLQVPCRAVPPPTQSPPAPTTTTTTTTPSSASAAAAAASEHHQPIRTSLIALISIADAAGVALVGVILVYVYWKVKDRKKQGRSSTVAAGDENESRHGLCRCIWGHRGVDSDTDTDDSSASENGGGGGKYGEGELVAIDRGFRVELDELLRSSAYVLGKGGKGIVYKVVVGNGATPVAVRRLGGGGGGGERCKEFAAEARAVGRARHPNVVRLRAYYWSADEKLVVTDFVGNGNLAAAMRGRPGQTPLSWSTRLKIARGAARGLAYLHECSPRRFVHGEVKPSNILLDADFTPRVADFGLARLLAVAGCADDVVDAPPAAPSSGGLLGGAIPYAAKPASSVAADHRGGGYRAPEARTAGARPAQKWDVFSFGVVLMELLTGRGPGDHASPSTSASFSAPSSSSAATTDRSGSGEHGHGAGVGGAVVPEVVRWVRRGFEEEARPVSEMVDPALLRDAPPLPKKEVVAAFHLALACTELDADLRPRMKAVADTLDKIASS

SEQ ID NO: 13767 - protein, 464 aa, Triticum aestivum
MVVTDECLDMIASSFRNFQVLRLVSCEGFSTAGLAAITEGCRNLRELDLQENYIEDCSSHWLSYFPESFTSLETLNFSCLEGEVNFAVLERLVSRCRNLKTLKLNNAIPLDKVASLLRKAPQLVELGTGKFSAEYHSDLFAKLEAAFAGCKSLRRLSGAWDAVPDYLPAFYCVCEGLTSLNLSYATVRGPELIKFISRCKNLQQLWVMDLIEDHGLAVVAGSCSKLQELRVFPSDPFGAGQVLLTERGLVDVSASCPMLESVLYFCGQMTNEALITIAKNRPNFTCFRLCILEPRTPDYVTRESLDAGFSAIVESCKGLRRLSVSGLLTDLVFKSIGANGNCLEMLSIAFAGNSDLGLHYILSGCKSLKKLEIRDCPFGNKPLLANAAKLETMRSLWMSSCSLTLGACRQLAEKMPRLTVEIMNDPGRTCPVESLPDDSPVETLYVYRTIAGPRSDTPDYVQIV

SEQ ID NO: 13768 - protein, 99 aa, Chlorogloeopsis fritschii
MATYKVTLINDAEGLNQTIEVDDDTYILDAAEEAGLDLPYSCRAGACSTCAGKIKSGTVDQSDQSFLDDDQIEAGYVLTCVAYPTSDCTIETHKEEELY

SEQ ID NO: 13769 - protein, 428 aa, Triticum aestivum
MASEGEHAAAAAAAGEQTPLKKAGEAEQGEELQAPSGWTKKLNPTRGGKFEVVFVAPTGEEVKTKRALTTYLKAHPGGPALSEFVWATGNTPRRSSRLSAKPKATESPEDEKPSRRSGKPSSSKKGKKGKQEDAEDAEAESGDHADAEEAKGTEVEMKDAEEAKVTDLDLEMKEADNAQEEKKEEEAGSLVGEKKEADTVAPEEKKEADTVAPEEEKKEADTVAPEEKKEAGTVAPEEKKEADTVAPEEKKEADTVAQEEKKEADTVAQEEKKDAPVVDAPEKTEEVEGEAAESEVAPVEAEMPDPVTENKENEKPAEFEEVPVEFEMSDLAAEYEVAPVEGEKTENGLAVESTVPPPASSEEKKVEADSTINPATPPPAEVKADAPAAEAAKATENPADNAVPEEQSAANVDNNGQIHPGVSTVRCT

SEQ ID NO: 13770 - protein, 474 aa, Bradyrhizobium japonicum
MRFLPVFLDLKAGPVVLIGAGELLRAKLRVLTAAGARIRVHAIDGNQDMGLSSEDAARVDIATGDPLIADLSGVIAIVCAGAGDVGVAMSARAKALGLPVNVMDDLEHSSFIFPAIVDRGDVVVAVGTGGTSPVVARRVREKIEALLPARIGELAEFIGDFRKSINERIAEFPLRRRFWERVIDGPIGGAVLAGRKGEADAALKAIADPAAFARADKPEGSVALVGAGPGDPDLLTIKALRALQDADIVFHDELVSREILDRIRRDTTRVAVGRRVGKPGIGQDAINTRMIEAAQSGQRVVRLKGGDPFVFGRGGEEVEALRSAGVAYSIIPGITAGLGGAADFEVPLTYRHEATRITFLTAHRARDAEAVDWSTLTDTKMTVVVYMGMTAAPAVRAGLFAAGRSPETPVGVFARVTRPDAQGAIGTLRDLPELVRRTHGGPAMLIIGDVVRHAGSLRRQTPKQIISDLLDAAE

SEQ ID NO: 13771 - protein, 181 aa, Brassica napus
  misc_feature (7)..(7): Xaa can be any naturally occurring amino acid
NVYVQFXKEEDQAAAALRALQGRSYLGRPIIGEYSPVTDFREATCRQYEEENCSRGGYCNFMHVKLVSREMRRKLFGRRSYRRGSRSRSISPRGRREYGRRGGDRDPPRREFNHRDRDGEFYRHGSGKRSERGGRDRDRDRDRDGSRRRERSPGGGREGSEERRARIELWNREREEKEEEA

SEQ ID NO: 13772 - protein, 727 aa, Pseudomonas syringae
MNTKSTTPAEDNSAPLDNPGSTPSRIREGLPFPLGASWDGLGVNFALFSANATKVELCLFDSTGEIELERIELPEYTDEIYHGYLPDAHPGQIYGYRVYGPYDPKNGHRFNHNKLLIDPYAKQLVGELKWSEALFGYTIGHPDGDLSFDERDSAPFVPKSKVIDEAYTWGRDQRVGTPWDKTIFYETHVRGITMRHPEVAEELRGTFAGLGSAPVVEHIRKLGVTSVELLPIHAFVNDQHLLQKGMTNYWGYNSIAFFAPDPRYLASGKIAEFKEMVAHLHHAGLEVILDVVYNHTAEGNELGPTLSMRGIDNASYYRLMPDDKRYYINDSGTGNTLDLSHPCVLQMVTDSLRYWASEMHVDGFRFDLATILGRYHDGFDERHSFLVACRQDPVLRQVKLVAEPWDCGPGGYQVGGFPPGWMEWNDKFRDTVRAFWKGDEAQLADFAARMTASGNMFNQRGRRPQASVNFITAHDGFTLHDLVSYNDKHNEANDENNQDGSNNNLSWNHGVEGPTEDPEINSLRLRQMRNFFATLLLAQGTPMIVAGDEFARTQHGNNNAYCQDSEIGWINWDLDEDGEALLKFVTRVIKLRQTYPILRRSRFLVGDYNEEIGVKDVTWLAPDGNEMSVEQWHDANGRCLGMLMDGRAQETGIRRAGADATLLLVVNAHHDGVNFTLPEVPEGTHYECLIDTNQDDARSKEHFAFGSQYTVTPRSLLLFELKREDQQ

SEQ ID NO: 13773 - protein, 418 aa, Desulfotalea psychrophila
MTLEETIVEVGVRAKAAAADLMSLATRQKDAVLSQVGELLVAEKAFLQEENEKDLAAGREKGLSDAMLDRLALTDSVIESMVKGLKEVIALPDPVGRTLGSVKRPNGLSVGRMCVPLGVIAMIYESRPNVTIDAAALCLKAGNAIILRGGSEAIHSNLALASILRRALEEAEVNPDSVQVIPMIDREAITIMLGLEDSIDLVIPRGGEGLIRFVSKNSSIPVLKHYKGVCHAYIDKDADLAKVAPIVINAKTQRPGVCNALEGILIHEDIVADVLPGLATELAELGVEMRGCSQSLPFSEHIVAASEEDWGTEFLRLCLCVKVVRSFEDAKSYIRKYGSQHTEAIITENYTTAHRFVAEVDASAVVVNASTRFNDGGELGLGAEIGISTTKLHAYGPMGLEELTTKKFVILGDGQIRS

SEQ ID NO: 13774 - protein, 471 aa, Aeropyrum pernix
MLVYPQLEHPWIPNSHKAILDEMLEAIGVSSVDDLYRDIPPTILLSPEEWDSLPIGEGRPLSEAEVLARINDILSRNKYFTDPPPFVGGGVWPRYVPSVVKALITRGEFLTAYTPYQAEISQGLMQALFEYQSLVAELLEMEVVNASLYDWSSAVGEAMLMARRVTRRNRVLVPETMNPLHLETATTYAYGGGIRVEKVRVDRETGFIDLEDLESRLSQGDTAALYMEYPSSYTGVIDENVEAAGEAVHKAGGLFILGVEPVSMAILKPPGRLGADIAVGDGQPLGLGLNYGGPYLGVFAVRWDGRLVRQMPGRLIGMTVDAEGRRAFAMILQTREQHIRRAKATSNITTNEALMAIAAAVYLSLLGPQGLREVAEASWYMSHYAAKRLSELRGVEAPLLEGEFIMDFTVRLPMDAGVARRRLLEKGVLAGIPLGGFSFFSDNDMLLTVTEAHTRRHVDLLVNLLDSVLGG

SEQ ID NO: 13775 - protein, 384 aa, Desulfotalea psychrophila
MMVDVTEELQLRREIFDKARRVVVKVGSAILTNVGGIHTSFIADLAREISYLRQSGHEVILVSSGAVAAGRKKISWQDSAPLGMKEKQALAAIGQSHLMRTYEEAFGFYELDVAQILLTHADLSHRDRYLNIRNTILTLLKFGVTPIINENDTVSVEELKFGDNDTLAALLTNLLEADICICLTDVDALYDKNPQKDPTARPLHIVTKISPEIEAMAGNSNSLFGTGGMQSKIRAAKIVFSGGGTAIIGPGRAPRVLQRLFAGEDIGTIFLPCKERMKSKKQWIAHVLKPKGTLLLDAGACKALLQGGKSLLPSGIVGISGEFDRGDSVNCCRLDGSRIAVGLVNYASVDVNAIKGLQSREIASVLKCCDNEEVIHRDNLVILS

SEQ ID NO: 13776 - protein, 246 aa, Synechococcus elongatus
MFGLFGKKTGLPTPEEALPGRAQAMLVPAKHFVLGTPLDGPFPVGIQLALFGNGCFWGTEKQFWQLPGVYSTAVGYAGGLTPNPNYREVCSGMTGHNEVVRVAYDPDRISYADLLKAFWESHDPTQGMGQGPDRGTQYRSGIYCYTPEQKQIALASQAAYQAVLKAKGYGAITTEIIDAPTFYFAEEYHQQYLDKPGSRPYCGAQPTGADLPHPNQWNLPTELQSHLTAHPEVWSKNFAECPVVPH

SEQ ID NO: 13777 - protein, 521 aa, Aeropyrum pernix
MVWRQSRWNEPLITEMSRRGRRGALPPRPDEKVVKEVGPLKLPQSLARGSPPSLPEVSEVEVVRHYTRLSQMAYGVDNGPVPLGSCTMKYNPRVAARLAFDPRLETLHPLQDDETVQGVLEAIYMVQEWLRHITGMDACTVHPAAGSQGELAGVLMIKRFHEMRGDLDKRRVIIVPDSAHGTNPASAAMGGFQVVEVPTGDDGNVDMEALKAAVGGDTAGLMITNPSTLGLFEENILEISRLVHEAGGLLYYDGANLNGIIGRARPGDMEFDIAHVNLHKTFSVPHGGGGPGSGPVCVKRVEVVDGVTLEDLLPGPRVVYSREEGLYRVRPPGRWSVGRLRAWIANTLAVLWAYAYILAMGPQGLRLAGEVSVVNTNYFIRLMEGHWGYSLPYAPSRPRKHEVVLSAKPLKRETGATAEDVAKGLLDAGLYAPTIYFPLIVEEALMIEFTESETKENIEAYAARLKEIAEEARRDPSTPRKWPRNTTSARVDNVRANHPRTVTPTWRVEVLRRQGKLGPLR

SEQ ID NO: 13778 - protein, 265 aa, Cymbopogon pospischilii
CELDNIMRLTGTTGIVNGMDVSEWDPSKDKYIAVKYDVSTAMEAKALNKEALQAEVGLPVDRKVPLVAFIGRLEEQKGPDVMAAAIPQLMEEDVQIVLLGTGKKKFERMLMSAEEKYPDKVRAVVKFNAALAHHIMAGADVLAVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWENVLLSLGVAGGEAGDRSGIAPLA

SEQ ID NO: 13779 - protein, 481 aa, Arabidopsis thaliana
MEVEGKGGEAGTTTTTAPRRFALPVDAENKATTFRLFSVAKPHMRAFHLSWFQFFCCFVSTFAAPPLLPVIRENLNLTATDIGNAGIASVSGAVFARIVMGTACDLFGPRLASAALTLSTAPAVYFTAGIKSPIGFIMVRFFAGFSLATFVSTQFWMSSMFSGPVVGSANGIAAGWGNLGGGATQLIMPIVFSLIRNMGATKFTAWRIDLPDGDYWAMHKSGEREKDDVGKVISNGIKNYRGWITALAYGYCFGVELTIDNIIAEYFFDRFHLKLQTAGIIAASFGLANFFARPGGGIFSDFMSRRFGMRGRLWAWWIVQTSGGVLCACLGQISSLTVSIIVMLVFSVFVQAACGLTFGVVPFISRRSLGVVSGMTGAGGNVGAVLTQLIFFKGSTYTRETGITLMGVMSIACSLPICLIYFPQWGGMFCGPSSKKVTEEDYYLAEWNDEEKEKNLHIGSQKFAETSISERGRATTTHPQT

SEQ ID NO: 13780 - protein, 461 aa, Pseudomonas putida
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPSSQVSGTSHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRAALDS

SEQ ID NO: 13781 - protein, 255 aa, Cymbopogon refractus
  misc_feature (243)..(243): Xaa can be any naturally occurring amino acid
CELDNIMRLTGITGIVNGMDVSEWDPSKDKYIAVKYDVSTAMEAKALNKEALQAEVGLPVDSKIPLVAFIGRLEEQKGPDVMAAAIPQLMEEDVQIVLLGTGKKKFERMLMSAEEKYPDKVRAVVKFNAALAHHIMAGADVLAVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWEXVLLSLGVAGGEP

SEQ ID NO: 13782 - protein, 255 aa, Cymbopogon schoenanthus
CELDNIMRLTGITGIVNGMDVSEWDPSKDKYIAVKYDVSTAMEAKALNKEALQAEVGLPVDSKIPLVAFIGRLEEQKGPDVMAAAIPQLMEEDVQIVLLGTGKKKFERMLMSAEEKYPDKVRAVVKFNAALAHHIMAGADVLAVTSRFEPCGLIQLQGMRYGTPCACTSTGGLVDTVIEGKTGFHMGRLSVDCNVVEPADVKKVATTLKRAIKVVGTPAYEEMVKNCMIQDLSWKGPAKNWENVLLSLGVAGGEP

SEQ ID NO: 13783 - protein, 435 aa, Oryza sativa
MALPCAFLSAAAAANATSFSSSPESRRCRSVHRVPSRPRPPLAPPARVMGKGNSKRKAANTRLWMRLDRRGGCEMILCDKSFVARRSGLPARDLRVLSPLLSRSPSILAREKAMVINLEFVRAIVTADEVLVLEPLAQEVLPFVEKLRKYFPLKSLDVDDVSTHMHTENQDGELAQDVSCYEVEGANHELPFEFQVLDFALEAVCLSYNSTISDLNRSAIAVLDDLMKSVSTRNLERVWSLKSSLTRLLASVQKVRDEVEHILDDNEAMAHLCTARKTKGQKDLLNTILFPETRLCRTHSSIENSTGIRTCVPSDSDAHILDMLLEAYFKQLDGIRNRIFLVRQYIVDTEDYISIQLDNKRNELLGLQLTLIIASFGIAINTFIAAAFAMNIPHRGYHFVIGVPFGQFVGATSFLCMSIVILLFTYAWRNRLLCT

SEQ ID NO: 13784 - protein, 112 aa, Oryza sativa
  misc_feature (18)..(18): Xaa can be any naturally occurring amino acid
RRCTTGASSVMGSTGELXAAVKGRSLHIQAPRRVELRVRAAATAVAFEAAEVDYSSNISVIPTEACNLIRGEAYNVQMYPEAKLSSSDAAAATYATAEEVHRDYLWYDEPTT

SEQ ID NO: 13785 - protein, 255 aa, Danthoniopsis dinteri
  misc_feature (248)..(248): Xaa can be any naturally occurring amino acid
CELDNIMRLTGITGIVNGMDVSEWDPSKDKYITVKYDAATAVEAKALNKEALQAEVGLPVDRKIPLVAFIGRLEEQKGPDVMAAAIPELMEEDVQIILLGTGKKKFERLLMSAEEKYPDKVRAVVKFNAPLAHHIMAGADLLAVTSRFEPCGLIQLQGMRYGTPCACASTGGLVDTVIEGKTGFHMGRLSVDCEVVEPADVKKVATTVKRAIKVVGTPAYEEMVKNCMMQDLSWKGPAKNWENVLLSXGAAGSEP

SEQ ID NO: 13786 - protein, 305 aa, Arabidopsis halleri
LVYLNNVAEGCVGRVAAKLEMMEPCSSVKDRIGFSMISDAEKKGLIKPGESVLIEPTSGNTGVGLAFTAAAKGYKLIITMPASMSIERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVKSAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAESMTFEA

SEQ ID NO: 13787 - protein, 789 aa, Clostridium thermocellum
MREKKIFSKRTKALIVSFVILALMVFPVGTVNISAANVEYNYAKALQYSIYFYDANMCGTGVDENGQYNWRGDCHVYDAELPLDSVNTNMSDAFIRENISVLDPDGDGKVDVSGGFHDAGDHVKFGMPEAYSGSTLGWGYYEFREQYKQTGQDQHIETILRYFNDYFMRCTFRDKDGNVVAFCYQVGDGDIDHAYWNPPEIDDMFRRGWFATKHLPSTDCVSAAAASLAVNYFNFKDTDPEYAEKSLDYAKALFDFAQKNDKEVNADGPKGYYTSSKWQDDYCWAAAWLYLATQDDNYLNELFKYYDYYAPSCWTHCWNDVWAGTACILAQIDDLYDKDSEEFENRYRQAANKSPYEPIDFWAEVAKLVENWMYGKTVTITPGGYAFLNKWGSARYNTATQFVALVYDKHHGDAPSAYSQWARSQMEYLMGNNPLNRCYIVGYSDISVKFPHHRAASGLSKCEDPDPHKYVLYGALVGGPDENDQHIDMTSDWVYNEVTIDYNAAFVGACAGLYRYFGDPSMEITPNFPPKVEISDPDNGGSYWVEAFGVDIVQSDGPKATEVTLYVRSDSRKPSKNISVRYFFDATGMSSVDPDKMEIRQLYDQTAAETDYAAKLTGPHHYKDNIYYVEISWEGFAIANSNKKYQFALGTYTWGNSWDPTDDWSYQELKIEESNYTGTPARNNRICVYDAGVLVGGIEPDGTTPQSPTPSPTPTPPQEPEFTYGDLNGDGRVNSSDLALMKRYVVKQIEKLNVPVKAADLNGDDKVNSTDYSVLKRYLLRSIEVIPIK

SEQ ID NO: 13788 - protein, 112 aa, Photobacterium profundum
MKKIEAVIKPFKLDDVREALAEVGITGMTVSEVKGFGRQKGHTELYRGAEYMVDFLPKVKLEIVVTDEVAEQCIETIIETAQTGKIGDGKIFMFDVERVVRIRTGEEDEDAI

SEQ ID NO: 13789 - protein, 255 aa, Dichanthium aristatum
  misc_feature (51)..(51): Xaa can be any naturally occurring amino acid
  misc_feature (71)..(72): Xaa can be any naturally occurring amino acid
  misc_feature (83)..(83): Xaa can be any naturally occurring amino acid
  misc_feature (199)..(199): Xaa can be any naturally occurring amino acid
  misc_feature (240)..(240): Xaa can be any naturally occurring amino acid
  misc_feature (242)..(242): Xaa can be any naturally occurring amino acid
  misc_feature (254)..(254): Xaa can be any naturally occurring amino acid
CELDNIMRLTGITGIVNGMDVSEWDPSKDKYITVKYDVSTAMEAKALNKEXLQAEVGLPVDSKIPLVAFIXXLEEQKGPDVMXAAIPELMEEDVQIVLLGTGKKKFERMLMSAEEKYPDKVRAVVKFNAALAHHIMAGADLLAVTSRFEPCGLIQLQGMRYGTPCACASTGGLVDTIIEGKTGFHMGRLSVDCNVVEPXDVKKVATTLKRAIKVVGTPAYEEMVKNCMIQDLSWKGPAKXWXDVLLSLGVAGGXP

SEQ ID NO: 13790 - protein, 284 aa, Picea mariana
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDYQKVGAPPDVVSELDELSQKCHAQQCVATISIGADPELDQFMEAYCEMFIKYQEEL

SEQ ID NO: 13791 - protein, 352 aa, Dichanthium aristatum
NIYDLKADEKTKSWKKLVNVAVSGAAGMISNHLLFKLASGEVFGQDQPIALKLLGSERSFTALEGVAMELEDSLYPLLREVSIGIDPYEVFQDADWALLIGAKPRGPGMERAALLDINGQIFADQGKALDAVASKNVKVLVVGNPCNTNALICLKNAPSIPAKNFHALTRLDENRAKCQLALKAGVFYDKVSNVTIWGNHSTTQVPDFLNAKIDGKPVKDVIKDTKWLEEEFTITVQKRGGALIQKWGRSSAASTAVSIADAIKSLVTPTPEGDWFSTGVYTTGNPYGIAEDIVFSMPCRSKGDGDYELATDVSLDDFLWEKIKKSEAELLAEKKCVAHLTGEGNAYCDVPD

SEQ ID NO: 13792 - protein, 502 aa, Xylella fastidiosa
MHNGFDALQLHANRLRGVTIPDLLAAELKRPEQYARQVGPLYFNFARQKYDCVALEALFALARNHNVAGAFQRMFCGEQVNVTEGRAVLHTALRGDLSGTSVAVAAYTAAAKVRERMYALIAGLDASEVTDIISVGIGGSDLGPRLVVDALRPISQGRFRVHFVSNVDGAAMRRTLDMLDPSRTAGILISKTFGTQETLLNGRILYDWLGGSERLYAVSANPERAAHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDPYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 13793 - protein, 416 aa, Streptococcus thermophilus
MIFDKEDYKAFDPELWNAIDAEAERQQNNIELIASENVVSKAVMAAQGTLLTNKYAEGYPGKRYYGGTAVIDVVETLAIERAKKLFGVKFANVQPHSGSQANAAVYMSLIQPGDTVMGMDLSAGGHLTHGAPVSFSGKTYNFVSYNVDKESELLDYDAILAQAKEVRPKLIVAGASAYSRIIDFAKFREIADAVGAYLMVDMAHIAGLVASGHHPSPVPYAHVTTTTTHKTLRGPRGGLILTDDEDIAKKLNSAVFPGLQGGPLEHVIAAKAVALKEALDPAFKEYGENVIKNAAAMADVFNQHPDFRVISGGTNNHLFLVDVTKVVENGKVAQNVLEEVNITLNKNSIPYEQLSPFKTSGIRVGSPAITSRGMGEAESRQIAEWMVEALENHDKPEVLERIRGDVKVLTDAFPLY

SEQ ID NO: 13794 - protein, 559 aa, Schizosaccharomyces pombe
LTMCGILAVHHVAEDIEAFKPKALHLSKQLRHRGPDWSGKAIRNQTILCHERLAIVGVESGAQPLVSDDGKLVLTVNGEIYNHLKLRENLKGNYKFKTYSDCEVILYLYREHGPACANMLDGMFSWVLYDQDKDKVVAARDPIGITTLYQGFSSDSPDTAYFASELKALHPVCDKIIAFPPGHYYDSETKQTVRYFKPSWWDENKIPSNPVDYKLLRETLEASVRKRLMAEVPYGVLLSGGLDSSLIASIAARETEKLANSTSQSEEARTITAWPKLHSFAIGLPGSPDLLAARKVADFLHTFHHEHTFTIDEVLMLFVTLFTILRHMMLPLSVQVPPCIYYLVKSRLKVLKWFCLVRDLTKSLVDTYISVMPPLVRPSIPSVCVVLRTCTYPNACVLTSQLWLGVLRLVFLSWIRTFWKLLLTLILRRKCILTVVKKNIFFAKALDTTHDSSLQPYLPQDILWRQKEQFSDGVGYSWIDALKDTAELCISDDEFALPRREWGDDIPTTKEAFWYRKLFDEIFPRQCADTVMRWVPKAEWGCPEDPSGRYQAGHVAALK

SEQ ID NO: 13795 - protein, 440 aa, Alkaliphilus metalliredigenes
MRRSILLITPENNEINRFRKKQINNFIQITMPYLAAFIDESKYEITLIDEYNQRVPYDDYFSLVALTVNTSNATHCYEIARRFKEKGSKVVMGGPHATLLPDEAKEHCDYIIIGEAEETWPKFLNDFYDNTPLERYFCIDVPSLDNLPIPRRDLIGKRYFTKGAVFATRGCPYQCSYCNLKQIYFDEFRMRPIQEVIEDIRSIKSKYFVFWDDNFFGDIKYAKILMKELKKLNKKWAAQVTLERCQDEELLQLARESGCMYLFIGLESFSEESLQGVNKGMNDVVKYKQIIDLIHTYGISVQAGIIFGFDYDKKDTFKKTLEACNDLGIDGVTVSILTPLPQTPLYQQFKTEGRLLSQDWRYYNGKTTVAYQPKNMTAKELYEGYMWFRKEFYSFRSILKRMRRSRTNIIHNLIVNLGYKFSIRENDFGKINEDIKVEHY

SEQ ID NO: 13796 - protein, 195 aa, Arabidopsis thaliana
MERDDCRRFQDSPAQTTERRVKYKPKKKRAKDDDDEKVVSKHPNFRGVRMRQWGKWVSEIREPKKKSRIWLGTFSTAEMAARAHDVAALAIKGGSAHLNFPELAYHLPRPASADPKDIQAAAAAAAAAVAIDMDVETSSPSPSPTVTETSSPAMIALSDDAFSDLPDLLLNVNHNIDGFWDSFPYEEPFLSQSYG

SEQ ID NO: 13797 - protein, 164 aa, Heterocapsa triquetra
MAKIVPTIIAAALCALVLRSAVNTFVAPQLPVAQTVHQACRPVGGSAVAPAFGAAPAIISAKPARPGVAAHFTVKLQTPDGEQSFECPDDVYILDQAEEEGIELPYSCRAGSCSSCAGKVIDGSIDQSDQAFLDEDQTDSGFCLTCVTYATSDVTIKTHCEDDL

SEQ ID NO: 13798 - protein, 99 aa, Nostoc muscorum
MATFKVTLINEAEGTKHEIEVPDDEYILDAAEEEGYDLPFSCRAGACSTCAGKLVSGTVDQSDQSFLDDDQIEAGYVLTCVAYPTSDVVIQTHKEEDLY

SEQ ID NO: 13799 - protein, 301 aa, Oryza sativa
MAGGGGAGRKVSVAAVQFACTDVESENVDTAERLIREAHKKGANIVLVQELFEGQYFCQAQRLDFFQRAKPYKGNPTIIRFQKLAKELEVVIPVSFFEEANNAHYNSVAIIDADGTDLGLYRKSHIPDGPGYQEKFYFNPGDTGFKAFKTKYATIGVGICWDQWFPECARAMVLQGAEILFYPTAIGSEPQDNNLDSREHWKRVMQGHAGANLVPLVASNRIGRETVETEHGESTITFFGNSFIAGPTGEIVKLANDKDEDVLVAEFDLDEIKSTRHGWGIFRDRRPDLYKVLLTLDGEKS

SEQ ID NO: 13800 - protein, 81 aa, Unknown
  Erythrobacter sp. NAP1
MAKEELLEMRGRVVELLPNAMFRVELENGHEVLGHTAGKMRKNRIRVLVGDEVLCELTPYDLTKARITYRFMPGRGGPGPQ

SEQ ID NO: 13801 - protein, 479 aa, Shigella flexneri
MSIVVKNNIHWVGQRDWEVRDFHGTEYKTLRGSSYNSYLIREEKNVLIDTVDHKFSREFVQNLRNEIDLADIDYIVINHAEEDHAGALTELMAQIPDTPIYCTANAIDSINGHHHHPEWNFNVVKTGDTLDIGNGKQLIFVETPMLHWPDSMMTYLTGDAVLFSNDAFGQHYCDEHLFNDEVDQTELFEQCQRYYANILTPFSRLVTPKITEILGFNLPVDMIATSHGVVWRDNPTQIVELYLKWAADYQEDRITIFYDTMSNNTRMMADAIAQGIAETDPRVAVKIFNVARSDKNEILTNVFRSKGVLVGTSTMNNVMMPKIAGLVEEMTGLRFRNKRASAFGSHGWSGGAMDRLSTRLQDAGFEMSLSLKAKWRPDQDALELCREHGREIARQWALAPLPQSTVNTVVKEETSATTTADLGPRMQCSVCQWIYDPAKGEPMQDVAPGTPWSEVPDNFLCPECSLGKDVFDELASEAK

SEQ ID NO: 13802 - protein, 165 aa, Heterocapsa triquetra
MAKIVPTIIAATLCALALRSVVNTTFVAQQLPAAQTVHQACRPVSGSAAAPAFGAAPAIISAKPARPGVAAHFTVKLQTPDGEQSFECPEDVYILDQAEEEGIELPYSCRAGSCSSCAGKVIDGSIDQSDQAFLDEDQTGSGFCLTCVTYATSDVTIKTHCEDDL

SEQ ID NO: 13803 - protein, 98 aa, Porphyra umbilicalis
ADYKIHLVSKEEGIDVTFDCSEDTYILDAAEEEGIELPYSCRAGACSTCAGKVTEGTVDQSDQSFLDDEQMLKGYVLTCIAYPESDCTILTHVEQELY

SEQ ID NO: 13804 - protein, 202 aa, Unknown
  Synechococcus sp. WH 8102
MARQGDIHRVTGETDVKVRLDLDGSGQCQASTGVPFLDHMLHQISSHGLIDLEINAVGDTHIDDHHTNEDVGIAVGQALAQALGDRRGIHRFGHFAAPLDEALVQVALDCSGRPHLSYSLSIPSQKIGSYDTELVKEFFVAVVNNSGLTLHIRQLDGVNSHHIVEACFKAFSRALRMATEIDPRRAGAIPSSKGVLEQAGAN

SEQ ID NO: 13805 - protein, 377 aa, Shigella flexneri
MSNGIVIIGSGFAARQLVKNIRKQDATIPLTLIAADSIDEYNKPDLSHVISQGQRADDLTRQTAGEFAGQFNLRLFPHTWVTDIDAEAHVVKSQNNQWQYDKLVLATGASAFVPPVPGRELMLTLNSQQEYRACETQLRDARRVLIVGGGLIGSELAMDFCRAGKAVTLIDNAASILASLMPPEVSSRLQHRLTEMGVHLLLKSQLQGLEKTDSGILATLDHQRSIEVDAVIAATGLRPETALARRAGLTINRGVCVDSYLQTSNADIYALGDCAEINGQVLPFLQPIQLSGMVLAKNLLGNNTPLKLPAMLVKIKTPELPLHLAGETQRQDLRWQINTERQGMVARGVDDADQLRAFVVSEDRMKEAFVLLKTLPV

SEQ ID NO: 13806 - protein, 99 aa, Arthrospira maxima
MATYKVTLISEAEGINETIDCDDDTYILDAAEEAGLDLPYSCRAGACSTCAGKITSGSIDQSDQSFLDDDQIEAGYVLTCVAYPTSDCTIQTHQEEGLY

SEQ ID NO: 13807 - protein, 489 aa, Unknown
  Synechococcus sp. WH 8102
MTVAPARPYNRSDWASSFVNVDEELTDVALTPVRGVVPAELQGTFYRNGPGRLERDGQRVHHPFDGDGMIAAMRFDNGRVQLTNRFVRTEGWLAEEKADKVLYRGVFGSQKPGGRLANAFDLRLKNIANTNVVRLGDQLLALWEAAEPHALDPQSLETRGLSRLDGVLKKGEAFSAHPRFDPGHNGRPSMVTFGVKTGPRSTIRLMEFATEGPDAGTLLHDRSDSFPGFAFLHDFAITPNWAVFLQNAIAFNPLPFVTGEKGAAQCLQSKPGGKGRFWLIPRDSGEFAGQKPRILEAPEGFVFHHLNAFEDGDHVVVESIVYDDFPSIGPDDDFAEVDFDTVPEGILHRCRLDLSREIVNTERISERTCEFAMVNPERQGLSAQFAWMAVAERETGNDPLQAVQKLDLSSGATHTWSAAPRGFVSEPLMVRRPGAEAEDDGWVLDLVWNGARRASDLVILNARDLSEVAVLELPLAVPHGLHGSWAAEL

SEQ ID NO: 13808 - protein, 271 aa, Debaryomyces hansenii
MGKADIGTAKYQSKQLKASGLQRLRFYCQICEKQCRDANGFKNHINSLSHQKKITSLKDGGSSIIEEYSSQFLNDFIKLLKINHGTKKINANKFYQEYILNDRDHVHMNSTKWSSLTQFVKFLGTKGYVKVEQPEADTDTEFNLVIRLIDTEYYQKQQELLQNQKNLKTEEQMSMKLINDQIKKSQEYMNRHKQEFKEESKPDNINTNQPIKVSLKLSISKRPKVRSAFGNDSESEGEEEGEEEERGSQLKRKNNTKIGEITNRLGVKSKR

SEQ ID NO: 13809 - protein, 169 aa, Isochrysis galbana
SADEPPPHTMLSYLVAGLSLNAPVSKIGASRVARASPAQMYAVTLIDPSGTFNIECPNDTYILDKAEEDGIDLPYSCRAGACSTCAGKVTAGTIDQSDGSFLDDDQMGQGLLPHLCLVPHVGLHHRDAQGGGALLSSPPCPAPEVCRREGRYSASPGGRRTPCLRPRRD

SEQ ID NO: 13810 - protein, 99 aa, Arthrospira platensis
MATYKVTLINEAEGINETIDCDDDTYILDAAEEAGLDLPYSCRAGACSTCAGTITSGTIDQSDQSFLDDDQIEAGYVLTCVAYPTSDCTIKTHQEEGLY

SEQ ID NO: 13811 - protein, 99 aa, Unknown
  Cyanothece sp. PCC 7418
MASYKVTLINEEMGLNETIEVPDDEYILDVAEEEGIDLPYSCRAGACSTCAGKIKEGEIDQSDQSFLDDDQIEAGYVLTCVAYPASDCTIITHQEEELY

SEQ ID NO: 13812 - protein, 132 aa, Isochrysis galbana
ILQIALTMLSYLVAGLTFTAQVSKIGSSRIARASPAQMYTVTLIHPTGTYTIDCPADTYILDKAEEEGIDLPYSCRAGACSTCAGKVTAGTVDQSDGSLLDDDQMAKGFCLTCVSYPTSDCTIETHKEEDLF

SEQ ID NO: 13813 - protein, 364 aa, Yarrowia lipolytica
MVLSKYLDLPQHGAVLAEYIWIDAHFNIRSKCKTLDKKPTSIEDLPEWNFDGSSTDQAPGHDSDIYLRPAAIYPDPFRRGDNIIVLAECWNNDGTPNKFNHRHECAKLMSAHEKEVIWFGIEQEYTMFDESDNPVGWPKGGFPAPQGPYYCGVGTGKVFARDVVEAHYRACLYSGINISGINAEVMPSQWEYQVGPCEGISMADELWMSRYLLHRVAEEFGIKISFHPKPLQGDWNGAGCHTNVSTKSMREPGGMKHIEAAIEKLAARHKEHIAVYGEDNDMRLTGRHETGSIGSFSSGVANRGCSIRIPRSVAKEGYGYFEDRRPASNIDPYLVTGIMTETICGSIPDADMVEETKRGEEEGF

SEQ ID NO: 13814 - protein, 97 aa, Unknown
  Synechocystis sp. PCC 6714
MASYTVKLITPDGENSIECSDDTYILDAAEEAGLDLPYSCRAGACSTCAGKITAGSVDQSDQSFLDDDQIEAGYVLTCVAYPTSDCTIETHKEEDLY

SEQ ID NO: 13815 - protein, 974 aa, Streptomyces avermitilis
MSRDPLIALRPWESPEVTSWGRLPMNAVDRRTGALPLDGEWRFQLLPTPGSPVTEAWSSQHVPGAWTVQGTDDLPQYTNVTMPWGEFPPASPAANPTGVYEREVDVPAEWAGRRVVLRVGAAESVLLVHVNGRPTGISKDSHLAAEFDLSDVVRPGERATVRLTVVKWSDASHLEDQDHWWHGGITRSVLLYATDPLHLADVTVRARPDGGLRVDCRVRHAMGRLPGGWYVTGELAGHLLAQDAEFDRLNAQDERVSDFLGEARLTALVREVRPWTAETPELYELTVRLHRADGSVADTAHPRVGFRQVEIRGRDLLVNGERVYIRGVNRHDFHPLTGRTVSYDDMRADLVTLKRFGFNAIRTAHYPNDPALLDLADELGFYVVDEADIESHDHAHEIADDPRYTAAFVDRVSRMVLRDKNHPSVIVWSLGNESDYGANHDAAAGWVRRHDPTRPLQYEGAAKLGWADPTVASDIACPMYAPVEDCVAHALSGEQTKPLIQCEYSHAMGNSNGTLADHWAAIESTPGLQGGFIWEFWDHGILQRVNDGRPAGRAGAGLYDNGVAAQGHRWAYGGDFGETVHDGAFIADGVVFPDRTPKPVMYEHREIAAPVRLAYDGGDLRISNHQHFRGLEWLAASWELSLAEGGTLTAPAGLPDVRAGESAVVPMPFALPEDGGEAWLTLRVTTADDEAWAPRGTEVCVPRVRLRAAAPVASAPLTTGAPVQVDEDGLLVHPLLTAAPVLSLWRAPTDNDEIGGMAARWRAWGLDALERKVVDVRRAAGSVTVVAEYGTMAGAVRHEQVFTRVEGGVRVEETAELPAGLDDVARVGSVFETVAGLDVLEWYGQGPWESYPDRSGGAPVGHHSRPVDELFTPYLRPQESGGRHGVRRFTLSAPDATGFAVELDEPRQVNVTRYRAADLAAATHHDELVPRPGCVVHLDVAHRGLGTASCGPDTSPGHLVPTGTHRWSWTLRVL

SEQ ID NO: 13816 - protein, 92 aa, Oxalis spiralis
GINISGTNGEVMPGQWEYQVGPSVGIEAGDHIWASRYILERITEQAGVVLTLDPKPIDGDWNGAGCHTNYSTKSMRDEGGFEVIKKAILNLS

SEQ ID NO: 13817 - protein, 232 aa, Brassica napus
MSSSPEKKKKKLAEELPSTQQTNPTPSLPDELLTSCIARLSRLYYPTVSLVSKSFRSLLSSPELYKARSLVSRTETCLYLCLESSSDSCWFTLCRKPDKTVTKDDVSKNKKNNDDVSKKKSTSYVLCKLPALHSPPAVFSGLVSVGSDIYNIRSSSNVSVLDCRFHTWRKAPSLPVELMALSACAVDEKIYVAGIHGESLKNASKVLNARTQTWDHVVSIPCSLKRRGALNM

SEQ ID NO: 13818 - protein, 199 aa, Rhodospirillum rubrum
MRQATVTRATKETEITVWLDLDGTGQYEVSTGIGFLDHMLEQVSRHSLMDLRVHAKGDTHIDFHHTTEDTGLAIGQAVTQALGDRKGIQRYGSALIPMDEALTQVAVDLSNRPYLIWKVDFSRDKLGDMDTELFKEWFQAFSQTAGVTLHVANHYGENNHHIVESCYKALARALRQAWEIDPRKADAVPSTKGVLGGTL

SEQ ID NO: 13819 - protein, 180 aa, Pyrobaculum aerophilum
MPVRPARCYKRIKGPPYTREEYIHGAPMIQIPKFDMGTTSAAARTAFTMTAKLVVEERGQIRMQALEAARQMASKYLTKYVGDANYYLRLNVVPHHVLRENRMLAMAGADRLQEGMRLAFGSPAGRAARVEPGQVLFYAEFKPEHLPHIKEALRRAASKLPLPTRIVIEPKGNGGNKTVT

SEQ ID NO: 13820 - protein, 336 aa, Unknown
  Citrus clementina x Citrus reticulata
MASVIILLLGMLIATLDTTSAQIGVCYGMLGDNLPSKPDVIALYNQNNIRRMRLYDPNKEALEALRGSNIEVMMGVSNDFDLLRRIASKQAEANTWVQDNVQNFVNNVKFKYIAVGNEAKPGDDFAQYLVPAMRNIQNAINGANLGSQIKVSTAIAGALDTKSSPPSAGSFNQDYRPILDPLITFLNENNSPLLVNLYPYFAIVGDRQISLDYALFRSQQPVVSDPPLSYQNLFDAQLDATYAALEKPVGGSLDIVVSESGWPSAGDGALTSVDNARTYNNNLIQHVKQGSPKKPSRPIETYIFAMFDEDKKGDEIERHWGLFSPDRQTKYQVNFN

SEQ ID NO: 13821 - protein, 585 aa, Actinoplanes missouriensis
MELTSEHDPVEGSHTEDGVVEHPTSDDFGHARALPADRTWFQRAVFYEVLVRAFYDSGSDGGGDLRGLIERLDYLQWLGVDCLWLPPFYDSPLRDGGYDIRDFYKVLPEFGTVEDFVALLDAAHKRGIRVITDLVMNHTSDSHPWFQASRHDPDGPYGDFYVWNDNSDKYKDARIIFVDTEESNWTFDPVRRQFYWHRFFSHQPDLNYENPKVQEAMMDALRFWLDLGIDGFRLDAVPYLFEEEGTNCENLPATHAFLKHCRKVIDDEFPGRVLLAEANQWPADVVEYFGDPRSGGDECHMAFHFPLMPRIFMAVRRESRFPISETLANTPAIPDNCQWGIFLRNHGELTLEMVTDEERDYMYSEYAKDPRMKANVGIRRRLAPLLENDRNQIELFTAMLLSLPGSPVLYYGDEIGMGDNIWLGDRDGVRTPMQWTPDRNAGFSTATPGRLYLPVNQDPVYGYQAVNVEAQRDSATSLLNVDPDHAAVRRRHEAFAVGTFRELGGSNPSVLAYLREYGDDVVLCVNNLSRFPQPIELNLQHWNGYTPVELTGHVNFPRIGQLPYLLTLPGHGFYWFQLCGSEEKQ

SEQ ID NO: 13822 - protein, 133 aa, Deinococcus radiodurans
MRRKLLVQLDSGAVAEGRITRVTDFGAFVQFENGETGLVHISQIAHSFVRNIHDHVREGENVEVKVLGRDERGRLDLSIKELLEEPEEVPRPRAIGRQSPQFEAKLRSFMRDAKERGPGSGGGGKKPAGKRKK

SEQ ID NO: 13823 - protein, 210 aa, Pseudomonas putida
MKPFSPNDFAELVMVERKASVERNTLETQVKCSINLDGSGKARFDIGVPFLEHMLDQIARHGLIDLDIECKGDTHIDDHHTVEDVGITLGMAFAQAIGDKKGIFRYGHAYVPLDEALSRVVIDFSGRPGLQMHVPYTRASVGGFDVDLFQEFFQGFVNHALVTLHIDNLRGHNTHHQIETVFKAFGRALRMAITLDERMAGQMPSTKGCL

SEQ ID NO: 13824 - protein, 363 aa, Coccidioides immitis
MTSPEVHHLFHRPIADHSFSADKDILAVAKENVVDLYQRSGSKFALTDELKGHDKTVTGVDIAPRSGRIVTCSQDRNAYVWERTSSGWRPTLVLLRINRAATFVRWSPSEQKFAVGSGARVIAVCYFEEENDWWISKHLKKPIRSTITTLAWHPNSVLLAAGSTDSHARVLSSYIKGVDERPQPTAWGERLPFNTVCGEFLNDSAGWVHGCAFSPSGDSLAFTCHDSSVTIVYPSAPDQPPRAMLNVSTRLLPFMSLIWNGENEIIAAGHDCEVYRLSGDERGWKLTGSVGTKSTQGTGAAREESALNKFRQMDLKGSTKDDSRLETLHQNTINTIRVYEEAGETVRKFSTSGVDGRVVIWQL

SEQ ID NO: 13825 - protein, 281 aa, Legionella pneumophila
MKENKLTVALVQEQWYENPKEHQDKLASGIFSATQQGAKLVCLQELTLSPYFCTRSDVDPTPYMEDIATGPTAQFVSQMAKSNQIHITASLFEKAGYNTAVAFNPQGELIAVTRKQHIPSGEKYHENFYFKPGDSNYPVHTIAGHYLGLPTCYDQWFPELSRIYGLKGAEILVYPTAIGGEPTAPGFDSQPMWQKVMVAQGIMSNTFIIAVNRIGCEDGLSFYGSSFISTPMGEILVQAPRNEPAVLVAELDFSQRELWGRLFPFPQQREPETYHELVKSR

SEQ ID NO: 13826 - protein, 416 aa, Photobacterium profundum
MLKRDMNIADYDAELFAAIQEETARQEEHIELIASENYTSPRVMEAQGSQLTNKYAEGYPGKRYYGGCEFVDKAEQLAIDRACQLFGAEYANVQPHSGSQANNAVYMALLNPGDTVLGMSLAHGGHLTHGSPVNFSGKLYNIIPYGIDETGQIDYEEMEALALEHKPKMIIGGFSAYSQVVDWKRMREIADKVGAYFFVDMAHVAGLIAAGVYPNPVPHAHVVTTTTHKTLAGPRGGLILSNDGEALYKKLNSAVFPGGQGGPLMHVIAAKAVAFKEAMEPEFKVYQACVVENAKAMVGEFLERGYKIVSGSTENHLFLVDLIDKGITGKEADAALGAANITVNKNSVPNDPRSPFVTSGIRIGTPSITRRGFTVEDTKQLAGWICDVLDNTDKPEVIEATKAKVLEICKRLPVYA

SEQ ID NO: 13827 - protein, 351 aa, Aspergillus nidulans
MAMNKVPGYNIYIGGVFALKNKVAMSGANITHVLSVIRLRPKDDLFAGYQHHRIEVDDLDDENLLEHFPSAIKFIQSGLDAGGGVLVHWPLTASSAMGKSRSATVCIAYLLRRQRNALTPQSALALLRESRPLCEPNPGFMEQLNVYYQMGCPDDVTSHPLYSRWLYRREVEESVACGRAPEMDSVYFEDEQPHQNVATTGPATEIKCRKCRRKLAIAPFVVPHGSHGDVKGAIISECAHIFMSPLTWMRPSLFPDTPGDAPLSGRLTCPNSSCGSNIGKFAWQGMQCSCGDWVVPAIGLARARVDISEPVTIRRGPGLPSGIRLPPNMRPIIGAAGVKPESERDTAKGSL

SEQ ID NO: 13828 - protein, 255 aa, Heteropogon contortus
CELDNIMRLTGITGIVNGMDVSEWDPSKDKYIAVKYDVSTAMEAKALNKEALQAAVGLPVDRNVPLVAFIGRLEEQKGPDVMAAAIPLLMEEDVQIVLLGTGKKKFERMLMSAEEKYPEKVRAVVKFNAPLAHHIMAGADLLAVTSRFEPCGLVQLQGMRYGTPCACASTGGLVDTIIEGKTGFHMGRLSVDCNVVEPADVKKVATTLKRAIKVVGTPAYEEMVKNCMIQDLSWKGPAKNWENVLLSMGVAGGEP

SEQ ID NO: 13829 - protein, 382 aa, Vitis vinifera
MSIVCVEGNPPSMFNPPTDDHKNQEPLVFDASVLRHQSNIPKQFIWPDAEKPGDKATELSVPLIDLGGFLSGDPAAAMEATRLVREACQKHGFFLVVNHGVDDKLIYKAHQYMDSFFGLPLAKKQRAQRKLGEHCGYASSFIGRFSSKLPWKETLSFSYSAEKKSSNAVQEYFLNKMGEDFSEFGQVYQDYCEAMSTLSLVIMELLGMSLGIGGAHFREFFEENDSIMRLNYYPPCLKPDLTLGTGPHCDPTSLTILHQDQVGGLQVFVDDKWWSISPNFDAFVVNIGDTFMALSNGRYKSCLHRAVVNSQTPRKSLAFFLCPEKDKVVRPPTELVDTNSPRIYPDFTWSNLLEFTQKHYRADMKTLEVFSSWLQQKTAEAG

SEQ ID NO: 13830 - protein, 255 aa, Hyparrhenia hirta
  misc_feature (56)..(56): Xaa can be any naturally occurring amino acid
  misc_feature (75)..(75): Xaa can be any naturally occurring amino acid
CELDNIMRLTGITGIVNGMDVSEWDPSKDKYITVKYDVSTAVEAKALNKEALQAEXGLPVDRKIPLVAFIGRLEXQKGPDIMAAAISELMEEDVQIVLLGTGKKKFERMLMSAEEKYPDKVRAVVKFNAALAHHIMAGADVLAVTSRFEPCGLIQLQGMRYGTPCACASTGGLVDTIIEGKTGFHMGRLSVDCNVVEPADVKKVATTLKRATKVVGTPACEEMVKNCMIQDLSWKGPAKNWENVLLSLGVAGGEP

SEQ ID NO: 13831 - protein, 553 aa, Photobacterium phosphoreum
MFCIQCEQTLEAPKKKGCAYATGMCGKTAEISDLQDVLVYILQGVSYWADLAHKFDIIDDEINHWAPRAFFATLTNVNFDRERILALANLAENYKTRLKQAVIAATTLAQQPLPTLPTVAEFTLPNTIDAILTLAPQVAVNRGYETINEDVIGLRLLCLYGLKGAAAYMEHARVLGQTNNAIYAQYHHIMSWLGTDPTDLNALLECSMEIGLMNYKVMEMLDLGETNTFGHPLPSQVNVKPIQGKCILVSGHDLHDLEKILQQTEGKHINVYTNGEMLPAHSYPELKKYPHLVGNYGSAWQNQQLEFANFPGAIVMTSNCLINPNVGKYADRIFTRSIVAWPGVAHIEGDDFSQVIDCALALDGFQHTEIEHMITIGFGRNALMNAAPAVIDQVKQGNINHFFLVGGCDGAKEERSYFTDFAAQVPQDSLILTLACGKYRFNKNNFGDINGIPRLLDVGQCNDAYSAIQLALALANEFDCSINELPLTLVLSWFEQKAIVILLTLFALGVKGIYTGPTAPAFLTDNLLAIIAEKFDMRSISTPEADLNTILSA

SEQ ID NO: 13832 - protein, 95 aa, Raphanus sativus
MALVRSLLGAKKILGQATASTSKRATMAAPPKGFLAVYVGESQKKRYVVPISYLSQPSFQALLSKSEEEFGFDHPMGGLTIPCPEDTFINVTSRL

SEQ ID NO: 13833 - protein, 255 aa, Ischaemum santapaui
CELDNIMRLTGITGIVNGMDVSEWDPSKDKYIAVKYDESTAVEAKALNKEALQAEVGLPVDRKVPLVAFIGRLEEQKGPDVMAAAIPELMEEDVQIVLLGTGKKKFERMLMSAEEKFPDKVRAVVKFNAALAHHIMAGADLLAVTSRFEPCGLIQLQGMRYGTPCACASTGGLVDTIIEGKTGFHMGRLSVDCNVVEPADVKKVATTLKRAIKVVGTPAYQEMVKNCMIQDLSWKGPAKNWENVLLSLGVAGGEP

SEQ ID NO: 13834 - protein, 216 aa, Crocosphaera watsonii
MQTQNTPHTTSSAIISPFSDRTSTVTRTTKETDVQVSLNLDGQGNCTVETGVPFLDHMLHQISSHGLIDLEVKATGDIEIDDHHTNEDVGITLGQALGKALGDRKGIVRFGHFLAPLDEALIQVALDFSGRPHLSYGLQIPTERVGTYDTQLVREFFVAIVNHSQMTLHIKQLDGINSHHIIEATFKAFARSMRMALEIDPRRAHSIPSSKGVLMT

SEQ ID NO: 13835 - protein, 255 aa, Schizachyrium scoparium
CELDNIMRLTGVTGIVNGMDVSEWDPSKDKYIAVKYDVSTAVEAKALNKEALQAEVGLPVDRKIPLVAFIGRLEEQKGPDVMAAAIPQLMEEDVQIVLLGTGKKKFERMLMSVEEKYPEKVRAVVKFNAALAHHIMAGADVLAVTSRFEPCGLIQLQGMRYGTPCACASTGGLVDTIIEGKTGFHMGRLSVDCNVVEPADVKKVATTVKRAIKVVGTPAYEEMVKNCMIQDLSWKGPAKNWENVLLGLGVAGGEP

SEQ ID NO: 13836 - protein, 547 aa, Magnaporthe grisea
MSALKTTTNEKTSTGDKLRNFFKINNNRRRLPFGRSKTGHEAPQAKSTRADDSDGAQYTTHDDESQDANEPHSTPADSEAARRIRRVKSEPSQLGLIFGYLSGGRPATSGRGKEKTLLANKNASAVGLVGTSSSTPTPGPSSTGGGECVIPSAGGEIVVVPTPNAATPPHGGPKQKLVAYHRTYSSNSIKKGPVRVGPEDFEKLKLIGKGDVGKVYLVREKKRDKLFALKMLDKDEMIRRNKIKRTVTEQEILQVMNHPFIVSLHHSFQSQKYLYLCMEYCSGGEFFRALQSRPGKCISEEAARFYIAEVISALEYLHMNGLIYRDLKPENILLHESGHIMLSDFDLSKISGQDGMPTMIVGRNGTTTMLDTRSCLEGYRTNSFVGTEEYIAPEVIKGHGHSVAVDWWTVGILSFEMIYGVTPFKGKNRNATFANVMREDVHFPDDPELSPMGKSFIRKCLIKDENRRLGAIAGAAELKRHPWFRTTQWALLRHLTPPIIPDQGPDGNFRTLKDSQSVDIGGATRKVADDDPFSAFSSVTLHYGDDK

SEQ ID NO: 13837 - protein, 453 aa, Coprinopsis cinerea
MSAPSAEEIAKAAKAAFDRSQLVPSTERITALEAIHKQLQAHKDEILAANVEDLKAAQEEVNAGRMSESMLKRLDLGRGDKWDSMLQGILDVSALPDPTGIVNYASELDDGLELYRVSCPIGVLLVIFEARPEVVVNIATLAIKSGNAAILKGGKESNRTTVLLSKAISAGLAQTALPETYIQTIQTRAEVSSLLAMDRYIDLVIPRGSNSLVRNIQNNTRIPVMGHADGLCSVFLDESADVDKAVRIVVDSKTDYPSACNALETLILHEAILSTVWPKVAEGLFNAGVKLLVDEPSLAALKASNVTIPESQIAPADDEAYNTEHLSLTAAVKTVPSVSAAIAWINEHSSHHTDSIVTESDENATTFCKGVDSAGTYVNASTRFADGFRYGFGTEVGISTGRIHARGPVGLEGLVTYKYMMKSKADKGHIVGEFGSNKKQYKHARINATSVPF

SEQ ID NO: 13838 - protein, 353 aa, Unknown
  Burkholderia sp. 383
MEQHARPPISTTQFPVDRWWVAALSSELTDKPVARTLLGHPVVLFRLPSGEVGALEDRCCHKSLPLSCGSLEARGLRCGYHGLLFDRGGACVEIPGQERIPAKACVSSYPVQEQDALVWIWIGADAHAQPTCAPPRYAFHADPQYRFGGGNYHYDAPYQLIHDNLMDLSHLGYVHLKTIGGNAPLHMGAETRVSSDGDTVTLVRRMPDSTPPPTYTAAWPFAGSVDRWQEIEFHVSHIRIWTGAMDAGAGDLHDPARGGFHMRGFHGITPETATTTHYFWTVATNPQHDVERVAQTVIEQSAATFDEDKTVIEAQYRNQLRFPDSRQIDIHVDAGPNRARRVIERLLRQPEPA

SEQ ID NO: 13839 - protein, 719 aa, Xylella fastidiosa
MQTLSIVDPFIKHHPKETLVAKITKTFQYGKHTVTLETGEVARQANGAVIVKMDDTVLLVTVVAAKTAREGQDFFPLTVDYQEKFYAGGRIPGSFFKREGRATEKETLISRLIDRPIRPLFPEDYKNEVQIIAMVMSLDPEIDGDIPAMIGASAALSLAGIPFKGPIGAAKIGYNDGQYILNPTVSELKKSQLELVVAGTANAVLMVESEAALLSEEVMLGAVIFGHREMQKVIQVIDSLTAEAGTQPSDWVPPAKNDALVIALKEVIGGRLSDAFHIRDKLQRRDAIAAVKDDVIQQLAGRLEVEGWNLAELLKEFGELEYRTMRDALLDTKVRIDGRSLEAVRPITVKVGVLPRVHGSGLFTRGETQAIVVTTLGTARDGQVIDAVTGEYKENFLFHYNFPPYSVGECGRFGVPKRREIGHGRLARRGVLAVMPSLDEFPYTIRVVSEITESNGSSSMASVCGSSLALMDAGVPVKAPVAGIAMGLVKEGERFVVLSDILGDEDHLGDMDFKVAGTSEGVSALQMDIKIEGITEEIMRQALQQAKVGRLHILGEMDKALAAPRAELSDYAPRLLTIKIHPDKIRDVIGKGGSTIQAITKDTGTQIDIQDDGTIIIASVNNAAAREAKCRIEQITSDVEPGRIYEGKVAKIMDFGAFVTILPGKDGLVHVSQISSERVERVGDKLKEGDVVRVKVLEVDKQGRIRLSIKAVEEEVASI

SEQ ID NO: 13840 - protein, 255 aa, Sorghastrum nutans
  misc_feature (51)..(51): Xaa can be any naturally occurring amino acid
  misc_feature (254)..(254): Xaa can be any naturally occurring amino acid
CELDNIMRLTGITGIVNGMDVSEWDPSKDKYIAVKYDVSTAVEAKALNKEXLQAEVGLPVDRKIPLVAFIGRLEEQKGPDVMAAAIPELMEEDVQIVLLGTGKKKFERMLMSAEEKYPDKVRAVVKFNAALAHHIMAGADLLAVTSRFEPCGLIQLQGVRYGTPCACASTGGLVDTIIEGKTGFHMGRLSVDCNVVEPADVKKVATTVKRAIKVVGTPAYEEMAKNCMIQDLSWKGPAKNWENVLLSLGVAGGXP

SEQ ID NO: 13841 - protein, 608 aa, Hordeum vulgare
MAALATSQLATSGTVLGVTDRSAPSMFRHAGFQGLRPRKPADGTFGMRTVGASAAPKQSRKAHRGNRRCLSVVVRATGSGMNLVFVGAEMAPWSKTGGLGDVLGGLPPAMAANGHRVMVVSPRYDQYKDAWDTSVISEIKVADEYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTWFHMGRLSVDCNVVEPADVKKVATTLKRAVKVVGTPAYQEMVKNCMIQDLSWKGPAKNWEDVLLELGVEGSEPGIVGEEIAPLAMENVAAP

SEQ ID NO: 13842 - protein, 373 aa, Unknown
  Burkholderia sp. 383
MPRTGGIDLKETTNVFLKNAWYVAGTPDEIDGKPLGRKICNESMVFYRAADGQVAALEDFCPHRGAPLSLGFVRDGVLVCGYHGLEMGCNGKAAGMPGQRVGGFPPIRSFPAVERYGFIWVWPGDASAADPAKLPVLAWAEDPAWAHGGGLYHIRCDYRLMIDNLMDLTHETYVHATSIGQKEIDEAPPKTASHGDEVVTSRFMENVMPPPFWQMGLRGNGLADDVPVDRWQICRFTPPSHVMIEVGVAHAGHGGYDAPADLKASSIVVDFITPETDTSIWYFWGMARNFRPDDHALTAEIREGQGRIFAEDLEMLERQQLNLEKWPDRKLLKLNIDAGGVLSRKVIERLLADENASSSQRPVIPVAQIKEAS

SEQ ID NO: 13843 - protein, 622 aa, Cucumis melo
MSMYGRDPWGGPLEINAADSATDDDRSRNLQDLDRAALSRPLDETQQSWLLGPGEQKKKKYVDLGCIIVSRKIFVWTVGTLLVSGFLAGLITLIVKTVPRHHHPHPPPDNYTLALHKALMFFNAQRSGKLPKHNNVSWRGNSCTRDGDGSSSLFKDLSGGYYDAGDAIKFNFPASFAMTMLSWSVIEYSAKYEAAGELNHVKDIIKWGSDYFLKTFNHTADSISTIVMQVGVGDTSGGNTSPNDHYCWMRPEDIDYVRPVLTCSSCSDLAAEMAAALASASIVFKDNKAYSQKLVHGARTLFKFAREQRGRYSAGNAEAAIFYNSTSYWDEFVWGGAWLYYATGNSSYLQLSTTPGIAKHAGAFWGGPDYGVLSWDNKLAGAQVLLSRLRLFLSPGYPYEEILRTFHNQTSIVMCSYLPFFTKFNRTRGGLIQLNHGRPQPLQYIVNAAFLATLYSDYLEAADTPGWYCGPNFYSTEVLRDFAKTQIDYILGKNPRKMSYVVGFGNHYPKHVHHRGASIPKNKIKYNCKGGWKWRDTTKPNPNTLVGAMVAGPDRRDGFHDVRTNYNYTEPTLAGNAGLVAALVALSGENSEKATGIDKNTIFSAVPPMFPTPPPPPAPWKP

SEQ ID NO: 13844 - protein, 434 aa, Corynebacterium efficiens
MTDAHHADDVRYQPLSEIDPEVAQAIAGELSRQRDTLEMIASENFVPRSVLQAQGSVLTNKYAEGYPGRRYYGGCEQVDIIEDLARDRAKALFDAEFANVQPHSGAQANAAVLMTLADPGDKIMGLSLAHGGHLTHGMKLNFSGKLYEVAAYGVDPDTMLVDMDQVREQAIKEQPKVIIAGWSAYPRHLDFAAFREIADEVGATLWVDMAHFAGLVAAGLHPSPVPYADVVSSTVHKTLGGPRSGIILAKQDYAKKLNSSVFPGQQGGPLMHAIAAKATALKIAGTDQFAERQARTIEGARILAERLTASDAKAAGIDVLTGGTDVHLVLADLRNSEMDGQQAEDLLHEVGITVNRNAVPFDPRPPMVTSGLRIGTPALATRGFDATAFTEVADIIGTALAQGKSADLESLQARVTKLAEQYPLYEGLEDWTIV

SEQ ID NO: 13845 - protein, 554 aa, Parvularcula bermudensis
MSSTPQDVNHTFDDDDLSILTTYGTVKAHEAGEILVPSGTSKADCLVTLSGQTHIFVISGQEESRVGYMERGQFAGDLSVLTGGVTFARTVMGEAGEVLHIPHDRFKRLLVERSALSDVFVRVLTARREFGKSRANRSIILIGPGRQRETFALRRLLERQSVPHTLVDPTLDEEAGEGVMRVHGLGPEDLPAVLLGEKEPMRAPTPSALAEALGLDLVADGTTTDVLVIGAGPAGLAASVYAGSEGLSVLTLDGDAPGGQAGTSSKIENYLGFPTGISGQELADRASVQAQKFGVQMAAPAEVASLQVEDKLYRVALEDGREVAARSVVIATGARYRRLDIDHLEDFEGRGIYYGATPMEAQLCGGREVAIVGAGNSAGQGAVFLSHTAKAVHVVYRRADIRETMSEYLVRRLEETPNIILHPEREVVALYGDNDGLLEKVDFINHATGSTETCDCGFLFLFIGARPCTDWLQGRLATDDRGFLKTGADLTNMELVKAQWSMDRMPTKYETSLPRVYAVGDVRTGSIKRVASAVGEGSVVVSDIHRALGELAAS

SEQ ID NO: 13846 - protein, 727 aa, Yarrowia lipolytica
MSETDHLLAAEPVAEYPQYTPWPNSRKSVDTEFSATSWIYDLVLWIFTACFDIFFREIRPRGAFRIPRKGPVLFVAAPHANQFVDPVILMNQVKQEAGRRISFLVAEKSMRRAAVGRMARSMNSIPVVRAQDNAKKGEGKIYVDAEDPTKIHGIGTQFTKQCEVRGLVVCSSSVGSIDVAEIVSDTLLIARKEFKGPKAKEALKESNGGITYKYADYVNQATVYRSVFDKLHHGGCVGIFPEGGSHDRTELLPLKAGVAIMALGALAEDPSCGVRIVPCGLNYFHAHKFRSRAVVEFGSPIAIPPDLVEKYKAGGEAKREAVKTVLDITAAGLKSVTVQVQDFDTLMLIQAIRRLYRPPGKKIPLPMVVELNRRLVYAYNHYKDDPRIEEMKQEIRKYNKFLQAMGLKDHQVEKARISKIEILGRLLYRSIKLVFLSIGCLPGLLLFSPIFIISKSISKTKAKEALKASSVKIKANDVVATWKVLVAMGLTPVLYILYSLVGSVVIRKLDLISWFPTILLPGLVLSIIITTSYAALAMGEAGMDIFKSLRPLALALNPSTKNSLLKLQNERKRLVLKSSELVTSLGPELFPDFPENSILQGSDKFEDEENYENEKRSHSRSTSATSLSAMSEGDGDELVREVRKGASYFPVSTISEDEDQAISRVGSEASLADIPLFGMSRSQSGASLSEASTHGSSTGADAEEAKTEVTRRIALAMEEKRREQDEE

SEQ ID NO: 13847 - protein, 608 aa, Hordeum vulgare
MAALATSQLATSGTVLGVTDRSAPSMFRHAGFQGLRPRKPADGTFGMRTVGASAAPKQSRKAHRGNRRCLSVVVRATGSGMNLVFVGAEMAPWSKTGGLGDVLGGLPPAMAANGHRVMVVSPRYDQYKDAWDTSVISEIKVADEYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEAKALNKEALQAEVGLPVDWKVPLVAFIGRLEEQKGPDVMIAVIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTWFHMGRLSVDCNVVEPADVKKVATTLKRAVKVVGTPAYQEMVKNCMIQDLSWKGPAKNWEDVLLELGVEGSEPGIVGEEIAPLAMENVAAP

SEQ ID NO: 13848 - protein, 137 aa, Pavlova lutheri
GIRHEAKTMFRLLLISACLAYASAFNVATSAFRRTGAASTVSMYTVTLKTPSGESKIECPEDTYILDKAEEEGIDLPYSCRAGACSTCCGKVASGTVDQSDQSFLDDGQMESGFVLTCVAYPSSDCTIETHKEEDLF

SEQ ID NO: 13849 - protein, 137 aa, Acetabularia acetabulum
MLAVATSPLLGSRVTLKPATTSQIFAAITRPIASRRSLKVLAYKVTLITPDGNQNSFECADDVYILDAAEEEGIDLPYSCRAGSCSSCTGVVKSGTIDQSDQSFLDDDQMGNGFVLTCVAYPTSDCTIETHKEEELN

SEQ ID NO: 13850 - protein, 473 aa, Pseudoalteromonas tunicata
MQYLPIFTKLDNKPVLVIGGGEVALRKCRALLQARGKVTLVAPDFCQELLELAEQNIVTLVHDYFAPAQLDGQMLVIAATDINAVNEAVFDAANERNIFVNVVDDQPKCTFIFPSIVDRNPITIAISSAGTAPVLARRLREKLETLIPQHIGPLAELVGSFRTQVKQRFKQFSDRRQFWEKVFDSNVVSKVQTGDIAAAKQQLHIMLDDTAAPKGEVYVIGAGPGDPELLTLKALQLMQQADVVVYDYLVSDEIMELVRRDADLICVGKRMGDHSVEQHDTNQMLVRLAKEGKKVCRIKGGDPFIYGRGGEEVQVLAEYQVAYQIVPGITAAAGCAAYAGIPLTHRDHAQAIQFVTGHCKKDGQDLDWRSLAQPHQTLAVYMGVVKSPYIQAKLIEHGRAHNTPVAIIENGTRKNQRVVTGHLGQLSQLIDQHAIVSPALLIIGEVAQLHSQLAWFGQQAQTSSFAQPLTDVV

SEQ ID NO: 13851 - protein, 370 aa, Rhodobacter capsulatus
MIDTVKAEFAGDFFARLEAVARYDEIRLIVLNHLEPDHTGAVPELLRRAPQAQVRLSPRGLPMLRALLKDDFERYDIKGVTTGQSVSLGDRICSFFTTPFVHWPDTQCTWLAAERVLFTCDLFGSHYCDGRLFNDLVGDFRFSFEYYFDRIMRPFRSFVAQVLDLIEPLDFGIIAPAHGPILRSHPRDYLTHTRRLISSWLAAETGSEKTLLIFYVSAYRATAQLAQAIHDGAAESPDVRVSLFDLEGGEITPFLDLIEEADGIALGTPTINGDAVRTIWEMLAALVDIETRGKLGAAFGSYGWSGEAVRLVETRLQGLKMRLPEPGLRVKLHPSAAELEEGRAFGRRLADHLTGRARPREVDFAEIAAR

SEQ ID NO: 13852 - protein, 177 aa, Cicer arietinum
LDIAVRLLEPLKEQFPIISYADFYQLGGVVAVEVTGGPEVPFHPGREDKPEPPPEGRLPDATKGSDHLRDVFGKAMGLSDQDIVALSGGHTIGAAHKERSGFEGPWTSNPLIFDNSYFTELLNGEKEGLLKLPSDKALLSDPVFRPLVEKYAADEDAFFADYAEAHLKLSELGFAEA

SEQ ID NO: 13853 - protein, 537 aa, Unknown
  Erythrobacter sp. NAP1
MWTSPHKPALIQINFREIGFAQVLDRARVEAKRETPVTITRHPPVKTSLEPSNHPYLSGPWTPCHEEVDVDELEVIEGAIPDDIDGIYLRNTENPVHQPLGRHHPFDGDAMVHQVSISGGKASYRNRFIRTHCFTEEQIAGKSLWGGLMDPHGTSARPGYGAHEGLKDTGSTDIIVHAGTAYATFYQCGEAWMLDPVTLANKGKAPWGPVDGVSAHPKVDEATGEMMFFNYSKYAPYMHYGVVDREGNLAHYVPIPLPGPRLPHDMAITKNWSILNDMPLFWDANLLERNIHAARIHEGVPTRFALIPRHGAPEDIRWFEASPTYVLHWTNAYEVSGSDGDEVVLEGYYQDKPMPDPIEEAGEYSHMMAYVDEHSFQSRLHRWRFNLKTGETTEERLSDRIVEFGMINPDYLMQKSRYIWSTTTRPGWFLFNGYVRHDTETGGEQVYQLPEGVYASESPMVPRKGASSEDDGYLVTFLIDENTGTSQLAILDASDIAKGPICRAALPHKISSGVHTCWVEHSQLAADAEFKRKAQAA

SEQ ID NO: 13854 - protein, 603 aa, Hordeum vulgare
MAALATSQLATSGTVLGVTDRFRRPGFQGLRPRNPADAALGMRTIGASAAPKQSRKAHRGSRRCLSVVVSATGSGMNLVFVGAEMAPWSKTGGLGDVLGGLPPAMAANGHRVMVVSPRYDQYKDAWDTSVISEIKVADEYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIVGYDKPVEGRKINWMKAGILQADKVLTVSPYYAEELISGEARGCELDNIMRLTGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCVVQDLSWKGPAKNWEDVLLELGVEGSEPGIVGEEIAPLAMENVAAP

SEQ ID NO: 13855 - protein, 416 aa, Heterocapsa triquetra
PAGAAALCGAHWAFVQPAAPAQGEVAAPRRLRASAGASAEGARFAGALPAATAIAVGSAVACCAAATKKKGVKVVHGKEIPWNIFMPKAPYTGKVVANDVHPQTLTEDTGDANWETTHLTFDHDGKVPYLEGQSIGIIAPGPDKKGETPAKIRLYSIASSAVGDDQTSKTVSLCVKRVVELDGKFANREVGEDKPDKAGTGYPKNKVYRGVCSNHICDMSVGDDVLITGPTGAEMLLPEDPKANIIMLATGTGIAPMRSYMRLLFHDKAGEAADGSRKFQGLAWLFMGVPYSKSLLYDDEHLAYVKNYPDQFRFDYAVSREQTNAAGQKMYIQTKMAEYTDELWELMQKENTHIYMCGLKGMEAGMEECFSAKAEAAGLVWKEFAKSMKKADRYHVEVYRGASTPSQWLLQHVQFS

SEQ ID NO: 13856 - protein, 405 aa, Unknown
  Polaromonas sp. JS666
MTSSYDPGRRSLLAAGASALAAAGLGGMTDAKAQAAPAATQARPLPPYVSWKNPNNLIVHTATTIETKRSAFGTSVITPADRLYIRNNLPAPDVSIVADRDAWTLAVEGVRGPRTLSVAELKSLGLETLATVLQCSGNGRGYFADKPSGTKWQVGAAGCVIWSGVAVRTVVAALGGLASGGRFMTGTGGERLPDGLDPKSVMVERSVPLSAMEDALLAWEMNGEPLPHAHGGPLRLVVPGYSGVNNIKYIKQLAFTAAETDAAIQKTGYRISPPGQKGDPSHPAVWEMDVKSWINAPAPEAGSPVRAGWVQIHGVAMGGTQAVRRVDVSVDGGQTWQQARLVGPDLGRFAWRQFVLPVKLAPGNYLLASRAQDVKFNWQAESTPENAGGYLNSGWRVHALPVTVT

SEQ ID NO: 13857 - protein, 304 aa, Agrobacterium tumefaciens
MTRQMILAVGQQGPIARAETREQVVGRLLDMLTNAASRGVNFIVFPELALTTFFPRWHFTDEAELDSFYETEMPGPVVRPLFETAAELGIGFNLGYAELVVEGGVKRRFNTSILVDKSGKIVGKYRKIHLPGHKEYEAYRPFQHLEKRYFEPGDLGFPVYDVDAAKMGMFICNDRRWPETWRVMGLKGAEIICGGYNTPTHNPPVPQHDHLTSFHHLLSMQAGSYQNGAWSAAAGKVGMEEGCMLLGHSCIVAPTGEIVALTTTLEDEVITAAVDLDRCRELREHIFNFKAHRQPQHYGLIAEF

SEQ ID NO: 13858 - protein, 410 aa, Streptomyces coelicolor
MSAPSRITAALRSDAVGGSLLIGAAVIALIWANSPLSHSYEALRSFTFGPSALHLNLSVETWAADGLLAVFFFIVGNELKQELVHGELRDPRRAALPIAAALGGVAVPALVFLAFTLGSGGEAAGGWGIPMATGIAFAVAVLAVVGRHLPTPLRTFLLTLATVDDMSAVLVIAVACTSGINFTALALAAVGLAVFGYLQNGSGRAVARVRAMVPAWLLFVPLAAVVWALMHACGVHATIAGVVMGLLMRTRPQGAERVSPSHRAEEVLRPFSAGIALPLFALMSAGVSLAGAGGFVTSAITWNVLAGLLVGKVVGIFGGTWPTSRLTSAHLNPLLGWADIAGIAVLGGIGFTVSLPIAELSSTSQAHLTDAKGAILLASTTAALLAALLLGRRSRHHQRLARQAAQQATT

SEQ ID NO: 13859 - protein, 367 aa, Isochrysis galbana
APLPVSRVAQSRLGGVRMASDEPWFEDCVSTTSIDKSAFEAAYATAMNAPAPAASTSGKQDFLEASPFWDQSNIPINTYKNKAPFTGKIISVKRIVGAAATGETCDIVMSHGGKMPYWEGQSYGVIPPGTNPKNGKPNSVRLYSIASSRYGDDMTGTTTTLCVRRATYWCPELKADDPAKKGVCSNFLCDSKPGDEVKLTGPSGKVMLIPEQDATADLIMVATGTGIAPYRSFIRRLFVEKTPYGEVYKGLAWLFLGVANKDALLYDDEWQSVLKSYPKNFRVDYALSREQTNKDGGKMYIQDKVAEYSDEIFTRMDNGAHMYFCGLKGMMPGITEMLEGVSKAKGIVWEDKLKEWKSKGQWHVEVY

SEQ ID NO: 13860 - protein, 218 aa, Bradyrhizobium japonicum
MLFMRKTTALPSATEALPGRAQAIPTASTHFVNGSKLQPPYPAGLEQAVFGLGCFWGAERKFWELGDGVYTTAVGYAGGHTPNPTYEETCSGRTGHTEVVLVVFDPKKVSYEKLLKTFWESHNPTQGMRQGNDVGTQYRSAIYTYSDAQKKAADESKALYQKALAAKGLGAITTEIAPAGAFYFAEDYHQQYLAKNPAGYCGLGGTGVSCPIGVGVSA

SEQ ID NO: 13861 - protein, 460 aa, Unknown
  Synechococcus sp. CC9605
MGKAGTDHIENLVIVGSGPAGYTAAIYAARANLQPLLVTGFQRGGIPGGQLMTTTHVENFPGFPDGVLGPDLMDLMKSQAVRWGTHLLEADADSIDLSSKPYRVEVEGQIVRTHALVIATGASANRLQLPSEQTFWSKGISACAICDGATPQFRNEELAVVGGGDSACEEAVYLTKYGSHVHLVVRSDKLRASAAMADRVLANDLITVHWNSEIDDVSGDDWMQSMTLRNRIEGSSSTIAVKGLFYAIGHTPNTDLLQGQIDLNEKGYLTTQPGRPETSMEGVFAAGDVADAEWRQGITAAGNGCKAALAAERWLSHHNLATRVQREQVEPAVAERPVNVDVTTEATYDPQGLWQKGSFALRKLYHDSAKPLLVIYTSPTCGPCHVLKPQLQRVIQELGGSAQAVVIDIEADQEIAEQAGVNGTPTVQLFHNKAMVKQWRGVKQRSEFKAAIEGCLQAAA

SEQ ID NO: 13862 - protein, 152 aa, Casuarina glauca
MALTERQEALLKQSWEVLKQNIPGHSLRLFALIIEAAPESKYVFSFLKDSNEIPENNPKLKAHAAVIFKTICESATELRQKGQAVWDNNTLKRLGSIHLKNKITDPHFEVMKGALLGTIKEAVKENWSDEMGCAWTEAYNQLVATIKAEMKE

SEQ ID NO: 13863 - protein, 231 aa, Zea mays
  misc_feature (83)..(83): Xaa can be any naturally occurring amino acid
MAGGGSDEVKLLGMWASPFVLRVQLALSLKGVGYEYVEEDLKSKSELLLKSNPVLQKVPVLIHDGKPVCESSVILQYIDEGFXGVGPSLLPEEPHGRAVARFWAAYIDGTLVKASSQASMAKTEEEKAEGKKQGTAAVETLEGALRDCSNGKPFFGGDTAGYVDVMLGGLLAWVHAGDKMKGVKTFDPATTPLLAAWADNFGSLDAVEAVMPDVGKLVEFGMAMHARAAAA

SEQ ID NO: 13864 - protein, 1551 aa, Oryza sativa
MSMAVASLRLLARGGRRRARFPAPLSVPGGRAAFLSGAAEEVAQADAPPPPPPGRKVLESFREEFEIGGRVISFETGKMARFANGSVVISMDDTHVLSTVAAAKSSEPVRDFLPLTVDYQEKQYAQGVIPTTYMRREGAPKERELLCGRIIDRPIRPLFPPGFYHEVQIMVNVISSDGKQDPDVMAANASSAALMLSDIPWNGPIGVIRVGRIDGNFVLNPTVDELGLSDLNLVYACSRDKTLMIDVQAREITERDLQAGMKLAHAEAVKCINPQLRLAKRAGKKKKEYKISLISDKSYEKIRTLSEAPIEEVFTDSTYGKFERGEALENITQSVKAKLEEECDEDSLKFLHKAVDTVRKQVIRKRIIEKGLRVDGRQLDEVRPLYCESSTYPILHGSALFSRGDTQVLCTVTLGAPGDAQRLDSIVGPPTKRFMLHYSFPPFSINEVAKRGGLNRREVGHDGLHGPIRLGDELRVWIEHKALDPTGFLLTNRLVFWERQWLSAGTLAEKALLAVLPPEGEFPYTVRVNSEVMASDGSTSMASVCGGSMALMDAGIPVREHVAGVSVGLVSEVDQTTGDISSYRILTDILGLEDHLGDMDFKIAGTRRGITAIQLDIKPAGIPLDIICESLEPARKARNQILDRMDQEISSARAFNDGSSPRLATLSFSSDSLRKLLFHRKKIEQETGSKFTVCENGVSLELSFNSYLPYSQGARVSVSDGTVTIVAKTQPIMDKAIEKVEFLVGREIEVGKTYKGVVSSIKEYGAFVEFNGGQQGLLHISELSHDKVSKVSDVVSVGQVLSLTCIGQDLRGNIKLSLKATLPHAHEKKDLASNHTDPLPSQEVVGWTAVENMPSKDANAEPSISKDEDNMIEETPGCSTPAVIIRSAAECDAQDVTNDPKKKRPKVAKSSPKLSKPASERQEVKRTSAKKTSGASTTAKKNKKEKADSSNDVLDAIPEQNKSNIMNYSSPSNFRSGSMKLGDVVTAKVYQIRAYGLVLELSDGVRGMHKFAENGHKDFEVGEELLVKCSSFNAKGIPKYRTGRKIVAFSATRSHNDEACGSEAASDNRQEMNQKNEPKMRSSSRVAAMSNAGRRRRSLTSIAPSPVSSSSFPSGAREAQAPPSQLPSWKFSQVLGELPLAAAGEGHDNGTLQDDGDTISAIEFDGRGEHLAAGDHAGRVILFRRTDDESHPPPPPSRADLERTDYAAAAPPAYAYMAEFQSHEQELGDRREGEEAEMVRAAEQLVAVHARHQRPHRQALEASRQVSEHRSRKGNGQPLRRLSTPTSASLSEIALLGEGDSSVRNGYYYEWASKKARNYLSPDSAEHSEKAGEVGEGYTAKCRRVFARAHVYNINSISNNCDGETFVSADDLRINLWHLEVTDQCFNVVDMKPADMEDLVEVITSAEFHPSSCSLLAFGSSRGFVRLVDLRQSALCDRNVRIFQDRGNSVQPRTLFTEIISCISDVKFTGDGKYLLTRDYMNLKLWDLRVESSPVATYKVHEFLRPKLSELYNNDCIFDRFSCCSSKGGDYFATGSYRFLLLQHINLISGV

SEQ ID NO: 13865 - protein, 476 aa, Oryza sativa
MAGSGRPPAAQKKILQSLRPPLPFAASSRSPFAAPNDYHRFPSGGAAAAAASGSGGIGAGGAGGGGGDIEEGLVIRTPQKRKAPEESDVAESSDCMITSPGFTVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTAPDVQWDEGLDTDVFLSEDVRTPSSHNQQPSAVGGPQMQVSDMHKP

SEQ ID NO: 13866 - protein, 292 aa, Streptomyces avermitilis
MQLGLIGLGKMGGNMRERIRRAGHTVVGYDRNPEVSDVSSLTELVSALEGPRVVWVMVPAGAPTQSVVDELGDLLSPGDTVVDGGNSRWTDDEKHAEELAAKGIGFVDAGVSGGVWGLQNGYALMVGGDAEHIARVQPIFDALKPEGDFGFVHAGKVGAGHFSKMVHNGIEYAMMQAYAEGWELLEKVDSVTDVRAVFRSWQEGTVIRSWLLDLAVNALDEDEHLEKLRGYAEDSGEGRWTVEAAIHNAVPLPAITASLFARFASRQDDSPQMKMVAALRNQFGGHAVESAE

SEQ ID NO: 13867 - protein, 902 aa, Ashbya gossypii
MHRVNVTPAQRHTGQRKHYALKQVIGKGAYGVVYKAVNRATDQVIAIKAIEYENEEELHEHMLEIDLLKNLKHENIVKYHGFIQSSHELYILLEYCIRGSLRDLIKKEALSEAKAKTYVRQTLRGLQYLHDQGVIHRDIKAANLLLTENGVVKLADFGVSTRVNNMAMTYAGSPNWMAPEVMLGKGASTVSDIWSLGATVVELLTGNPPFYNLVNEAACYAIVNDVYYPPEHLSAECKAFMELCFQKNMFKRPQAHQLLQHGWLKEGRDKLEQFKEDDLVEDRWDQDFLEVNTVVSQSSPGKKQLDGPYKYIEQLRSGQFISSPETILQNITAEDITDLMFELCNLDEPNRASLLFGVFSFDKEYVSGAGTKGFIALGGIPQVLPFEEILVTYFSSSIPLLVQCGILSRINDLHDSTLLLKIVDHVQRMFSFERWCKWCSSISSLQEVLLKELLHGNKLSEVIMLQLSTSRAFRFDLSKLMLPSFRGSVRLQHIIFKCLNNILKRTHAVDFTQTPPNSVSVSSSASSISFKMDSTLYPAGETLPDNFIDWLLNFIPPADATPKNVKIFLEVCYYASHLNSLRLSELIESHAFLDFIAHLQSNVRFLHWSACLNICVDLSNELNRDALPEMLLIGNRFFEQPDLFTGTVEILLNCMLFALREGCAYHIDKRSSDIEITQDSLPSGTIPCDKLIVNFFEKEDQFPKFITKFTRLVSLPPCGKLCYDLVMAPKFVEKMVRIFKLYQASLIIQIDALKFLKIVLTKALEYTPAGRPSKLVTPARLLESALGKQIKNTDEQHLLHVVSQLSKFLLANWSSSRPSSQLHVAAAGPTSLLETPLASASHSPPPSRKGHLGKVGNDSILIRQLCEDIASLNNKENGNNNNGRPLHDSDGFLVPRRLPSGC

SEQ ID NO: 13868 - protein, 375 aa, Nicotiana tabacum
MEVISTNTNGSTIFKNGAIPMNGHQNGTSEHLNGYQNGTSKHQNGHQNGTFEHRNGHQNGTSEQQNGTISHDNGNELLGSSDSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKETTQVKSKLGPLKFYNSDIHKAAFILPSFARSMIES

SEQ ID NO: 13869 - protein, 385 aa, Tropheryma whipplei
MSIIRSERYSAIFLLCSAALAIIFANVLDPDTWHAVHSAVSEYHIFGLITPHDIVADFLLAVFFFAVAIELKHELVKGELSSFSKAIIPGVCAAGGILVPISIYLSVASVLPNGWPVPTATDVAFSLGILAIFGSSLPSKVRIFLLALAVLDDLAGIVIIATAFSVSISYWWIIVACITVGLFGFCSYRLARCKTSKTFLIIPAMLLCALAAWVSVYQSGIHATIAGVMLGIMLNRKQGAAIEHALEPYINGIILPAFAFLAAMVRVPHLPLDEISPALWGILLGLLFGKLLGISVFGIIALKFFRKKSISFFNLLVVSALGGIGFTVSLLMNELAFLGTPVHEQGVIAVLIGSLLSAILAIILMRCYKGRKSKSLPGRKGRVSH

SEQ ID NO: 13870 - protein, 338 aa, Uromyces viciae-fabae
MSPVATESMYKPTTINQTAHQQAMDPLKSKQQSNATVNKPAFKPEPAVNLTPIKFAPIKEHQVQRAMVRRYFQDMEERAISDVIIVGAGSAGLSCAYALGTARPDLKITILESNVAPGGGCWLGGQLMSAMVCRKPADEFLDQVGVPYEDEGNFVVVKHAALFTSTVLSKVLAMPNVKMFNATACEDLIIKPCPINPGVQRIAGCVTNWTLVSLNHDHQSCMDPSTITAPLVCSFAGHDGPFGAFCVKRVASAGLSEGLGDMRPLDMERAEDHIANKTREILPGLIVGGMELSEFDGSARMGPTFGAMLLSGKRAAEVALQSLDRVKIEEGEVVGLAK

SEQ ID NO: 13871 - protein, 511 aa, Oryza sativa
MVGAGEGDRVGGGAAVGGGQQFVDRSKVRILLCDSDPSSSREVLRLLCNCSYQVTCAKSPRQVINVLNCEAGEIDIILAEVDLPVSKCFKMLKYIARNKELRHIPIIMMSNRDEVSVVVKCLRLGAAEYLVKPLRMNELLNLWTHVWRRRRMLGLSEKNFFNDNFELALSEPSDANTNSTTLLSDDTDDKPKENINQETSTSNQHEYESNPSDAEPKQKGTPEGLLVSTEGGDQASYVKSSTPTTSSFDSELQKGGNRLDSSDHRGNFSSTTDRSDTGTDVNIRDKEAFEMPVQYPVVCFSSSNLHLERSNEGQNDASGTPPVYHFPFYYPGMMDHGMTHPPVQNFQGNINNAQVHTPQTLLPQYNIYPQCHGVSMMPPFQYNPAGMSIQSNQLPTQNMWPQASSTPMPEETCSRSERRAAALAKFRLKRKERCFDKKVRYVNRKKLAETRPRVRGQFVRQANYTDITSTGDDISEDEDDDPSSREKFASTIENKDTSDLTYRTVLSSQYF

SEQ ID NO: 13872 - protein, 231 aa, Brassica napus
SYFRQHTPNPSLPAKDTSCESVVTSGQHQVASLNPPRDASPAGLLSIAEETLAEFLSKATGTAVEWVQMPGMKPGPDSIGIIAISHGCAGVAARACGLVGLEPTRVAEIVKDRPSWFRECRAVDVMNVLPTANGGTIELLYMQLYAPTTLAPPRDFWLLRYTSVLEDGSLVVCERSLKSGPSMPPVQHFVRAEMLPSGYLIRPCDGGGSIIHIVDHMDLEAWSVPEVLRPL

SEQ ID NO: 13873 - protein, 161 aa, Pseudomonas aeruginosa
MSDSLLSIPCTTIKGEQKTLADFGGKALLVVNTASKCGFTPQYQGLEALWEKYRERGLVVLGFPCNQFGKQEPGDEGEISQFCELNYGVSFPLFRKIEVNGAGAHPLFVSLKKRAPGLLGSQGIKWNFTKFLIGRDGQVVKRYAPTTKPEELSSAIEALLE

SEQ ID NO: 13874 - protein, 539 aa, Mesoplasma florum
MRNEVIYQIFPLTFSDGKKKGKGNIKGIINKLDYLKSLGITRIWISPFTKSPFKDSGYDVSDYCGINEEFGTMEEVEILISEAKKRDLTIVLDIVFNHTSDQHEWFKKALAGDEKYMNYYIFKDPVDGKEPTNWKSKMGGLSWEFVPNLNKYYLHLFTKEQPDLNWENPEVRNELINILKFWKDKGISGFRLDVCNLYSKPTLFENDEIGDGRRFYTDGVKVEEYFNLMHNEVFGTDNEIFTVGEVSSTTKEKSAKYAKVENKELDSVFTFLHLKVDYENNDKWTNVKPDLNLFWKLQKEWQEYYQLENSTLALFMNNHDQPRAVSRFGNVDKYWYESATSIFAFTSLMRGVPFIYQGEEIGMTNLTFNNLNEFKDVESIGNANDLLKIKSEEEVLDILRIKSRDNARSVMQWNDEFNAGFSEKENIDLFVNKNYKTINVKNQLNDDKSVLNFYKKVINLRLNEEVFNDGTISFFENQDYAYCRKLKDKEIIILTNWTTENKLIKLKLDSNNWKIILNNYEDFSFDSLKPYQVIAIERK

SEQ ID NO: 13875 - protein, 417 aa, Enterococcus faecalis [sequence omitted]

SEQ ID NO: 13876 - protein, 430 aa, Blastopirellula marina
MRNVISLVLGGGRGTRLYPLTKYRSKPAVPLAGKYRLIDIPLSNCINSDLNRIYVLTQFLSVSLHRHIRQTYRFDNFRGGFVELLAAQQTGNESTDWYQGTADAVRKNLKYIQQYGTDYVLILAGDQLYRMDYRKMLETHIKSGADVTIAGIPVTREDAGSLGIMRLDDSGRVVGFVEKPQTEEDLNLVRMAPDKLEALGVKSQGRDCLASMGIYLFNRDTLVDVLEKTDYEDFGREIFPAAIRSRHVQLHAFDDYWEDIGTIRAFYEANLSLANPNPPFSFSDEDEPIYSRARFLPPTLMSEVTIKRSQIADGCRIGAGCVIDNSVVGLRSLIGENVTIKDSVLMGSDYFETEGELADHRSCKRPPLGIGSGSVIQGAIIDKNCNIGKNVRIVNDHGIEDKEYDVGVTVVEGIPCVEKGAQIPDGWTLT

SEQ ID NO: 13877 - protein, 271 aa, Enterococcus faecalis
MRNKLQQAKRIVIKVGTSSLIYPNGNINLKAIDQLAFTLSDLSNQGKEIILVSSGAIGVGLNKLNLSVRPTTIPEQQAVAAVGQAELMNIYNQRFSTYSQQMAQVLLTRDVIEYPESRNNVTNTFEQLLKMNIIPIVNENDTVAIEELDHLTKFGDNDQLSAIVCQIVQADLLVMLSDIDGFFSDNPTVNKEATLFSEINEINEDLFQLAGGKGSRFGTGGMSSKLKAAERVLANQQAMILANGKQPKIIFEILEGKDIGTLFIKGGHESD

SEQ ID NO: 13878 - protein, 122 aa, Zea mays
  misc_feature (58)..(58): Xaa can be any naturally occurring amino acid
GVSLFLGRFFFFHFHRENVAKQVPAQNGQTPFYPGPERPKEFPALLNSNDPVGFNLVXVLPLGLLGHIVPYYILPPSTNGYDPPFFLPVVQDFFSTHPFACVFPFHVSDQSSSTFSSSATPK

SEQ ID NO: 13879 - protein, 204 aa, Zea mays
  misc_feature (43)..(43): Xaa can be any naturally occurring amino acid
  misc_feature (188)..(188): Xaa can be any naturally occurring amino acid
MASSSLFLQSIFMTSFTNLSCNQQFHRISLLGSCKAFQNLGIXSNGTHFSYASIFTANKNLTASQALSQNGNIENPRPSKAQELSEYEINELDRHSPKILKNAFSLMFGLGDLVPFTNQLYTGDLKKRVGITAGLCVVIEHVPDKKGERSEATYSFYFGHYGHLSVQGPYLTYEDSLLAITGGAGIFXRAYGQVKLQHPVFPTH

SEQ ID NO: 13880 - protein, 421 aa, Brucella melitensis [sequence omitted]

SEQ ID NO: 13881 - protein, 692 aa, Desulfotalea psychrophila
MFNKVEADIDGKLISIETGKLAKQASGSIVISCGGTVVLVTVVGAKTSNPNVDFLPLTIEYQEKFSAVGRVPGNYFRREIGRPSDQEVLTCRIIDRPLRPLFPEGYRSETQVIATVLSADQVNSPDVLALTGASAALSISHIPFAGPVAGGRIAYIDGKYVLNPTFAELESSSMDLMVACTRNAIVMVEGKADELSEDEILGAIFFAFENLQPLINLQDELQRANGLEKIVVESPVIDAELKAKVVEIAAAGMQKVYTTVDKLERGKVYDDLKKEVVAQLDTEEGLRASEISSLLSDFKKTYLREKTVNTGVRIGGRAWDEIRDISSETEYLPKTHGSALFTRGETQALVTATLGSERDKQRVETLNGETSRRFMLHYNFPPYCVGEARFLRGPSRRDIGHGTLATRGLEAVLPSEEDFPYAIRVVSEILESNGSSSMASVCGGSMAMMDAGVPLKRPVSGIAMGLIKEGEGVAILSDILGDEDHLGDMDFKVVGTCDGITALQMDIKIDGVSRDIMSNALDQAKRGRMHILEEMSKGIAEARAEVVEHAPKYFIHKISQDKIRDIIGPGGKIIKELSAQYDAKIEVDDSGLVKMFVANGALAEALVERVKSITAEVEVGAVYTGKVKTIKDFGAFVEILPGTDGLVHISELALERVKDVTDVVNEGDTIEVKVLDVDNRGRIRLSRKALLG

SEQ ID NO: 13882 - protein, 552 aa, Paxillus involutus
MSGKLATEYSSWKKLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSFDQMGVELGKVLAKNILSQLGKPSDVTGHDSSTAGLIHYYQKNRKE

SEQ ID NO: 13883 - protein, 235 aa, Adiantum capillus-veneris
MQQKNWTIDLEGMMAAGIHFGHQTQRWNPKMSPYIFTERKGVHILDLTQTARLLSEACDLVFDAAVEGKEFLMVGTKNQVTDLIVSAALKSQCHYVNEKWLAGTLTNWVTTETRLRRFQHLQTGGDLGEFDRLPKREAAILKGQLVRLKKCLGGIQYMSDLPDIAIITDQHEQSIALKECSILGIPTICIVDTDCDPDLVDVPIPGNDDARSSIRWILDKLALAISEGRSNIKVT

SEQ ID NO: 13884 - protein, 113 aa, Xylella fastidiosa
MSDYVLHISDANFDAMVLLSDQPVLVDFWAKWCGPCKIISTLLDDLAQSYEGRLKIAKVDIDENRALAIKYHVCSIPMLLLFKDGQVQITQTGAVGKGRLTQMIDKVLANTDS

SEQ ID NO: 13885 - protein, 255 aa, Sorghum bicolor
CELDNIMRLTGITGIVNGMDVSEWDPSKDKYIAVKYDVSTAVEAKALNKEALQAEVGLPVDRKIPLVAFIGRLEEQKGPDVMAAAIPLLMEEDIQIVLLGTGKKKFERMLMSAEEKYPDKVRAVVKFNAALAHHIMAGADLLAVTSRFEPCGLIQLQGMRYGTPCACASTGGLVDTIIEGKTGFHMGRLSVDCNVVEPADVKKVATTLKRAIKVVGTPAYEEMVKNCMIQDLSWKGPAKNWENVLLSLGVAGGEP

SEQ ID NO: 13886 - protein, 463 aa, Leuconostoc mesenteroides
MYEVKIIARTVLPVKLNQELIVVVDDIRIDGMGIVYVTAKYPLYVADALPGEKVHLLVTQVDKFSGYAKVLDWLESSDKRQNSDRQYLIDAGTAPLVNLKYEAQLELKQAQVKRLFEEQHIDVSVDRTIGMDNPTYYRNKTIVPVKWQNDHLTSGFYKRGTHDLVPMDDYFVNDAEIDQAIIVVRNILEKYDITAFDPDLERGAIRYIMIRRGYYSHELMVVLVSNEEVISHETEIIADIRNQLTELKSLILNYSPKKDYVLLSPNNRILWGEKAIYDTLLGYEFIIGPNSFYQVNPQTTEVLYDLAAQKADLKPTDTVIDAYSGIGTIGISVASRVKKVLGVEVVPGAVADAQLNLQVNNISNAEYILADAPVQFKKWQEQGLKPDVVFVDPPRRGLTTSLINGTTDMSPEKIVYISCNPVTLSRDAVEIIENGYHIDGSVLPVDQFPQTSHVESITVFRKD

SEQ ID NO: 13887 - protein, 502 aa, Arabidopsis thaliana
MGKVAVATTVVCSVAVCAAAALIVRRRMKSAGKWARVIEILKAFEEDCATPIAKLRQVADAMTVEMHAGLASEGGSKLKMLISYVDNLPSGDETGFFYALDLGGTNFRVMRVLLGGKHDRVVKREFKEESIPPHLMTGKSHELFDFIVDVLAKFVATEGEDFHLPPGRQRELGFTFSFPVKQLSLSSGTLINWTKGFSIDDTVDKDVVGELVKAMERVGLDMLVAALVNDTIGTLAGGRYTNPDVVVAVILGTGTNAAYVERAHAIPKWHGLLPKSGEMVINMEWGNFRSSHLPLTEYDHSLDVDSLNPGEQILEKIISGMYLGEILRRVLLKMAEEAAFFGDIVPPKLKIPFIIRTPNMSAMHSDTSPDLKVVGSKLKDILEVQTSSLKMRKVVISLCNIIASRGARLSAAGIYGILKKIGRDATKDGEAQKSVIAMDGGLFEHYTQFSESMKSSLKELLGDEVSESVEVILSNDGSGVGAALLAASHSQYLELEDDSETS

SEQ ID NO: 13888 - protein, 246 aa, Zea luxurians
CELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENV

SEQ ID NO: 13889 - protein, 256 aa, Zea mays
ELDNIMRLTGITGIVSGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACSSTGGLVDTIIEGKTGFHMGRLSVDCNVVEPADVKKVATTLQRAIKVVGTPAYEEMVRNCMIQDLSWKGPAKNWENVLLSLGVAGGEP

SEQ ID NO: 13890 - protein, 112 aa, Mycobacterium smegmatis
MSEDSATVAVTDDSFSTDVLGSSKPVLVDFWATWCGPCKMVAPVLEEIAAEKGDQLTVAKIDVDVDANPATARDFQVVSIPTMILFKDGAPVKRIVGAKGKAALLRELSDAL

SEQ ID NO: 13891 - protein, 257 aa, Zea mays
CELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACSSTGGLVDTIIEGKTGFHMGRLSVDCNVVEPADVKKVATTLQRAIKVVGTPAYEEMVRNCMIQDLSWKGPAKNWENVLLSLGVAGGEP

SEQ ID NO: 13892 - protein, 362 aa, Capsicum annuum
MATAVTAAVSLPSSKSTSFPTRTSIISPEKINFNKVPLYYRNVSGGSKLVTIRAQVTTEAPAKVEKISKKQDEGVVVNKFRPKEPYIGRCLLNTKITGDDAPGETWHMVFSTEGEIPYREGQSIGVIADGVDANGKPHKLRLYSIASSALGDFGDSKTVSLCVKRLVYTNDKGEEVKGVCSNFLCDLKPGADVKITGPVGKEMLMPKDPNATVIMLGTGTGIAPFRSFLWKMFFEKHDDYKFNGLAWLFLGVPTSSSLLYKEEFEKMKEKAPENFRLDFAVSREQTNEKGEKMYIQTRMAQYAEELWTLLKKDNTFVYMCGLKGMEQGIDDIMSSLAAKEGIDWADYKKQLKKAEQWNVEVY

SEQ ID NO: 13893 - protein, 255 aa, Aegilops markgrafii
ELDNIMRLTGITGIVNGMDVSEWDPTKDKFLAANYDITTALEGKALNKEALQAEVGLPVDRKVPLVAFIGRLEEQKGPDVMIAAIPEILKEEDVQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEP

SEQ ID NO: 13894 - protein, 313 aa, Unknown
  marine gamma proteobacterium HTCC2143
MTNVPTIDLNCIDNDALQALDLACRDHGFFFLKGHGLDALVEAVKTQAECFFALPRDEKQKVVRKEDNPMGYYDRELTKQKRDLKEVFDFYARSNGQENRMPWPQQPTEFKETLRAYFLANAELSNRVMHILCNALGVDETSFDRFFMPRHTSSARLNYYPSEDPLAADDQQSVTPLGDMALHHHTDQGAITLLFQDDIGGLQAFSKDAGWIDIPPMEDALVVNIGDIAQVWSNGAYQAALHRVLPIAAGKSRYSLPFFYQPSFDTVVAPHQDLGAPNYRSFNCGDFIQGRIDDNYEDLGADDIQVERFRINA

SEQ ID NO: 13895 - protein, 202 aa, Cicer arietinum
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLAANKVVSSETAKAFADEIGIPFMETSAKNATNVEQAFMAMAAEIKNRMASQPANNARPPTVQIRGQPMNQKSGCCST

SEQ ID NO: 13896 - protein, 158 aa, Arabidopsis thaliana; identical to SEQ ID NO: 304

SEQ ID NO: 13897 - protein, 370 aa, Haemophilus somnus
METQKTNKTIVVKFGTSTLTQGSSKLNRPHMMEIVRQITQLHRAGFRIIIVTSGAMAAGRHYLNHPQLPPTIASKQLLAAVGQSQLIQTWEQLFAIYDIHIGQILLTRADIEDRERFMNARDTLHALLDNRIIPVINENDAVATAEIKVGDNDNLSALVAILAQAEQLYLLTDQRGLFDSDPRKNPQAKLISIVDKITDHIRSIAGGSGTTLGTGGMTTKISAADIATRSGVETIIAPGNLENVIVNLAYGKEIGTKFVVQTDCLESRKQWLFAAPVAGIVTIDEGAESAVLIQHKSLLPAGIISVEGCFSRGEVVKICGTNGKKIALGVPRYNSDSLIQIKGKKSQDIEQILGYEYGSVAIHRDDMVVY

SEQ ID NO: 13898 - protein, 286 aa, Pseudomonas syringae
MSDYQETLYEGYGQRFRMEKMLHEVRTEHQHLVIFQNPRMGRVMALDGVIQTTEADEFIYHEMLTHVPILAHGAAKRVLIIGGGDGGMLREVAKHLTVEHITMVEIDATVVEMCKEFLPNHSSGAFDDSRLNLVIDDGMRFVATTEEKFDVIISDSTDPIGPGEVLFSENFYQACHRCLNEGGILVTQNGTPFMQLSGVQTTAGRMNGLFADWHFYQAAIPTYIGGAMTFAWGATDKSYRKLPLETLRQRFTGSGIVTRYYNPEVHISAFALPQYVLQAVSKASND

SEQ ID NO: 13899 - protein, 347 aa, Heterocapsa triquetra
NVAEGALAAGMPSSAARSAGVFYPLVCSVAKASGSDPAQGTEKKTGAFLVQSAFQATGNSSSLWLYGAAQNLLALRLAAQCGYEIASPFTAWLKATCVPALVAMALTPLVTFWALKPEVTKTPEAPAEAKRKLDEMGPMSRDEAILGGVVAGMLVLWAGSTAFGIPAVTTAVLGLSALLLTGTMTWADCASEQGAWTTMTWFAILVSMSAMLNKRGVVSWLAATISGQITGAGLSAAPAFFLLLFIYTFSHYAFASQVAHLSALYVPFIAMMVKTGTPPAVAVFALAVASNVFGSLTPYASAQAPVFYGGGYVTLKDWYRMGLIFIVFNLAVWISVGSVWWKIIGLY

SEQ ID NO: 13900 - protein, 620 aa, Perilla frutescens
MATANQKGVTDNLRNQLALAVRSIQWSYAVFWSFSAKQSGSLEWGEGYYNGDIKTRKTVQAVELNSDPLGLQRSDQLRELFESLSLGETSPQPKRPTAALSPEDLTDTEWYFLVCMSFVFNVGQGLPGRSFAKNDTIWLRNAHLADTKLFSRSLLAKSASLQTVVCFPHLGGVVELGTTELVAEDRNLIQHIKTSFLESSSDTVINPNHDLVYQVLDHANDPENNLDDVEVCSPDTSSDDFADNVLIEGSSLADGADGEASQLQNWQFKDDAISNGLNNSTSSSDCVSQTQGNPVTVVQQLDGKKTSDNCMPVNQECNQQKSPPGFNGSDVHYQSVLSSLLKSSHQLMLGPNRNGKQESSFISWKDRKLSSRLPQILSPQRLLKKVLFEVARMHENARIESAKQKDKCDDHSGQEADEVDRNHVLSERKRREKISERFSILVSLVPSGGKVDKVSILDHTIEYLRELERKVKDLESYKEATERESTTQSKAHDSIERTSDNYGHSKFGSITKLLGNKRKSCDTEKMAGENKRGRSSSSTDSITISITDKDVLIEMRCSWRQCVLLEVMEALTQLNLDSQSVQSSNTDGILSLSINAKSKGVKGASAGAIKQALQRIIKKC

SEQ ID NO: 13901 - protein, 315 aa, Acidobacteria bacterium
MNTSEMSTLRVAEDISELVGQTPMLHLRKMVPPEIADIYVKLEFLNPGGSIKDRAALGMILRAEKEGVLKPGATILEATAGNTGVGLALIGVSRGYKVVLAVPQKFSKEKVMLMEALGAQVYRTPDAEGMEGAIRLVKKFLTEIPNSWLAGQFENQANPDFHYETTGRELWEQMGGKIDAIALGAGTAGTFTGVARYLKERSPQTLCVLVESQASVYGGGKSGPHAVEGIGASFIPATFDRSVCDEVIAVKDVDAFRTIKDLAAKEGVLAGSSSGAAVFASLELAKRLGPGKRVVTIIPDSAERYLSKDPYHFNE

SEQ ID NO: 13902 - protein, 784 aa, Oryza sativa
MMIPARHMPSMIGRNGAAYGSSSALSLSQPNLLDNHQFQQAFQHQQQQHHLLDQIPATTAESGDNMIRSRASDPLGGDEFESKSGSENVDGVSVDDQDPNQRPRKKRYHRHTQHQIQEMEAFFKECPHPDDKQRKELSRELGLEPLQVKFWFQNKRTQMKNQHERHENSQLRSDNEKLRAENMRYKEALSSASCPNCGGPAALGEMSFDEHHLRIENARLREEIDRISAIAAKYVGKPMVPFPVLSNPMAAAASRAPLDLPVAPYGVPGDMFGGGGAGELLRGVQSEVDKPMIVELAVAAMEELVRMAQLDEPLWSVAPPLDATAAAMETLSEEEYARMFPRGLGPKQYGLRSEASRDSAVVIMTHANLVEILMDANQYAAVFSNIVSRAITLEVLSTGVAGNYNGALQVMSVEFQVPSPLVPTRESYFVRYCKQNADGTWAVVDVSLDSLRPSPVLKCRRRPSGCLIQEMPNGYSKVTWVEHVEVDDRSVHNIYKLLVNSGLAFGARRWVGTLDRQCERLASVMASNIPTSDIGVITSSEGRKSMLKLAERMVVSFCGGVTASVAHQWTTLSGSGAEDVRVMTRKSVDDPGRPPGIVLNAATSFWLPVPPKRVFDFLRDESSRSEWDILSNGGIVQEMAHIANGRDQGNCVSLLRVNSSNSNQSNMLILQESCTDASGSYVIYAPVDVVAMNVVLNGGDPDYVALLPSGFAILPDGPAHDGGDGDGGVGVGSGGSLLTVAFQILVDSVPTAKLSLGSVATVNSLIACTVERIKAAVSGESNPQ

SEQ ID NO: 13903 - protein, 249 aa, Pseudomonas syringae
MTVYFIGAGPGDPELITVKGQRLIRSCPVIIYAGSLVPLAVLEGHQAVQVTNSAELHLEQIIDLIKRAHAQGQDVARVHSGDPSLYGAIGEQIRHLRELNIPFEIIPGVTATAACAALLGVELTLPDVSQSVILTRYADKTSMPSGEELASLASHRATMAIHLGVNNLQRIVEELMPHYGADCPIAVVHRASWPDQDWAVGTLADIEEKVQAKGFRRTALILVGRVLADDTFSESSLYRAGHAHLFRPV

SEQ ID NO: 13904 - protein, 183 aa, Tropheryma whipplei
MVITFTCTPYAVNCKHMKPLLSEAVIHRRLAQLALQIDEDYRGTSIVLLGVLKGSIMLMADLSRLLSSDLRIEWVTLSSYGNDTVSSGSIRIVHDLDADIRDRHVLIIEDIVDSGLTLGWLLAKMRERRPASIEACVLLRKPHARGTDVRYLGFDIPDEFVIGYGMDYAEKYRNLKSVYVLEQ

SEQ ID NO: 13905 - protein, 360 aa, Triticum aestivum
AWIVVHGHVYDCTAFLKDHPGGADSILINAGSDCTEEFDAIHSDKAKALLDTYRTARPITTGTGYNSDNSVHGGSSLSHLAPIREATKVAGAPIALSSPREKVPCRLVDKKELSHDVRLFRFALPSSDQVLGLPVGKHIFVCATIDGKLCMRAYTPTSMVDEIGQFELLVKVYFRDEHPKFPNGGLMTQYLESLQLGSCIDVKGPLGHVEYTGRGNFVINGKQRRARRLAMICGGSGITPMYQVIQAVLRDQPEDETEMHLVYANRSEDDILLRDELDRWAAEYPERLKVWYVIDQVKRPEDGWRFSVGFVTEDILRAHVPEGGDETLALACGPPPMIKFAISPNLEKMKYDMANSFISF

SEQ ID NO: 13906 - protein, 104 aa, Campylobacter lari
MGKYIDLTAENFAQAKEGVALVDFWAPWCGPCRMLAPVIDELANDFDGKAKICKVNTEEQGDLAAQFGVRSIPTIFFFKDGEVVDQLVGAQSKQVLADKLNSLL

SEQ ID NO: 13907 - protein, 106 aa, Zea mays
QNSIIFLINNGGYTIEVEIHDGPYNVIKNWNYTGLVEAFHNGEGACYTAKVRTEEELTEALEAALGPKKDCLCFIEVIVHKDDTSKELLEWGSRVSAANSRPPNPQ

SEQ ID NO: 13908 - protein, 202 aa, Zea mays
PNEPLRVNVLFKHVQKMLTGDSAVIAETGDSWFNCQKLKLPEGCGYEFQMQYGSIGWSVGALLGYPQGANHKRVIAFIGDGSFQVTAQDVSTILRCEQNSIIFLINNGGYTIEVEIHDGPYNVIKNWNYTGFVDAIHNGLGKCWTSKVKSEEDLTAAIETALGEKDCLCFIEVIAHKDDTSKELLEWGSRVSAANSRPPNPQ

SEQ ID NO: 13909 - protein, 313 aa, Campylobacter lari
MMLDLAIIGGGPAGLSAGLYATRGGLKNVVMFEKGTPGGQITSSSEIENYPGVAQVLDGISFMAPWNEQCMRFGLKHEMIGVEQISKNTDGSFNIKLENGKVEQAKAVIVCTGSTPRRAGFKGEDEFFGKGVSTCATCDGFFYKNKEVAVLGGGDTALEEALYLANICSKVYLIHRRDEFRAAPSTVEKVRNNDKIELITNAVVDEVCGDNMGVNKVKIAFNDGSKRELDVPGIFTFVGLNVRNEILKQENGEFLCAMEEGGQVSVDLKMQTNIAGLFAAGDLRKDAPKQVICAAGDGAVAALSALAYIENLH

SEQ ID NO: 13910 - protein, 528 aa, Leuconostoc mesenteroides
MKFSELGLSQDILDAITTHGYVEATPIQEKTIPLTLAGRDVIGQAQTGTGKTAAFGLPILEHIDLNNKNIQALIVSPTRELAIQTAEELKKLGRDKRVDVQVVFGGADIRRQIQNLKSHPQILVGTPGRLLDHINRKTVKIDNVRTLVLDEADEMLNMGFLDDIEAIISKTPAERQTLLFSATMPPAIKRIGVKFMTNPEHIQIEAKELTTDLVDQYFVRMRENEKFDTMTRIFDVQAPKLAIVFGRTKRRVEELSRGLEARGYHAAGLHGDLTQQMRSRVLAQFKSHEINILVATDVAARGLDVKDVSHVYNFDIPQDPESYVHRIGRTGRAGAKGVSVTFVAPNEMDYLRAVEDLTKKRMTPLEPASLKDARIGKINNAAGEVAKLIDTTEVSEIQSQVDALTAKYSAEQLAAAVLSSVADLEKQNTPVEITRERPLPRRKGGNGGSRGGSRNGGGRRNGGGGGYRGNRERRGNGDTRGNDRRRGSGAASSERRFGDYKRRDGRSTESRRNSSGGSRREFTVREKD

SEQ ID NO: 13911 - protein, 168 aa, Wolbachia endosymbiont
MDNKFKLFQEGQKIIDLGASPGGWLQVASQKGANVVALDVKPMNAINGVEFIQCDIINEFEILREKFKDQKFDVILSDMAPESCGLKSLDHIRIMLLCEAALNFAKHFLSHGGTFVVKIFQGESDKDFCNELKKMFKTVKYFKPKSSRSESTEMYLVSLGFIGSRLSI

SEQ ID NO: 13912 - protein, 274 aa, Aeropyrum pernix
MNSNMVFARVNEADVTEAILDGFYSSLKKHLRSDVIVVGAGPAGLTAAWRLAEAGARVLIVEQNNYLGGGLWLGGYFMNPVTIRAPAQRILDELEVPYEAVKPGLYRTKGPLLAAKLAARALEAGAEVLNLTMLDDVIVENSRVAGVVVNWSPVQGLPRQITCVDPVGLRAEYVVDATGHDAVVTRKLAERGMVEASKLGPMWVERSEDLVVEKTGEVYPGLVVAGIAVAEVYGLPRMGPTFGAMLLSGEKAAALIGEKLGLKVKVAAAPASQA

SEQ ID NO: 13913 - protein, 484 aa, Zea mays
  misc_feature (336)..(336): Xaa can be any naturally occurring amino acid
MAAGGGAPWAERARVVGTQIRNRFRVAPVDHRSLWLRADGRVATEAVRRWSDRVRALLQRGRSADRNSTSTDTSPEAVAKPSSSVLRFYRKRVGKEVNGIEDSVIFRSLQALAVPLIGNACYVFMHGLNSVQVYGVEKLHQALHGRPKGKALLTVSNHVAAMDDPFVIASLLPPSVMLEAQKLRWTLCATDRCFTNPVLSTFFRSVKVLPVSRGDGIYQKGMDMALSKLNSGGWVHIFPEGSRSRDGGKTIAPAKRGVGRLVMDADSLPVVIPFVHTGMQDIMPVGKRIPRAGKRVIVVVGDPINFDDLLIDNCGDTQDIPRGILYDTVNRELGSXMQELKVEVDRLAAEQEPALQNRNVGDDGYRLWQQVDWEGFGIGSSMLPSEPSAAAQVPSREAEPEPHLEVEQSVSPAPSAATSYDVAVPHWFQRHADPSELMGFASRGLIKHGKFLEEGYREFQQSATTLHTWWVSRANNAAHRWSTA

SEQ ID NO: 13914 - protein, 256 aa, Aegilops comosa
CELDNIMRLTGITGIVNGMDVSEWDPTKDKFLAANYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPLAHQMMAGTDVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEP

SEQ ID NO: 13915 - protein, 91 aa, Thiocapsa roseopersicina
MSDSIVHVTDDSFEDEVLKSLEPVLVDYWADWCGPCKMIAPVLDEIAGEYAGRIKVAKLNIDENPNTPRRYGIRGIPTLMLSRQSEVEATK

SEQ ID NO: 13916 - protein, 322 aa, Prochlorococcus marinus
MEIANDITSLVGNTPLVKLNRIRKYFDCYPEIIAKLESFNPSASVKDRIAYSMLCKAEEEGLITPDKTTLIEATSGNTGIALAMVAAAKGYKLILTMPDTMSIERRAMLRAYGAELQLTPGKDGMKGALDLANELSSTIANSYQFNQFENFANPDIHERTTAQEIWSQSNNNLDGLVTGVGTGGTITGCARFLKKVNPNCKIYAVEPKKSAVISGEKAGSHSIQGIGAGFVPKVLNTKLIDEIIKIDDDEAFYFGRLLARLEGLLSGISSGAALAATIKIGKRKELMKKRLIVILPSFGERYLSTAMFESNTSIQARKDGYL

SEQ ID NO: 13917 - protein, 256 aa, Aegilops searsii
CELDNIMRLTGITGIVNGMDVSEWDPTKDKFLAANYDVTTALEGKALNKEALQAEVGLPVDRKVPLVASIGRLEEQKGPDVMIAAIPEILKEEDVQIVLLGTGKKKSERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHGMVKNCMIQDLSWKGPAKNWEDVLLELGVEGSEP

SEQ ID NO: 13918 - protein, 211 aa, Paxillus involutus
MAEGSNYDFLFKVVLIGDSGVGKSNLLSRFTRNEFNLDSKSTIGVEFATRSINVDSKTVKAQIWDTAGQERYRAITSAYYRGAVGALLVYDISKHATYVNVTRWLKELRDHADSNIVIMLVGNKSDLKHLRAVPTEEAKNFSAENELSFIETSALDASNVESAFQTILTDVYRIVSTKSLEQSSDPIRAPTSDTIPVAIDSSAPTKNGSCC

SEQ ID NO: 13919 - protein, 256 aa, Aegilops bicornis
CELDNIMRLTGITGIVNGMDVSEWDPTKDKFLAVNYDITTALEGKALNKEALQAEVGLPVDRKVPLVAFIGRLEEQKGPDLMIAAIPEILKEEEVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVNKVVTTLKRAVKVVGTPAYHGMVKNCMIQDLSWKGPAKNWEDVLLELGVEGSEP

SEQ ID NO: 13920 - protein, 256 aa, Aegilops longissima
CELDNIMRLTGITGIVNGMDVSEWDPTKDKFLTANYDITTALEGKALNKEALQAEVGLPVDRKVPLVAFIGRLEEQKGPDVMIAAIPEILKEEEVQIVLLGTGKKKFERLLKSIEEKFPSKVRAVVRFNAPLAHQMMAGADMLAVTSRFEPCGLIQLQGMRYGTPCACASTGGLVDTIVEGKTGFHMGRLSVDCNVVEPADVNKVVTTLKRAVKVVGTPAYHGMVKNCMIQDLSWKGPAKNWEDVLLELGVEGSEP

SEQ ID NO: 13921 - protein, 254 aa, Aegilops speltoides
LDNIMRLTGIAGIVNGMDVSEWDPTKDKFLATNYDITTALEGKALNKEALQAEVGLPVDRKVPLVAFIGRLEEQKGPDVMIAAIPEILKEEDIQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEP

SEQ ID NO: 13922 - protein, 473 aa, Bacillus cereus
MQQQTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNADVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESEEPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYKTPLYPIVPILALITNSIVVISLAFIPEQRMALYCGIPFIIFCYIYYYINKKRQKPMKVETTNETNHQTR

SEQ ID NO: 13923 - protein, 150 aa, Lactobacillus delbrueckii
  misc_feature (137)..(137): Xaa can be any naturally occurring amino acid
NREIYNFKPLREELIKAGHTFSTKADTEVILHGYEEWGMDGILKRVRGMFAFIIWDDNTQTMYGARDFFGIKPMYYQDVDGHLLVGSELKSFLPFPHFKKELNTEAVKPYLMNQYNDLKETFFKGVYRFQPGHWFEXKDGKMKTHQYWDA

SEQ ID NO: 13924 - protein, 108 aa, Cicer arietinum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQD

SEQ ID NO: 13925 - protein, 1156 aa, Yarrowia lipolytica
MRDYSDVSEAETEVAPSPYKLGSRLKRLKRRIDDDDDYSSDEGPSNHSSQVLRKEPKRKNSSDMSRSATPMPRVGSGSRKKRDANGRMKLQRMCDKGKYEEAYQLVRDGADVNDRDYAGNTALHEAALKGHVDIVKLLLDHKAIVDIRSGPTDLDTPLIDAAANDHVEVVQLLLERGADPRIINALGKSAMDSVDEEMPHSTKIRSLIQEALHSFRNRPRPPESREDDPEAFPDPELHKIYNHGTGGGEGGGAGSDTGSSRRRGVRAQAMRNDLLWLDLTSKNGREQIYQKAADGDIEFIGSSLEGGWKPDTQSLCLAARHGHTDVVGLLLAFGCECDEPGEDGETALLRTVGRGHVSTLKLLLDSGANPLRKNSQGKTALQVVKELSGYEEEVTLLEEWTSKGSGKDRGDSKLVKSEKADKSEKADKSDRDKARLEKMEKRRIERERERERERERDRERVKVEKVEKSEKSEKREKRERTNSTSERHNSTASTHSERHNSTSEIRDRERERERERERERKHVKKEPVVDTHANMSSSSPHHVASPPRVASPSQMSPVSTPMSRTSSQADENKGSVKHERTPSISSISDKLLVKKRKLAGGKEEMERRKSKEEVKVKKRSISSASGASNKPQSVFDKLFGSKQKEKEEQQRVAREKEEAARLERQERIRRKKQQQQEQLEEEKRKLEEEKRKLEEKKRLEEERLRKEQEKRDKAEKAERERVERERREKKERERKEREDKEKKEREEKERAERVEREKRERAERAEKAEKEARERKEREEKERVERVEKEKARAEKAEKEANEAAKAEKEAKDKEIKEAAEKAQAKEVKESKESKEPKESKETSKESSRESLSASSSAAASTTPSAATSPDSRKSPLIKRPKELDRQKSKESLDRREIEREKERKRLERQRAILKGIEEDERRRNEMRRREQELKAEQELLAAKEREKREAEELEREKERERQRRIQLDIDSRKALPYGLREAIYEPRQVDQIFAFLPLFVRQSCFLDIQLSLLLGVKNFCGSYPRVARRIVSTTEKERLWSTLTPLLCRAPGPGDDLEMVGLERQDERRKFLGMNCFWVSCSDVLEVISTNFPLLFDAVMSVAPLKVDIDWEEDAEAAAATAAYVEAESEQIDKAIAKFPLRVRMKLQALRPQWP

SEQ ID NO: 13926 - protein, 508 aa, Bradyrhizobium japonicum
MRVLLVNVPHPSIGSRIPDDHLPPLGLLAIGGPLIDDGHAVRLIDAEFGPMSIAEVVSEATGFAPDAVLFGHSGSTSGHPVIAAVACALVKVMPRVLIVYGGVFPTYHWREILHDEPYVSAIVRGEGEETARRLMRALEYGRDLADIAGIAFRDVSGPRATQPAPVIANLDACRIGWELIDHARYSYWGGLRAVVVQFSRGCPHLCNYCGQRGFWTRWRHRDPVRFAKELARLHREQGVKVINFADENPTVSKKVWRAFLEALIAENVDLILVGSTRADDIVRDADILHLYKKAGWQRFLLGLENTDERTLELIRKGATTAVDREAIRLLRQHGILSMATWVVGFEEETDRDHWRGLKQLLAYDPDQVQLLYVTPHRWTPYFRLAAERRVIQPDRRRWDYKHQVLATRHMAPWRVLAWFKFTEMVLQCRPKAIWRVLFQRDAGLRHAMRWYTQMGRRVWPHEILEFLRARRLKWGPSVREFWGAPQDDEEQSMTATRPERRVGRREAA

SEQ ID NO: 13927 - protein, 72 aa, Parvularcula bermudensis
MAKEELLEFQGTVEELLPNANFRVKLDNDHEIIAHTAGKMRKNRIRVLAGDKVLVEMSPYDLSKGRITYRFK

SEQ ID NO: 13928 - protein, 968 aa, Prochlorococcus marinus
MSKAELKDFTFKSRHIGPTNEDEALMLQHLGYENSEEFISSVIPNEIFDSENNVVSIPDGCDQNKALKEINIISKKNVEHRSLIGLGYHSTVIPPVIQRNVLENPNWYTAYTPYQAEISQGRLEALFNFQTLISELTGLPISNASLLDEATAAAEAISLSLAVRKNKNANKFLVDQEILPQTFDVLKTRCEPLGISLEMFENNNFEIDKNIFGILIQLPGKNGRIWDPTKIINDAHKCNAIVTIAIDPLAQVLIKPMGEFGADIVVGSAQRFGVPIACGGPHAAFFATKEIYKRQIPGRIVGQSVDVEGNQALRLALQTREQHIRRDKATSNICTAQVLLAVLSSFYAVHHGPKGLKQIAENVVKYRSNFESILMNLEYPIEKYSAFDSVDVYCSEASEVIQLASEEGYNFRVLPIGSDFENAKGFGVTFDELTCDEEIYTLHQILAQVKGKKAHDLSNFLNENASLVDIPLREKSWLEQSVFNQYQSETDLMRYIHSLVSKDFSLVQGMIPLGSCTMKLNSAAELLPIEWREFSSIHPFAPHAQLAGFHEIINDLENWLSALTGFQGVSLQPNAGSQGEFAGLLVIRSWHQSLGEGHRNICLIPTSAHGTNPASAVMSGFKVVSVKCDEYGNVDLEDLKNKSKIHSKNLAALMVTYPSTHGVFEPNIREMCQVIHQEGGQVYLDGANLNAQVGICRPGSYGIDVCHLNLHKTFSIPHGGGGPGVGPIAVADHLVPYLPGHSIIKCGGEKAISAVSAAPFGSAGILPISWMYIRMMGSDGLRKASSIAILSANYLAKRLDPYYPVLFKDPNGLVAHECILDLRPLKSQLGIEVEDVAKRLMDYGFHAPTISWPVAGTLMVEPTESESLPELDRFCDAMIGIREEIEQIKLGKIDPINNPLKQSPHTLKRVTSDDWDRPYSRKEAAYPLPDQEKYKFWPSVSRINNAYGDRNLICSCPSVQDLEDINSV

SEQ ID NO: 13929 - protein, 429 aa, Unknown
  Synechococcus sp. WH 8102
MSDSTASSINKGLAAADPAIAALIEKEQQRQETHLELIASENFASRAVMDAQGSVLTNKYAEGLPSKRYYGGCEHVDAIEELAIERAKELFGAAWANVQPHSGAQANFAVFLALLQPGDTIMGLDLSHGGHLTHGSPVNVSGKWFNVVQYGVDRETQRLDMEAIRQLALEHKPKLIVCGFSAYPRTIDFAAFRAIADEVGAFLLADMAHIAGLVAAGVHPSPVPHCDVVTTTTHKTLRGPRGGLILCRDADFAKKFDKAVFPGSQGGPLEHVIAAKAVAFGEALQPAFKTYSQHVVANAAALAERLIARGIDVVSGGTDNHVVLLDLRSVGMTGKVADLLVSDVHITANKNTVPFDPESPFVTSGLRLGTAALTTRGFDAGAFREVADVIADRLLNPEDDAVQQQCLRRVEALCQRFPLYAAARQPALA

SEQ ID NO: 13930 - protein, 954 aa, Rhizobium leguminosarum
MTTPTEFQFTDYQPYDFANRRHIGPSPAEMTDMLKVIGYNSLDGLIDATLPPSIRQKAPLVWGAPMTEREALDKLRETANKNKVLVSLIGQGYYGTITPPVIQRNILENPAWYTAYTPYQPEISQGRLEALLNYQTMICDLTGLDVANASLLDEATAAAEGMAIAERVAKSKAKAFFVDADCHPQTIALIRTRAEPLGWSVIVGNPVTDLDPVDVFGAIFQYPGTHGHVHDFTGLISRLHQTGAIAIVAADILALTLLKSPGEMGADIAVGSSQRFGVPVGYGGPHAAYMSVKDAIKRSMPGRLVGVSVDARGNRAYRLSLQTREQHIRREKATSNICTAQVLLAVMASMYAVFHGPKGIKAIAQQVHQKAVLMAKGLEKLGYKVEPETFFDTITVDVGHMQGLILRAAVAEGVNLRKVGETKIGMSLDERTRPATLEAVWRAFGGNFTIADFEPSYRLPKGLLRTSDYLTHPIFHMNRAESEMTRYIRRLSDRDLALDRSMIPLGSCTMKLNATAEMLPITWPEFSDIHPFVPADQALGYREMIDDLIEKLCAVTGYDAFSMQPNSGAQGEYAGLLTIRNYHIANGDGHRDVCLIPTSAHGTNPASAQMVGMKVVVVKVRENGDIDLDDFRAKAEQHAANLACCMITYPSTHGVFEETVKEICDLVHEHGGQVYLDGANMNAMVGLSRPGDIGSDVSHLNLHKTFCIPHGGGGPGMGPIGVKAHLAPYLPGHPETDGRPGAVSAAAFGSASILPISWSYCLMMGGEGLTQATKVAILNANYIAARLRGAYDVLYKSETGRVAHECIIDTRPLVDSSGVTVDDVAKRLIDCGFHAPTMSWPVAGTLMIEPTESETKAELDRFCEAILAIREEARAIEDGRMDKVNNPLKNAPHTVEDLVGEWDRPYSREQACFPPGAFRVDKYWSPVNRVDNVYGDRNLICTCPPVESYAEAAE

SEQ ID NO: 13931 - protein, 412 aa, Mesorhizobium loti
MTEMARGMVIIGAGECGGRAALTLRDLGYDGPVTLVGDEPHLPYERPPLSKEAMASDAPEIKAIASDAVLAERSIRHIHSVQAAAIDRAAHSVRLSDGSVLPYDKLLLATGATPRKLSMPGLGARCVYLRTFADALAIRGHLRAGSRIAVIGGGFIGLELAAASRRLGAAVTVIEAQPRILMRGVPAEIAEIVHDAHIAEGVDIVCGQGIASIADDGRQVRVTLAGGREVSADLAIIGIGAVPVTGLAADAGLMIDNGIAVDAELCSSDPDIFAAGDCCSFPLAVYGGRRVRLEAWRNAQEQGALAAKNMLDAGEAHAAVPWFWSDQYGLSLQIAGLSDEGKNTVRRDLDDGAFILFHLAEDGTLVAASGIGPGNAVARDIRLAEMLIGKRAKPAPEALGSQAVKLKSLLAA

SEQ ID NO: 13932 - protein, 92 aa, Oryza sativa; identical to SEQ ID NO: 428

SEQ ID NO: 13933 - protein, 188 aa, Unknown
  Fragaria x ananassa
MASSTTNPSSGPRFRHSGKPGSPVCSIRGGLLLGSRAQVSASRRRDQDRGSLLPGQRPRPELRASLHRNHQPLRGGSAPLRPASLLILRPTSRIWSRHDPTTLNRQGRYVGLNMDLGYITTLESRLVSRGIQGSNAKELKDKSVVTEILPAKRFYRSEEYHQQYLEKGGDHGNQSAEKGCTDPIRCYG

SEQ ID NO: 13934 - protein, 490 aa, Bacillus halodurans
MDFHTDTIILLAGLLFIVGVITAKFSTRLGVPALVLFILVGMLVGSDGLGLIHFDFSQAHFAQLIGIFALVIILFEGGLQTKWKTVQSVAVPSLSLATFGVLITSTLVAVAAKYVLGVSWLEAYLFGAIVGSTDAAAVFAVLKEQNIKDRLATTLEAESGTNDPMAVFLTLSLIELITIGSMNPLHLFGSFLWQMGAGLILGFGLGKLGSYSINKINLDSSGLYPVFALAFALLTYSVTAMIGASGLLAVYVAALVIGNQDLTYRHSIFRFNEGFAWMMQMLMFIILGLLVFPNQLFEASIFIKGILLSLILMLVARPVAVFLTTIKMRFDWKEKLFLSWAGLRGAVPIVLATFPMTAGLENSPLFFNVVFFVVLTSALIQGSTIAHFANKLQLTGPQKTTPLHSLELVSIGKANAEIVELEMKQDTPVIGKTLEEINLPKDVLVNAIIRDEQLITPYGKTTIQADDILYVLVSKKKKRQLKELFQAKES

SEQ ID NO: 13935 - protein, 89 aa, Unknown
  Candidatus Protochlamydia amoebophila UWE25
MKRRTSSCFLGFITSGNMAKEDTIKIEGSVEELLPNMHFRVSLQNGLNVIAHLCGKMRMKNIRVLVGDVVTVEMSPYDLSKARIIFRQR

SEQ ID NO: 13936 - protein, 410 aa, Campylobacter jejuni
MRNLLENIKKNSQKLLNLTPKDKEKIILKLAQILRENFKIILEANKKDMANFTKSGKMKDRLLLDEKRILALCEGLEKIAYIEDPIGKISKGWKNYAGLNIQKISIPLGLICVIYEARPSLSAEIAALMIKSSNACVFKGGSEAKFTNEAIFTLVNKVLKEFDLQDCFAMFTQRDEILQILAFDDLIDVIIPRGSSNMIQEIANNTKIPLIKQNKGLCHAFVDQSANLDMALKIILNAKCQRVSVCNALETLLIHEKIAKNFISLLIPEFEKFKVKIHAHENTLAYFNNSNLEIFKANENTFDTEWLDFALSVKLVKDCDEAIEHINKHSSLHSETIISNDASNIAKFQRLINSSCIYANASTRFSDGGEFGFGGEVGISTSKLHARGPMGIEDICTYKYIINGEGQIRE

SEQ ID NO: 13937 - protein, 305 aa, Neisseria meningitidis
MNLTKTQRQLHNFLTLAQEAGSLSKLAKLCGYRTPVALYKLKQRLEKQAEDPDARGIRPSLMAKLEKHTGKPKGWLDRKHRERTVPETAAESTGTAETQIAETASAAGCRSVTVNRNTCETQITVSINLDGSGKSRLDTGVPFLEHMIDQIARHGMIDIDISCKGDLHIDDHHTAEDIGITLGQAIRQALGDKKGIRRYGHSYVPLDEALSRVVIDLSGRPGLVYNIEFTRALIGRFDVDLFEEFFHGIVNHSMMTLHIDNLSGKNAHHQAETVFKAFGRALRMAVEHDPRMAGQTPSTKGTLTA

SEQ ID NO: 13938 - protein, 353 aa, Haemophilus influenzae
MKLSKTFLFITALCCATPTLAIQNSTSSSGEQKMAMENTQNIREIYLAGGCFWGMEAYMERIHGVKDAISGYANGNTEKTSYQMIGLTDHAETVKVTYDANQISLDKLLKYYFKVIDPTSVNKQGNDRGRQYRTGIYYQDGADKAVIGQALAQLQTKYKKPVQIEVQPLKNYIVAEEYHQDYLKKNPNGYCHIDITKADEPVIDEKDYPKPSDAELKAKLTPLQYSVTQNKHTERSFSNEYWDNFQPGIYVDITTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 13939 - protein, 417 aa, Pseudomonas putida
MFSKQDQIQGYDDALLAAMNAEEQRQEDHIELIASENYTSKRVMQAQGSGLTNKYAEGYPGKRYYGGCEHVDKVEALAIERAKQLFGADYANVQPHSGSSANGAVYLALLQAGDTILGMSLAHGGHLTHGAKVSSSGKLYNAVQYGIDTNTGLIDYDEVERLAVEHKPKMIVAGFSAYSKTLDFPRFRAIADKVGALLFVDMAHVAGLVAAGLYPNPIPFADVVTTTTHKTLRGPRGGLILAKSNEEIEKKLNAAVFPGAQGGPLMHVIAAKAVCFKEALEPGFKAYQQQVIENAQAMAQVFIDRGYDVVSGGTDNHLFLVSLIRQGLTGKDADAALGRAHITVNKNAVPNDPQSPFVTSGLRIGTPAVTTRGFKVAQCVALAGWICDILDNLGDADVEADVAKNVAALCADFPVYR

SEQ ID NO: 13940 - protein, 305 aa, Coccidioides immitis
MQIFVKTLTGKTITLEVESSDTIDNVKTKIQDKEGIPPDQQRLIFAGKQLEDGRTLSDYNIQKESTLHLVLRLRGGMQIFVKTLTGKTITLEVESSDTIDNVKTKIQDKEGIPPDQQRLIFAGKQLEDGRTLSDYNIQKESTLHLVLRLRGGMQIFVKTLTGKTITLEVESSDTIDNVKTKIQDKEGIPPDQQRLIFAGKQLEDGRTLSDYNIQKESTLHLVLRLRGGMQIFVKTLTGKTITLEVESSDTIDNVKTKIQDKEGIPPDQQRLIFAGKQLEDGRTLSDYNIQKESTLHLVLRLRGGN

SEQ ID NO: 13941 - protein, 163 aa, Cucumis sativus
PHGGHLSHGYQTDTKKISAVSIFFETMPYRLDESTGYIDYDQLERSATLFRPKLIVAGASAYARLYDYARIRKVCDKQKAIMLADMAHISGLVAADVIPSPFEYADIVTTTTHKSLRGPRGAMIFFRKGVKEINKQGREVLYDYEDKINQAVFPGLQGGPHNH

SEQ ID NO: 13942 - protein, 243 aa, Aegilops tauschii
ITGIVNGMDVSEWDPTKDKFLAVSYDITTALEGKALNKEALQAEVGLPVDRKVPLVAFIGRLEEQKGPDVMIAAIPEILKEEDVQIVLLGTGKEKFERLLRSIEEKFPSKVRAVVRFNAPLAHQMMAGADVLAVTSRFEPCGLIQLQGMRYGTPCACASTGGLVDTIVEGKTGFHMGRLSCNVVEPADVKKVVTTLKRAGKVVGTPAYHEMVKNCMIQDLSWKGPAKNWEDVLLELGVEGSEP

SEQ ID NO: 13943 - protein, 553 aa, Schizosaccharomyces pombe
MSVDENQLENGQLLSSENEASSPFKESIPSRSSLYLIALTVSLLGVQLTWSVELGYGTPYLFSLGLRKEWTSIIWIAGPLTGILIQPIAGILSDRVNSRIGRRRPFMLCASLLGTFSLFLMGWAPDICLFIFSNEVLMKRVTIVLATISIYLLDVAVNVVMASTRSLIVDSVRSDQQHEANSWAGRMIGVGNVLGYLLGYLPLYRIFSFLNFTQLQVFCVLASISLVLTVTITTIFVSERRFPPVEHEKSVAGEIFEFFTTMRQSITALPFTLKRICFVQFFAYFGWFPFLFYITTYVGILYLRHAPKGHEEDWDMATRQGSFALLLFAIISLAANTALPLLLEDTEDDEEDESSDASNNEYNIQERNDLGNIRTGTNTPRLGNLSETTSFRSENEPSRRRLLPSSRSIMTTISSKVQIKGLTLPILWLSSHVLFGVCMLSTIFLQTSWQAQAMVAICGLSWACTLWIPYSLFSSEIGKLGLRESSGKMIGVHNVFISAPQVLSTIIATIVFIQSEGSHRDIADNSIAWVLRIGGISAFLAAYQCRHLLPINF

SEQ ID NO: 13944 - protein, 256 aa, Aegilops umbellulata
  misc_feature (132)..(132): Xaa can be any naturally occurring amino acid
  misc_feature (141)..(141): Xaa can be any naturally occurring amino acid
  misc_feature (246)..(247): Xaa can be any naturally occurring amino acid
  misc_feature (249)..(249): Xaa can be any naturally occurring amino acid
CELDNIMRLTGITGIVNGMDVSEWDPTKDKFLAANYDITTALEGKALNKEALQAEVGLPVDRKVPLVAFIGRLEEQKGPDVMIAAIPEILKEEDVQIVLLGTGKKKFERLLKSVEEKFPSKVRAVVRFNAPXAHQMMAGAXVLAVTSRFEPCGFIQLQGMRYGTPCACASTGGLVDTIVEGKTGFHMGRLSVDCNVVEPADVKKVVTTLKRAVKVVGTPAYHEMVKNCMIQDLSWKVPAKNWEDVXXEXGVEGSEP

SEQ ID NO: 13945 - protein, 256 aa, Aegilops uniaristata
CELDNIMRLTGITGIVNGMDVSEWDPTKDKFLAANYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPLAHQMMAGADVLAVTSRFEPCGLIQLQGMRYGTPCACASTGGLVDTIVEGKTGIHMGRLSVDCNVVEPADVKKVVTTLKRAVKVVGTPAYHEMVKNCMIQDLSWKGPAKNWEDVLLELGVEGSEP

SEQ ID NO: 13946 - protein, 256 aa, Agropyron cristatum
  misc_feature (186)..(186): Xaa can be any naturally occurring amino acid
CELDNIMRLTGITGIVNGMDVSEWDPTKDKFLSVNYDVTTALEGKALNKEALQAEVGLPVDRKVPLVAFIGRLEEQKGPDVMIAAIPEIVKDVDVQIVLLGTGKKKFERLLKSIEEKFPSKVRAVVRFNAPLAHQMMAGADILAVTSRFEPCGLIQLQGMRYGTPCACASTGGLVDTIVEGKTGFXMGRLSVDCNVVEPADVKKVATTLKRAVKVVGTPAYHEMVKNCMIQDLSWKGPAKNWEDVLLELGVEGSEP

SEQ ID NO: 13947 - protein, 270 aa, Unknown
  Candidatus Desulfococcus oleovorans Hxd3
MTPKTIRAGVVQFDTRLGDIEVNLKSALDGIAGLAAQGADLAVLPELWPCGFDNRHLAAHAAQTPRILEIVSAQAAEHSMVIAGSVPEAGPDGICNTLVVMDRDGREAGRYRKIHLFSAGGEERFFAKGKAWAVCDTAAGKLGLMICYDLRFPELCRVLALDGAACVIVPAQWPEARIDHWNALLKARAIENQLFVVGANRCGHDPSLAYGGGSQVVSPTGEVLALARADAPQVILANLDRAVMENFRKHIPCLQERAPESYQTGPKGKS

SEQ ID NO: 13948 - protein, 494 aa, Paxillus filamentosus
KLQQIYDAEHPRLILKELFAQDPDRFSKFSKEYVDPTDPNTTFLIDYSKNLITQPILDTLLSLASEAELETYRDKMFAGERINTSEDRAVLHVALRNFDDFKIQEKGVEEVASVLAHMKEFSDAIRSGSWKGYTGKTINTIVNIGIGGSDLGPVMVTEALKPYAKRDLTALFVSNIDGTHLAETLRECDPERTLFIIASKTFTTQETITNAESARDWFLSFAKDKAHVAKHFVALSTNTKAVTAFGIDGANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKNGERVDYQTGPIIWGAAGTNGQHSFYQLVHQGTKLIPADFLAPATSHNPIADSKHHRILLSNFFAQPEALAFGKTEEEVRKELGRGASEALVKSKVFEGNRPSNSIMFPLLTPRTLGALISLYEHKIFTQGVIWGINSY

SEQ ID NO: 13949 - protein, 433 aa, Arabidopsis thaliana
MAASVQPACLDLHFSGKHPPLLKHNAIIVRCVSSPNVIPEADSISGPPDIINTNRDQRKVVRIAWEKLVRWSRSLRAKAKTDVLERTRKVVVLGGGSFGTAMAAHVARRKEGLEVNMLVRDSFVCQSINENHHNCDKVDSVASKYFPEHKLPENVIATTDAKAALLDADYCLHAVPVQFSSSFLEGIADYVDPGLPFISLSKGLELNTLRMMSQIIPIALKNPRQPFVALSGPSFALELMNNLPTAMVVASKDKKLANAVQQLLASSVEIAGALKNVLAIAAGIVDGMNLGNNSMAALVSQGCSEIRWLATKVMGAKPTTITGLSGTGDIMLTCFVNLSRNRTVGVRLGSGETLDDILTSMNQVAEGVATAGAVIALAQKYNVKLPVLTAVAKIIDNELTPTKAVLELMNLPQVDYRFHRFPFRLGYSSGIFI

SEQ ID NO: 13950 - protein, 560 aa, Oryza sativa
MAEDAAAAAMAAASLSDDLEPATDRTRIRSILADGAARAGERVVVGGWVKTGREQGKGTFAFLELNDGSCASNLQVLVDAAVHPLAPLTATGTSVLVEGQAQEAAGAAPSSASSSASTASSRLGEVDPAAYPLPKTKLTLENLRDVVHLGSRTNTIGAVARIRHQLACATHRFFDENGFLYVHTPIITTSDCEGAGEMFQVTTLFSHAEKVEKELKENPAPSESDIEAARVVVKEKGDAVAQLKAAKASKQEITAAVAELNKAKENVSRLEERSKLKPGIPYRDDGTVAYENDFFKRQAFLTVSGQLQVETYACALSSVYTFGPTFRAENSHTSRHLAEFWMVEPEIAFANLQDDMNCAERYVQYLCKWLLEHCREDMEFMVKNYDKTAIERLELVSSTPFQRISYTKAVELLKNVTDKKFENKVEWGIDLASEHERYLTEVIFKKPVIVYNYPKEIKAFYMRLNDDQKTVAAMDVLVPKVGELVGGSQREERLDLLKTRIQDAGLPLEPYEWYLDLRRFGSVKHSGFGLGFERMILFATGLENIRDVIPFPRYPGRADL

SEQ ID NO: 13951 - protein, 256 aa, Australopyrum retrofractum
  misc_feature (7)..(7): Xaa can be any naturally occurring amino acid
CELDNIXRLTGITGIVNGMDVSEWDPTKDKFLAVNYDVTTALEGKALNKEALQAEVGLPVDRKVPLVAFIGRLEEQKGPDVLIAAIPEIVKDEDVQIVLLGTGKKKYERLLKSVEEKFPGKVRAVVRFNAPLAHQMMTGADVLTVTSRFEPCGLIQLQGMRYGTPCACASTGGLVDTIVEGKTGFHMGRLSVDCNVVEPTDVKKVATTLKRAVKVVGTPAYHGMVKNCMIQDLSWKGPAKNWEDVLLELGVEGSDP

SEQ ID NO: 13952 - protein, 159 aa, Chromobacterium violaceum
MTTLYDFSAQRADGAEQALSAYEGRVALLVNTASECGYTRQYAGLQELQDYFAGQAFVVLGFPCNQFGGQEPGGEDEIVDFCRSRFGVSFPLFAKLQVNGDGAHPLWRWLTQADSDRPHPIKWNFTKFLVDGRGRVVKRYEPAVEPHELVDDIKALLAR

SEQ ID NO: 13953 - protein, 372 aa, Dechloromonas aromatica
MNPTRLANAKRLVVKVGSALVTNNGTGLDLSAINDWARQIAVLRQQDKEVVLVSSGAIACGMQRLGWAKRPKSVHELQAAAAVGQMGLVQVYEGAFAKHGLHTAQILLTHDDLADRKRYLNARSTLNTLLELGVVPIINENDTVVTDEIKFGDNDTLGALVANLIEADALIILTDQQGLYTADPRKDPSATLINEATAGDETLEGMAGGAGTRIGTGGMITKVIAAKRAARSGAHTAIASGRETDPIIRLANGEPVGTLLVSQTQPLAARKQWLADHLQLAGRLILDAGAVNALHAGKSLLPIGVIAAEGEFERGAAVACISPDGREIARGLSNYGSGEARLIARKTTQEIENTLGYVDEPEIIHRDNLILS

SEQ ID NO: 13954 - protein, 304 aa, Clostridium sticklandii
MIYENIMQTIGKTPIVKLKNLTDENMAELYVKLEFFNPGGSVKDRAALNMIENMEKEGKLKLGDIIVEPTSGNTGIGIAMVGSAKGYKVILCMPETMSIERRKILKAYGAELVLTEGAKGMKGAIAKAEEMAQEDGYIILRQFDNSYNVDAHYKNTAKEIISDLPDLDALVVGVGTGGTLTGVAKAFKESSINAEIVAVEPVDSAVLSGNAPGPHKLQGIGAGFVPSILDTEYISKIEQIQTQEAFNASRLMASKEGILLGISGGAALEAAIRTAKRLGKGKKVCLLLPDNGERYLSTALYGDE

SEQ ID NO: 13955 - protein, 275 aa, Triticum aestivum
NAGQWIVLRLTIGRIGPDLACSPPAMAAGLACSRPSSSVSSRRRRRSRRLPRAAVAMGRRPARCYRQIKNKPYPKSRYCRGVPDPKIRIYDVGMKKKGVDEFSHCVHLVSWEKENVSSEALEAARIACNKYMTKHAGKDAFHLRVRVHPFHVLRINKMLSCAGADRLQTGMRGAFGKPQGVCARVAIGQVLLSVRCKPNNAIHATEALRRAKFKFPGRQKIIESRKWGFTKFNRNDYLKFKSEGRILPDGVNAKLLGCHGRLANRAPGQAFLSAA

SEQ ID NO: 13956 - protein, 615 aa, Bacillus cereus
MCGITGWVDYKRSLEGERDVVTKMAETLAKRGPDDNKVWIKGNVAFGHKRLIVVDPEGGKQPMTCLKGETNYAICYNGELYNTEDIRKELLRRGYTFKGHSDTEVLLASYMEWKEECVDHLNGIYAFAVWDEQKEQVFIARDRLGVKPLFYKYDSGRLLFGSELKAILAHPDVKAEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSIDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQRRYEESIQEVPILEGESPIEAKRRQLFYLNMVWFMTTLLDRKDRMSMGASLEVRVPFADHRLVEYAWNIPWEMKMYKNREKGLLRKALEGLLPNDILYRKKSPYPKTHNPHYTKAVTVWLQDLLTDKGSILHELFDKEQLSGLIESGGSAFQTPWFGQLMTGPQLLAHLAQIHVWFKEYGVNIKE

SEQ ID NO: 13957 - protein, 301 aa, Unknown
  Dehalococcoides sp. BAV1
MVAKVIVNPVAGARSTEQKWPHISRLMRDMGFSYDFQYTESQGHAIEIARTAALNGYPYLVAVGGDGTINEVVNGILTASQDQKTLMGVVDTGTGNDFVRSLGLDGNYLHSCQHLLSSKHTQVDAGLVTFQKDGRKVSRFFVNGAGVGFDAEVAAATEHMPKALGGTIPFVMALAKTLVGYRNKTIDIRLDTDDYTRRVLSVIVANGSYFGGGMKIAPSALITDSRFDVITLGDVNKLEILQTFPKIYKGTHITHPKVKTEHAHFVSISSGEGLYLQADGELLGKTPATFEVLPQALTMVF

SEQ ID NO: 13958 - protein, 239 aa, Schizosaccharomyces pombe
MATSQVLHILPKPSYEHAFNSQRTEFVTTTATNQVELYEQDGNGWKHARTFSDHDKIVTCVDWAPKSNRIVTCSQDRNAYVYEKRPDGTWKQTLVLLRLDRAATFVRWSPNEDKFAVGSGARVISVCYFEQENDWWVSKHLKRPLRSTILSLDWHPNNVLLAAGCADRKAYVLSAYVRDVDAKPEASVWGSRLPFNTVCAEYPSGGWVHAVGFSPSGNALAYAGHDSSVTIGYPSAPEQ

SEQ ID NO: 13959 - protein, 251 aa, Schizosaccharomyces pombe
LTLDPEAFPTHKRGSIALIGSGPGSPDLLTVAARKAIMKADYVLADKLVPEAVLQLIPRHTPLFIARKFPGNADKAQDELHQVALDALSRGDYVVRLEQSDPYIYGRGGEEYLFFTQHGYVPTVIPGISSALMPPISAGIPVTHRGVADQFLVCTGTGQKGSMPKIPSFVPTQTTVFLMALHRLEILVQALIESGWPRVLPVCIAERVSCPDQRFIFSTLEDVVEEYNKYESLPPGLLITGYSCNTLRNTA

SEQ ID NO: 13960 - protein, 295 aa, Chlorobium tepidum
MGSNMVEHLLELGHEVVAFDLSAEAVKAIAAKGATAASSLQHLVGELAAPRVVWMMVPAGRPVDAVIDGLTPFLRAGDIVIDGGNSRYTDSVARAEKLRKQGIRMLDIGTSGGLDGARHGACMMAGGDREAYEHVEPVLRDLCVENGYGYMGASGSGHFVKMVHNGIEYGMMQAIGEGFELLRASGYDLDNQNVARVWSNGSVIRGWLMDLAGKAFAQGNDLGWLGGKVADSGEGRWTVEAAIELGVAVPIISGSLFRRFQSQNEEHFSDKVVAALRHEFGGHAYEKPGEGEGKA

SEQ ID NO: 13961 - protein, 520 aa, Pseudomonas syringae
MLDANLKAQLKSYLERVTRPIEIVASLDDGAKSQEMLALLNDVISVSKDVTLNDSGNDARTPSFSLSSPGHDISLRFAGIPMGHEFTSLVLALLQVGGYPPKVSAETIEQVRALQGEFHFETYFSQSCQNCPDVVQALNLMAVLNPGIKHVAIDGALFQDEVTDRKIMSVPSIYLNGELFGQGRMGLEEILAKIDTGAGARQAEKLNAKQAFDVLVVGGGPAGSAAAVYAARKGIRTGVAAERFGGQVLDTMAIENFISVQHTEGPKLAVALEEHVKQYEVDIMNLQRADKLIPGAAGELHEVKFASGASLKAKTVILATGARWREMNVPGEQQYRNKGVAYCPHCDGPLFKGKRVAVIGGGNSGVEAAIDLAGIVSHVTLLEFDVQLRADAVLQRKLHSLPNVTVITSAQTTEVTGDEQKVNGLRYKNRTTGEEITVPLEGIFVQIGLLPNSEWLKGSIELSPRGEIVVDARGETSVPGIFAAGDVTVTPYKQIIIALGEGAKASLSAFDHLIRTSAPA

SEQ ID NO: 13962 - protein, 493 aa, Methylobacillus flagellatus
MSACNSIACVVMPDPVFRWKWNRMSRMETLPIFMKLRDRPCLVVGGGEIASRKVSLLEKAGASVTVVSPELHPTLAKSLAEGRIRHLASVFEPAQLDGAVLVIAATDDAEVNRAVSREAQARNIPVNVVDAPELCTFIVPSIVDRSPLLVAVSSGGTAPVLARMLRTRIETLIPATYGRLAAFAAEFREAVKQRFSTGQQRRIFWEDVFQGVIGEQVLSGQEEAARHAMQQVLSGRGELHHGEVYLVGGGPGDPDLLTFRALRLMQQADVCVYDKLVSKEVMALVRRDAELIYVGKSRDQHTLPQEDINQLLVRLAKEGKRVLRLKGGDPFIFGRGGEEIETLMENGIPFQVVPGITAANGVSSYAGIPLTHRDYAQSCLFTTGHLKDGSVNLDWDALVRPNQTVVIYMGLVGLPEICRQMVAHGAPENLPIAIVQQGTTQRQRVVEGTLATLPGLVERAGLRAPCLIIVGQVVRLREKLAWFAPSPEVVSAG

SEQ ID NO: 13963 - protein, 54 aa, Arabidopsis thaliana
QIQNCLRFTASASTVYAVPPTLLMKPTLTISDPVLPLPPMTKKNGGARCSMQTK

SEQ ID NO: 13964 - protein, 141 aa, Bacillus cereus
MANYIKELREKVGHDCVLINFAGGCVLNEYGEILLQKRGDFNAWGFPGGAMEIGESAAETAIREIKEETGYDVEINELIGVYTKYFQSYPNGDRAQSILIFFSCSITGGEKKIDGDETLDLKFFPLNKMPPLFNQQHEDCL

SEQ ID NO: 13965 - protein, 567 aa, Vibrio parahaemolyticus
MTKILIVGGVAGGASAAARARRLSEDAEIIMFERGPFVSFANCGLPYHIGGDIQERSKLLLQTPESFLARFNVDVRVMNEVVSINRQDKTVTIKNLLDESEYVESYDFLLLSPGAGPIVPPIPGLDNPLTHSLRNIPDMDRIIETIQMNKPEHATVVGGGFIGLEMMEAFHQLGIKTSLIEMADQVMTPVDREMAGFAHAEIRDKGVDLKLGVALESVKFVPNEHVASFDSGESEKHQHLEGELELTLNNGEKLTTDILIMAIGVRPETKLAQEAGLQIGALGGIYTNEYMQTSDPSIYAVGDAIEEKDFVTGEQTLVPLAGPANRQGRMAADNMLGRKETYQGTQGTAICKIFDLAVASTGKNEKQLKRAGIAYDKVYVHTASHASYYPGAEVVSFKMLFDPQSGKILGAQAVGKDGIDKRIDVMAVAQRAGMTVEQLQHLELTYAPPYGSAKDVINQAAFVANNIIKGDATAIHYDEIDNLTEDQILLDVRNPGELESVGYLEGAINIPVDQLRHRMDELPKDKEIVIYCQVGLRGNVAYRQLVNNGYKARNLIGGYRTYLHSKV

SEQ ID NO: 13966 - protein, 199 aa, Mesorhizobium loti
MAPRSAEASRKTKETDISVSVHVDGSGKSDIATGVGFFDHMLDQLSRHSLIDMTVRAKGDLHIDDHHTVEDTGIALGQALTKALGERRGIMRYASIDLAMDETLTRAAIDVSGRPFLVWNVSFSSPKIGTFDTELVREFFQALAQNAGITLHVTNHYGANNHHIAETCFKAVARALRAALEPDPRQPDAVPSTKGSLKG

SEQ ID NO: 13967 - protein, 700 aa, Oryza sativa
MTEERGCTMSDTEMPFKYSSGKAFPLGVSQVEGGLNFALFSQHASSVILCLKLPGRGTEDEKGADVVEFVLDQQKNKTGDIWHVIVEGLPASGVLYGYRVGGPQGWDQGHRFDSSTVLLDPYAKLVSGRKYFGVAEEKSSQHFGTYDFDSSPFDWGDDYRLPNLPEADLVIYEMNVRAFTADESSGLDSTSRGSYLGLIDKIPHLLELGVNAVELLPVFEYDELEFKRYPNPRDHMVNTWGYSTINFFAPMSRYASAGGGPVAASKELKQMVKELHKAGIEVILDVVYNHTNEADDAHPYMTSFRGIDNKVYYMLDLNKNAELLNFSGCGNTLNCNHPVVKELILDSLRHWVEEYHIDGFRFDLASVLCRGPDGCPLDAPPLIKEIAKDAVLSRCKIIAEPWDCGGLYLVGRFPNWDRWAEWNGKYRDDLRRFIKGDPGMKGVFATRVSGSADLYQVNERKPYHGVNFVIAHDGFTLCDLVSYNLKHNDANGEGGCDGCNDNFSWNCGVEGETNDLNVLSLRSRQMKNFHVALMISQGTPMMLMGDEYGHTRYGNNNSYGHDTCINNFQWEQLEQRRDGHFRFFSEMIKFRHSNPILRRDRFLNKNDVTWHEDCWENQESKFLAFTVHDHNSGGDIYLAFNAHDYFVDAVIPPPPHHKCWNRVVDTNLESPNDIVPEGVPFTGPKYRIAPYSSILLKAKP

SEQ ID NO: 13968 - protein, 850 aa, Bacillus cereus
MIKRLINKSVLLLTIIVMFASVFSIQSVKAVSNSKTTEVIIHYKEQLGNTKDWNLWLWGENANGTSYEFTGEDEFGKYAKINIDGDYNRVGFIIRTNEWEKDGGDRWIENIKDGRAEVWILSGDEKVYNAKPSSDLSIQKATIDSFNEITVTTNVPFHIKEQKIEIEGIKIKNISPYDINSGNVTNKVKIITEQKIDLKQTYKVKIENLADTNTEIGKVIRSEEFDHSFYYGGNDLGNIYTPQHTKFRVWAPTASEAKLVTYKKWNDKIGTEINMQQGEKGTWKAELKGNQEGLYYTYKVKIGDKWTEAVDPYARAASVNGDKGAVVDLEETNPKKWNTNKKPKLKNPEDAIIYELHVRDLSIQPESGIKQKGKYLGVTEKGTRGPEGVKTGLDHMKDLGVTHVQLLPIFDYASVNEENVNEPQYNWGYDPKNFNVPEGSYSTNPYEPTVRITELKQMIQTLHDNNLRVVMDVVYNHMYNATESNFHKLVPGYYYRYNEDGTFANGTGVGNDTASERKMMRKFMIDSITYWAKEYNLDGFRFDLMGIHDYETMNEIRKAVNQIDPSIILHGEGWDLNTPLAAELKANQKNAEKMKGIAHFNDNIRDGLKGSVFEEKENGFVNGKANMEDRIKKGITAGINYDKNTSTYQDPEQVLTYVEAHDNHTLWDKLELTNPSDSEEVRKQMHKLSSSILLTSQGIPFLHAGQEFMRTKYGDHNSYKSPDSINQMDWLRRATFNNEVDYMKGLIELRKKYSAFRMTSAEQIKTHISFIDAPKNTVAYTIEGNKNEYFTVAHNANREAVEITLPSKGPWKVLVDGKQAGSKPLSVVHDNKIKVPALSSFVLKTEKPIK

SEQ ID NO: 13969 - protein, 390 aa, Sulfolobus shibatae
LDTLEALSQPERVIQVKIQIRGSDGKLKTFMGWRSQHNSALGPYKGGVRYSPNVTQDEVIALSMIMTWKNSLLLLPYGGGKGGIRVDPKKLTLKELEDLSRKYVQLIHNYLGSDVDIPAPDINTNPQTMAWFLDEYIKITGEVDFAVFTGKPSELGGIGVRLYSTGLGVATIAREAANKFIGGIEGSRVIIQGFGNVGSFTAKFLNEMGAKIIGVSDIGGGVISDDGIDVNKALEVVQSTGSVVNYPEGKKVTNEELLTSDCDILIPAAVENVINKFNAPKVKAKLIVEGANGPLAADADEIIKQRGIVVIPDILANAGGVVGSYVEWANNKSGGIISDEEAKKLIIDRMTNAFNALYEFHKRKFADQDLRTVAMALRVDRVVGMKARAI

SEQ ID NO: 13970 - protein, 961 aa, Streptomyces avermitilis
MTAHRIPLSDLEQGIPFEQRHIGPDSEARAKMLAQVGYGSLDELTATAVPDVIKNAEALELPGARTEAEVLAELRSLADRNQVLGSMIGLGYYGTFTPPVILRNVMENPAWYTAYTPYQPEISQGRLEALLNFQTVVAELTGLPTSGASLLDEGTAAAEAMALSRRMGKNKKGLFLVDADALPQTIAVIETRAEPTGVEVVVADLSEGIPAGIAEREINGVLIQYPGASGAVRDIKPLVEQAHELGAVVTVAADLLALTLLTSPGELGADIAVGTTQRFGVPMGFGGPHAGYMAVREKFARSLPGRLVGVSVDADGHKAYRLALQTREQHIRREKATSNICTAQVLLAVMAGMYAVYHGPDGLRTIARRTHRYATILAEGLKAGGVEVVHGAYFDTLTARVPGRAAEIVAAAREGGVNLHLVDADLVSISCDETTTRAQLGAVWTAFGVEGDIEALDAAAEDTLPAALLRTDDYLTHPVFHQYRSETAMLRYLRRLSDRDYALDRGMIPLGSCTMKLNATTEMEPVTWPEFGQLHPFAPAEQAQGYLTLIRELEERLAEVTGYDKVSLQPNAGSQGELAGLLAVRGYHRANGDEQRTVCLIPSSAHGTNAASAVMAGMKVVVVKTADDGEIDVEDLRAKIEQYRDELSVLMITYPSTHGVFEEHVADICAQVHEAGGQVYVDGANLNALVGLAKPGHFGGDVSHLNLHKTFCIPHGGGGPGVGPVGVRAHLAPYLPNHPLQPEAGPATGVGPISAAPWGSAGILPISWSYVRLMGGEGLKRATQVAVLSANYIAKRLEPHYPVLYTGPGGLVAHECIIDLRPLTKATGVSVDDIAKRLIDYGFHAPTMSFPVAGTLMIEPTESEDLGELDRFCEAMIAIRAEVEKVGSGEWPAEDNPLRNAPHTAAALGGEWEHAYSREEAVFPAGVSAADKYWPPVRRIDQAFGDRNLVCSCPPLDAYDD

SEQ ID NO: 13971 - protein, 415 aa, Glycine max
KVSSPRWRPPSRDTTSRRPARPGQVGARKSAQDGAWARGATARTGAAGRGAKAGATGRVNSGTRASTTTGKKGGAASSGKASKTDTAAAAVTNGDAEDGKSKKLQYEGPDPELAAMLERDVLETSPGVRWDDVAGLTEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCNARGASGEHESSRRVKSELLVQLDGVNNSSTNEDGTRKIVMVLAATNFPWDIDEALRRRLEKRIYIPLPNFESRKELIRINLKTVEVAPDVNIDEVARRTEGYSGDDLTNVCRDASLNGMRRKIAGKTRDEIKNMSKDDISKDPVAKCDFEEALRKVQRSVSQADIERHEKWFTEFGSA

SEQ ID NO: 13972 - protein, 119 aa, Arabidopsis thaliana
  misc_feature (72)..(72): Xaa can be any naturally occurring amino acid
MFSSMPSAVVEETSPAQASGVTPYTGGKSFAANPVTRKTNKDITTIASNGGRGSCMKVRPPIGKKKLETISXSPDLSDVQLAEEGDHTLRNKGIPCGEFRLEHPFEYPEHGNHSGYHQG

SEQ ID NO: 13973 - protein, 193 aa, Mycobacterium smegmatis
MDVAVESTEMYPGDIKSVLLSEEQIRTRTAELAAAIADQYRDNLGDDDLLLVTVLKGAVMFVTDLARSIPLPTQLEFMAVSSYGSSTSSSGVVRILKDLDRDINDRDVLIVEDIIDSGLTLSWLLRNLATRHPRSLKVCTLLRKPEAVRTDIDVEYVGFDIPNEFVVGYGLDYAERYRDLPFIGLLDPKVYTH

SEQ ID NO: 13974 - protein, 280 aa, Hibiscus grandiflorus
GLPPAMAAKGHRVMTVSPRYDQYKDAWDTSVVVELKVGDKVETVRFFHCYKRGVDRVFVDHPMFFEKVWGKTASKIYGPRAGVDYKDNQLRFSLLCQAALLAPRVLNLNSSKYFSGPYGENVVFIANDWHTALLPCYLKSMYQSRGIYMSAKVVFCIHNISYQGRFAFADFSLLNLPDRFKSSFDFIDGYNKPVKGRKINWMKAGILESDRAMTVSPYYAQELVSGEDKGVELDNFIRKTGITGIVNGMDVQEWNPATDKYTCVKYDATTVMDAKPLLKE

SEQ ID NO: 13975 - protein, 103 aa, Rubrobacter xylanophilus
MAVKDVTDDTFKSEVLDSDKPVIVDFWAPWCAPCRRVAPVLEELSESRDDVKFVKLNVDDNQNTTLNYSVTSIPTIARFENGQVTRRAVGALPKQQLMEQLDL

SEQ ID NO: 13976 - protein, 280 aa, Hibiscus grandiflorus
GLPPAMAAKGHRVMTVSPRYDQYKDAWDTSVVVELKVGDKVETVRFFHCYKRGVDRVFVDHPMFLEKVWGKTASKIYGPRAGVDYKDNQLRFSLLCQAALLAPRVLNLNSSKYFSGPYGENVVFIANDWHTALLPCYLKSMYQSRGIYMSAKVVFCIHNISYQGRFAFADFSLLNLPDRFKSSFDFIDGYNKPVKGRKINWMKAGILESDRVMTVSPYYAQELVSGEDKGVELDNFIRKTGITGIVNGMDVQEWNPATDKYTCVKYDATTVMDAKPLLKE

SEQ ID NO: 13977 - protein, 377 aa, Arabidopsis thaliana
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSERMRKSLAFFLCPKKDRVVTPPRELLDSITSRRYPDFTWSMFLEFTQKHYRADMNTLQAFSDWLTKPI

SEQ ID NO: 13978 - protein, 260 aa, Archaeoglobus fulgidus
MPLKFTEVMEAEITKAIVETASEEWVEYAESDVIVVGAGPSGLTAARYLAEKGLKTLVLERRLSFGGGIGGGGMLFHKVVVEREAKDILDDFGIRYTEHRNFLVADSAEFMAKLAAKAIDAGAKIIHGVSVEDVIFRDDPLGVRGVCIQWSAVEISGLHVDPLFLRSRAVVDATGHDAEVISVAARKIPLEVSVVGERSAYSEVAEREIVEKTGKIVKGLYAAGMAVAAVHNLPRMGPIFGGMLLSGKKVAEIVAEDLKL

SEQ ID NO: 13979 - protein, 256 aa, Critesion californicum
  misc_feature (142)..(142): Xaa can be any naturally occurring amino acid
CELDNIMRLTGITGIVNGMDVSEWDPTKDKFLAVNYDITTALEAKALNKEALQAEVGLPVDRKVPLVAFIGRLEEQKGPDVMVAAIPEIVKEEDVQIVLLGTGKKKFERLLKSVEEKFPGKVRAVVRFNAPLAHQMMAGADXLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEP

SEQ ID NO: 13980 - protein, 276 aa, Hibiscus grandiflorus
AMAAKGHRVMTVSPRYDQYKDAWDTSVVVELKVGDKVETVRFFHCYKRGVDRVFVDHPMFLEKVWGKTASKIYGPRAGVDYKDNQLRFSLLCQAALLAPRVLNLNSSKYFSGPYGENVVFIANDWHTALLPCYLKSMYQSRGIYMSAKVVFCIHNISYQGRFAFADFSLLNLPDRFKSSFDFIDGYNKPVKGRKINWMKAGILESDRVMTVSPYYAQELVSGEDKGVELDNFIRKTGITGIVNGMDVQEWNPATDKYTCVKYDATTVMDAKPLLKE

SEQ ID NO: 13981 - protein, 352 aa, Ischaemum koleostachys
NIYDLKADDKTKNWKKLVNVAVSGAAGMISNHLLFKLASGEVFGQDQPIALKLLGSERSFQALEGVAMELEDSLYPLLREVSIGIDPYEVFEEADWALLIGAKPRGPGMERAALLDINGQIFADQGKALNAVASRDVKVLVVGNPCNTNALICLKNAPNIPAKNFHALTRLDENRAKCQLALKAGVFYDKVSNVTIWGNHSTTQVPDFLNAKIDGKPVKDVIKDTKWLEEEFTMTVQKRGGVLIQKWGRSSAASTAVSIADAIKSLVVPTPEGDWFSTGVYTTGNPYGIAEDIVFSMPCRSKGDGDYELATDVSMDDFLWERIKKSEAELLAEKKCVAHLTGEGNAFCDLPN

SEQ ID NO: 13982 - protein, 256 aa, Dasypyrum villosum
  misc_feature (156)..(156): Xaa can be any naturally occurring amino acid
CELDNIMRLTGITGIVNGMDVSEWDPTKDKFLTVNYDITTALEGKALNKEALQAEVGLPVDRKVPLVAFIGRLEEQKGPDVMIAAIPEILKDEDVQIVLLGTGKKKFERLLKSVEEKFPGKVRAVVRFNAPLAHQMMAGADVLAVTSRFEPCGLIXLQGMRYGTPCACASTGGLVDTIVEGKTGFHMGRLSVDCNVVEPADVKKVVTTLKRAVKVVGTPAYQEMVKNCMIQDLSWKAPAKNWEDVLLELGVEGSER

SEQ ID NO: 13983 - protein, 468 aa, Crocosphaera watsonii
MPTWSQALAKPAEEFPLKPLPILSGEIPDGLRGTLYRNGPGRLERGSQKVGHWFDGDGAILAIHLREAGAEATYRYVQTEGYQKEAEANEFLYPNYGMTVPGPFWKTWGKDVKNAANTSVLALPDKLLALWEGGNPHALDLDDLATKGLDNLDNLSEKQSFSAHPKIDHKTANIYNFGVSLGAKVTLHLYQSDTTGKVIKKSDYPLDGLRIVHDFVLAGSYIIFFVPPIRVKLLPAALGLASLSEAMEWKPELGTEILIFDRDSLSFISKAKADPWFQWHYSNGCVNQEGNILVEFVRYPDFSTNQNLKEVATGKTKTPVKGTLWEVEIEPKTATVIRQEQLLDRGSDFPIVPSHQTGQKWRYTYLSVHRDNADLSQEILGAIARYDRQLKKITVADMGENRYPSEPIFVPNIPNSEQGWVLTVVYDGNNHSSELRIYDSEALESSPLCRLGLPNVIPIGFHGTWKQG

SEQ ID NO: 13984 - protein, 222 aa, Pseudomonas putida
MVLRSEILVNKNVMPTAEQALPGRDTPMSLPEFHYVFKDTPLLGPFFEGAIDFAIFGLGCFWGAERRFWQREGVVSTVVGYAGGFTPHPTYEEVCSGLTGHTEVVLVVFDKDKVSYRELLAMFWELHNPTQGMRQGNDIGTQYRSAIYCTSPEQLEQAKASRDAFQAELSKAGFGEITTEIDQAPTVYFAEAYHQQYLAKNPDGYCGIGGTGVCLPPSLQGN

SEQ ID NO: 13985 - protein, 419 aa, Oplismenus compositus
PAGSRLVLTPLGASAARRRSVHLLRPRRPPLAAVRCSVDTTKQVQDGAATVAAEAPASRKECFGVFCTTYDLKADDKTRSWKKLVNIAVSGAAGMISNHLLFKLASGEVFGQDQPIALKLLGSERSLQALEGVAMELEDSLYPLLREVNIGIDPYEVFEDADWALLIGAKPRGPGMERAALLDINGQIFADQGKALNAVASRDVKVIVIGDPCNTNALICLKNAPNIPAKNFHALTRLDENRAKCQLALKAGVFYDKVSNMTIWGNHSTTQVPDFLNAKINGRPVKEVIKDTKWLEEEFTMTVQKRGGVLIQKWGRSSAASTAVSIVDAIRSLVTPTPEGDWFSSGVYTTGNPYGIAEDIVFSMPCRSKGDGDYELVSDVLMDDFLWERIKKSEAELLAEKKCVAHLTGEGNAYCDLPE

SEQ ID NO: 13986 - protein, 446 aa, Xanthobacter autotrophicus
MRYLPLTPEDRAEMLARIGVASVDELFVDIPADKRETALPRLALHKSELEVERTLARLAGQNVPAGSVPFFVGAGAYRHHVPATVDHLIQRSEFLTSYTPYQPEIAQGTLQYLFEFQTQVAELTAMEVANASMYDGSTAAAEAVLMAHRVTRRRKAVLAGNLHPHYRSTIETVSRYAADEVVALPPAPFGEEDLITPIDDTVSCVVVQSPDVFGNLVDLKPIAEAAHKAGALLVAVFTEAVALGLIEPPGAQGADIVVGEGQSIGNALNFGGPYVGLFATRQKFVRQMPGRLAGETVDAEGRRGFVLTLSTREQHIRREKATSNICTNSGLCALAFTIHMSLLGKTGLTRLARANHAAACDLADRLAAVKGASVVNDTFFNEFTLRVPGPAADVVEKLAAKGILAGVPYSRLAPKSGLDDLILVAATETTTEDDRAAYAAALKEVL

SEQ ID NO: 13987 - protein, 255 aa, Eremopyrum bonaepartis
  misc_feature (247)..(247): Xaa can be any naturally occurring amino acid
  misc_feature (249)..(249): Xaa can be any naturally occurring amino acid
  misc_feature (254)..(254): Xaa can be any naturally occurring amino acid
CELDNIMRLTGITGIVNGMDVSEWDPTKDKFLAVNYDVTTALEGKALNKEALQAEVGLPVDRKVPLVAFIGRLEEQKGPDVMIAAIPEIVQEEDVQIILLGTGKKKFERLLKSAEERFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYHEMVKNCMIQDLSWKGPAKNWEDVLXEXGVEGXE

SEQ ID NO: 13988 - protein, 523 aa, Xanthobacter autotrophicus
MNREGRGATTPHSIALTGPQTFTGNRALDLEEGLIFEIGRTEVTGVDIPEPAPFRERLGTQARTAPLDLPGLSEPEAMRHYVRLSRMNYGIDSGLFPLGSCTMKHNPRLNEKMARLPGFADIHPLQPQSTVKGALGLMAELSRYLLELTGMQAVALTPKAGAHGELCGMMAIKAAHAARGDGATRHVVLVPESAHGTNPATAALIGYQVRSIPARADGTVDPEAVKSALGPEVAALMLTNPNTCGLFERDVVAIAEAVHGAGAYFYSDGANFNAILGKVRIADLGVDAMHINLHKTFSTPHGGGGPGAGPVVLSDALAPFAPVPALVATADGLALVEDEGAEGAQQALGRMSAFHGQMGMFVRALAWMLSHGADGMRQASEDAVLSANYIRASLMDLMSAPFAERPAMHEALFDDAWLAGTGLTTLDVAKALIDEGYHPMTVYFPLVVHGAMLIEPTESESKASLDLFIAALRDLAMAAKAGDKERFLGAPYYAPRRRLDETRAARAPVLRWVKPAPVADAAE

SEQ ID NO: 13989 - protein, 387 aa, Methanococcus maripaludis
MAVTLKEGVYWVGAIDWNIREFHGYETKDGSSYNSYLIEDEKIVLIDTVKKYLFDEFYGRIKKVVDPEKIDYIVVNHVEMDHSSSLEKIMEISKAKIITNQKAKEHLELHYNTKDWEYIIVDSGDSVNIGKRNLTFVKTPMLHWPDNMVTYSPEDKILFSNDAFGQHIASSERFDFEIDYTLDSAKEYFANILLPYRTLIPNAVKTVDTLETDLICPSHGIIWKENISKIKEKYLEFASNNVINKAVIVYDTMYSSTEKIGLAIAEGLIESGVEVKVFKISKTPVSKIIAEILDAKYVLVGSPTLNINLYPEVARFLKYMEGLKPNKKIAAAFGSYGWAENATKHIKNTFDILSFDTVDDECLTCRFVPNEEHLKKCQEFGKKLAKM

SEQ ID NO: 13990 - protein, 423 aa, Panicum maximum
PAGSRLATAPLAAGAARRASVQRLRPRRPLIATVRCSVDAAKQVQDGAATVAADPPVRHKTGRLPRYGVFCPTYDLTADDKTKSWKKLVTIAVSGAAGMIANHLLFQLASGEVFGPDQPVALKLLGSERSLQALEGVAMELEDSLYPLLREVSIGIDAYEVFEDADWALLIGAKPRGPGMERAALLDINGQIFADQGKALNAVASPNVKVIVVGNPCNTNALICIKNAPNIPAKNFHALTRLDENRAKCQLALKAGVFYDKISNMTIWGNHSTTQVPDFLNAKIDGRLVKEVIKDTKWLEEEFTLTVQNRGGVLIQKWGRSSAASTSVSIVDAIKSLVTPTPEGDWFSSGVYTTGNPYGIAEDIVFSMPCRSKGDGDYELATDVLMDDFLWERIKKSEAELLAEKKCVGHLIGEGIAFCDIKE

SEQ ID NO: 13991 - protein, 150 aa, Unknown
  Candidatus Desulfococcus oleovorans Hxd3
MTDQAVIVPCSRCGAKNRVRTDPAGKMPVCGKCRAPLVAGKALSVPITVFDRTFQDEVLSSAVPVLVDFWAPWCGPCKMVGPMLERLAAKYAGRVKIAKLNVDENPATASRYAVSSIPTLLFFKQGRVAQTLVGAVPESRIEDQIRALLA

SEQ ID NO: 13992 - protein, 255 aa, Henrardia persica
ELDNIMRLTGITGIVNGMDVTEWDPTKDKFLAVNYDVTTALEGKALNKEALQAEVGLPVDRKVPLVAFIGRLEEQKGPDVMIAAIPEIVKEEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYHEMVKNCMIQDLSWKGPAKNWEDVLLELGVEGSEP

SEQ ID NO: 13993 - protein, 1267 aa, Cryptococcus neoformans
MPTSKSSIDHRDVYYRKGKSAGYRARSAYKLLHLDEEFDLFTNVHTAVDLCAAPGSWSQVLGQKLKPKSKQGGEGTRVVSCDLQPMAPLPNITTLQTDITLPSTIPLVLDALGGRKADLVVCDGAPDVTGVHDLDAYLHSQLLLAALTLSLTLMAPGATLIFKIFLSPLDPRAEFLASQLRCFFSSPLPEDKEKEDEFGQYAEFEEEGEYAEEAGQDKGDEKKRNVGTKGYDPQGRRGGVWVRKPRSSRQGSAEAFIVCRNFSPSSLPLPPTFSPSALDKLRTTTGTLTLDSLSSLVPQDESKGEEIQGFKGSEEQVKQQWHRWEMIKGYVGGGDFTDFRSSSSFIPSLYPLLPPSLPAQSPKMTLSSPPKLHLPMPTTPPNLVHHILKTPEIISPHSSTASPKALQPQPTPVDEPPEYFSPKRAHIQALFLSPTKMKEHRQGQGQGQGQGQGQDGGGTSRQSSLDSLTPNPSPVGDVDSTRPWTSSSPPSSSMSASPPTPVPPTITAPPQEKTSLSIPLLLHSASTSSAVSDGGYGIHGVHGVHSVHSVHSSRPQTPATLGVITPALASPALSSSSKTDLFFSASSAELPTPPRALSPASALDKGPFSSSSAASSGLDVSGNERAQSTTMPSSSFPSTATSGAASWSGSGISTVKLRLPTRKERFRETVIPAEMKDEMDIDRSREGWGAPFGMGLGAGFEEISTSRLRSLSNPIAPPPAHTVPPAPPAPLPAPLPSSFTTQNSSNDGDSRPEFARQSSLTPTVVSPQTPRAGFFPLNNARTKANAVPSVPFHPSPSAGGYTPPPWKLRRKESQQLEREHRQAGVDESVKAGDVIEPCFPNTNADNNGEHEKEKRKERVIGGWRLVKKMGEGAFSAVWSAVPAGSTPLSSTPTHAPTATSLLVALKLLTHPLPDHRTRIAFLREASVLRHISHPSIVGYIDDFSTERHDVLVLEAAGGGELFELMSEEENRRRMILPAPAPVAGSEESEMGWDKDGEGFVRRVFSELVKAVGWLHEVGVVHRDIKLENILFTTNPFILPPTSTSSIPLHLLPPPGQPLIKLTDFGLSRFISPASPLLYTRCGSESFAAPEIIMGKPYDGRETDAWALGVVLYGLIIGELPFDREESIKLPDGIATPGGGNSERVRGRKKMHRIAKGEYTWPSPEPALSQDIPGAYVPGTATPSARAVISSLLERSPSKRAKPSDLWEYEWMLGPGGVPRPVEGAGTPQQEGVGKDKGREASGRGRRRVLDGFLVEEERIEDVAMTEH

SEQ ID NO: 13994 - protein, 161 aa, Paxillus involutus
VVLIGDSGVGKSNLLSRFTRNEFNLDSKSTIGVEFATRSINVDSKTVKAQIWDTAGQERYRAITSAYYRGAVGALLVYDISKHATYVNVTRWLKELRDHADSNIVIMLVGNKSDLKHLRAVPTEEAKNFSAENELSFIETSALDASNVESAFQTILTDVYR

SEQ ID NO: 13995 - protein, 351 aa, Paspalum paniculatum
TTYDLKADDKTRSWKKLVNIAVSGAAGMISNHLLFKLASGEVLGQDQPIALKLLGSERSLQALEGVAMELEDSLYPLLRQVSIGIDPYEVFEDVDWALLIGAKPRGPGMERAALLDINGQIFADQGKALNAVASPNVKVIVVGNPCNTNALICLKNAPRIPAKNFHALTRLDENRAKCQLALKAGVFYDKVSNMTIWGNHSTTQVPDFLNAKIDGRPVKEVIKDTKWLEEEFTGTVQKRGGVLIQKWGRSSAASTAVSIVDAMRSLVTPTPEGDWFSSGVYTTGNPYGIAGDIVFSMPCRSKGDGDYELATDVLMDDFLWERIKKSEAELLAEKKCVAHLTGEGNAFCDLP

SEQ ID NO: 13996 - protein, 254 aa, Heteranthelium piliferum
CELDNIMRLTGITGIVNGMDVSEWDPVKDKFLTVNYDVTTALEGKALNKEALQAEVGLPVDRKVPLVAFIGRLEEQKGPDVMIAAIPEILEEDVQIVLLGTGKKKFERLLKSIEEKFPSKVRAVVRFNAPLAHQMMAGADVLAVTSRFEPCGLIQLQGMRYGTPCACASTGGLVDTIVEGKTRFHMGRLSVDCNVVEPADVKKVTTTLKRAVKVVGTPAYHEMVKNCMIQDLSWKGPAKNWEDVLLDMGVEGSE

SEQ ID NO: 13997 - protein, 205 aa, Chromobacterium violaceum
MARSKSSNNWLQEHVNDQYVHMAQKDGYRARAAYKLLEINDKDKLIRPGTVLADLGSTPGSWSQVAARIVGEKGKVFALDILDMDPVPGVDFIQGDFREEAVLREFEQLLDGRALDLVISDMAPNMSGMSAIDQARSFLLCELALEFARDHLKPGGHFLVKVFQGSDFQPYLKAMRELFDEVVTRKPKASRDRSSEIYLLGKGRR

SEQ ID NO: 13998 - protein, 413 aa, Pogonatherum paniceum
PVGSGLAPAPLGATGAVHRRSAQLHRPRRALLATVRCDAAKDGVATAEAPATRKDCFGVFCTTYDLKAEDKTKSWKKLVNIAVSGAAGMISNHLLFKLASGEVFGQDQPIALKLLGSERSFTALEGVAMELEDSLYPLLREVSIGIDPYEVFQDVDWALLIGAKPRGPGMERAALLDINGQIFADQGKALNAVASKNVKVLVVGNPCNTNALICLKNAPSIPAKNFHALTRLDENRAKCQIALKAGVFYDKVSNVTIWGNHSTTQVPDFLNAKIDGRPVKEVIKDTKWLEEEFTITVQKRGGVLIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAFCDLPV

SEQ ID NO: 13999 - protein, 448 aa, Streptococcus thermophilus
MSKQLVSIIDVPKHIGEEITIGAWVANKSGKGKIAFLQLRDGTAFFQGVAFKPNFIEKFGEEEGLEKFDTIKHLSQETSIYVTGMVKEDERSKFGYELDITDIEVIGKSQDYPITPKEHGTDFLMDNRHLWLRSRKQMAIQQIRNAIIYATYDFFDKNGFIKFDSPILSSNAAEDSTELFETDYFGTPAFLSQSGQLYLEAGAMALGRVFDFGPVFRAEKSKTRRHLTEFWMMDAEYSFLSHDESLDLQEAYVKALIQGAIDRAPQALEILERDVDLLKKYIAEPFKRVSYDEAIDLLQAHENDEDTDYEHLEHGDDFGSPHETWISNYFGVPTFVVNYPASFKAFYMKPVPGNPERVLCADLLAPEGYGEIIGGSMREDDYDALVAKMEELGMDRSEYEFYLDLRKYGSVPHGGFGIGIERMVTFVAGTKHIREAIPFPRMLHRIKP

SEQ ID NO: 14000 - protein, 113 aa, Dasypyrum breviaristatum
MTEKKNRREKKNPREAKVTFEGLVTEALPNGMFRVRLENDTIILGYISGKIRSGSIRILMGDRVKIEVSRYDSSKGRIIYRLPHKDSKRIEDSKDSEDLKDSEDLKDTKDSKD

SEQ ID NO: 14001 - protein, 557 aa, Arabidopsis thaliana
MASLALSGSCSLAFPLKSRSLSLPRPPSSSLNLTKPLRSLDSRFSLLKSPLPVSLRRRSSTLVKASSTVASASSSPTPPLVPAPVPWQGAAIKPLLASIATGLILWFVPVPEGVTRNAWQLLAIFLATIVGIITQPLPLGAVALMGLGASVLTKTLTFAAAFSAFGDPIPWLIALAFFFARGFIKTGLGNRVAYQFVRLFGSSSLGLGYSLVFSEALLAPAIPSVSARAGGIFLPLVKSLCVACGSNVGDGTEHRLGSWLMLTCFQTSVISSSMFLTAMAANPLSANLAFNTIKQTIGWTDWAKAAIVPGLVSLIVVPFLLYLIYPPTVKSSPDAPKLAQEKLDKMGPMSKNELIMAATLFLTVGLWIFGAKLGVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLAKWWGYGFLISIVNILIWLGVGGAWWKFIGLW

SEQ ID NO: 14002 - protein, 361 aa, Sinorhizobium meliloti
MKALVENLKATARETDATDIRAAFAADPNRFSRFSTAFDDLLFDYSKCAVNDRIIDGLEALAKAAKVEEKRDAMFRGDIINITEERAVLHTALRNRSNRPVLVDGKDVMPDVNAVLEAMGKFADDIRSGALKGATGKKITDVVNIGIGGSDLGPVMATLALAPFHDGPRLHFVSNVDGAHIADTLTLLDPETSLFIVASKTFTTIETMTNAATARAFIAGKLGEAAVGHHFAAVSTALDKVGAFGIDAARVFGFWDWVGGRYSIWSAIGLPLMIAIGKENFGRFLDGGHAIDEHFRSAPLRQNIPMLLGLIGFYNRNVLGYPSRAILPYDQRLTRFPAYLQQLDMESNGKGVTLDSQPVEF

SEQ ID NO: 14003 - protein, 476 aa, Unknown
  Candidatus Kuenenia stuttgartiensis
MLEIMKETKFDYGMIGLGTMGCNLVYNMSDNGYTVIGFDKNRSQVETLKKEAGTEKISATSDLNEFLNTLKTPKVIIMLVPAGKIVDDVISELKPFLSKNDLLMDFGNSHFTDTNRRSEQLEESAIHFMGVGISGGELGARHGPSIMPGGPKKVYERVAEMLKAVSAKANNEPCVTWLGPGSAGHYVKMVHNGIEYGLMQLIAEAYHLLKECAAMSNDELHTVFSKWNEGELQSYLIEITADIFMQKDELTDSRIIDRILDSAKQKGTGAWTSEDAMNLQVPIPVIDIAVSMRDLSAYKNEREVAHQNMGGSEVKFTGDKNDLVKWVEQALYFSIITVYVQGMALLQVASKKYKYDLKLEDIAAIWRGGCIIRAALLEDIRSAFSKQPDLSNLILSVAFSKKLMQSQEGIRKVIQTGVGFGIPVPAMMGALAYFDSYRSGWLPANLIQAQRDDFGAHTYERNDREGIFHTHWNQKK

SEQ ID NO: 14004 - protein, 140 aa, Brassica napus
  misc_feature (11)..(12): Xaa can be any naturally occurring amino acid
  misc_feature (28)..(28): Xaa can be any naturally occurring amino acid
  misc_feature (32)..(32): Xaa can be any naturally occurring amino acid
  misc_feature (35)..(35): Xaa can be any naturally occurring amino acid
  misc_feature (39)..(39): Xaa can be any naturally occurring amino acid
  misc_feature (46)..(47): Xaa can be any naturally occurring amino acid
  misc_feature (52)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (64)..(64): Xaa can be any naturally occurring amino acid
  misc_feature (72)..(72): Xaa can be any naturally occurring amino acid
  misc_feature (75)..(75): Xaa can be any naturally occurring amino acid
  misc_feature (78)..(78): Xaa can be any naturally occurring amino acid
  misc_feature (81)..(82): Xaa can be any naturally occurring amino acid
  misc_feature (85)..(85): Xaa can be any naturally occurring amino acid
  misc_feature (87)..(87): Xaa can be any naturally occurring amino acid
  misc_feature (90)..(91): Xaa can be any naturally occurring amino acid
  misc_feature (93)..(93): Xaa can be any naturally occurring amino acid
  misc_feature (97)..(98): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(109): Xaa can be any naturally occurring amino acid
  misc_feature (111)..(111): Xaa can be any naturally occurring amino acid
  misc_feature (113)..(113): Xaa can be any naturally occurring amino acid
MASSMLSSAAXXTSPAQGTMVAPFTGLXSSAXFPXTRKXNNDITFXXSNGRXVXCMKXXXPVGXKKIENLSXLSXLTXMNXXKGXDXPFXXKXVSCXXIQMXHGXFXXXGXGXTPPILIGVLKGNFLGRADGGQKGKTKF

SEQ ID NO: 14005 - protein, 469 aa, Streptococcus pyogenes
MVSVMWFRRDLRIDDQKALAHVIASQSPTLCVFQFNKEQLNLLHSRNQSSFITSVLAFRKLLKCEGIDLYLMYGDLMTCFEQLLTQLKDWTDVYFNYDESGYGRLRDQKAAQFFKKNGIAVHTYQDHYLHGSQEIINQSGQPYKVFTPYYRIWQNYPKETPIKVELSQGRWLNLETPDDVLRTVESFKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQQLIDYDAASNIGGWQWAASTGTDAVPYFRIFNPVTQGKRFDPKGEFIKAYLPQLEHVPEKYLHEPWKMPKNLQESVSCIIGTDYPQPIVDHAKQREQAIAKYEWAKEKAKIE

SEQ ID NO: 14006 - protein, 288 aa, Prochlorococcus marinus
MNYKLKTRSGWLDEYHQGVRYGLEGKLILEESSPFQKITIYESKRYGKALLLDDCWMTAEKSEKCYHECLIHPALCCSTRIDNILIIGGGDGGSARECLKYKEVKSIDLVEIDLRVIELSQKYLPTIGGNAWSDSRLNLQIKNGIDWVKHTKENSYDVIIIDGADPIGPSKELFSNSFLKDCKRILKPGGVLATQSESPESFQEIHINIVKILREIFDYADPMYGSVSIYPSGLWSWAFASMENPKYIYPKKSRVKEISENCQVWSERWQQGAFNTIPAFIERELAKI

SEQ ID NO: 14007 - protein, 317 aa, Mycobacterium tuberculosis
MAKDLVATVPDLSGKLAIITGANSGLGFGLARRLSAAGADVIMAIRNRAKGEAAVEEIRTAVPDAKLTIKALDLSSLASVAALGEQLMADGRPIDLLINNAGVMTPPERVTTADGFELQFGSNHLGHFALTAHLLPLLRAAQRARVVSLSSLAARRGRIHFDDLQFERSYAPMTAYGQSKLAVLMFARELDRRSRAAGWGIISNAAHPGLTKTNLQIAGPSHGRDKPALMERLYKTSWRFAPFLWQEIEEGILPALYAAATPQADGGAFYGPRGRYEVAGGGVREAKVPAAARNDADSKRLWEVSEQLTGVSYPKSR

SEQ ID NO: 14008 - protein, 392 aa, Triticum aestivum
  misc_feature (167)..(167): Xaa can be any naturally occurring amino acid
  misc_feature (355)..(355): Xaa can be any naturally occurring amino acid
MVHRGPRLRAEPAPISATNLSCIKPRGLRLPPPPTSSRTSSSGRHFVQLQLREDHLAVESLVDGGMGEASSPAIAKDVTELIGNTPLVYLNKVTDGCVGRVAAKLESMEPCSSVKDRIGYSMITDAEEKGFIVPGKSVLIEPTSGNTGIGLAFMAAAKGYRLVLTMXPASMSMERRIILKAFGAELILTDPLLGMKGAVQKAEELAAKTPNSYILQQFENAANPKIHYETTGPEIWKGTGGKIDGLVSGIGTGGTITGTGKYLQEQNPNIKLYGVEPTESAILNGGKPGPHKIQGIGAGFIPGVLDVDIIDETIQVSSDESIEMAKSLALKEGLLVGISSGAAAAAAIKVAQRPXENAGKLFVVVFPSFGERYLSSVLFHSIKKEAESMVVE

SEQ ID NO: 14009 - protein, 157 aa, Lactococcus lactis
MNFYDFSAFKMNGETVSMSDFKGKVVIVVNTASKCGFTPQFEGLEKLYENYKDQGLEILGFPCNQFVNQDAGENSEINEFCQLNYGVTFPMFQKIKVNGKEAHPLYQFLKKEAKGALSGTIKWNFTKFLIDREGNVIERFAPKTEPKEMEEEIQKLL

SEQ ID NO: 14010 - protein, 1483 aa, Ashbya gossypii
MRARSEGPGRNLSPRTGVPRSPAVVSSQGILRSPSLKSGASPMSTLGLGWKHGQQSPTGHVAQYLSPLSADSSSAPSRKTSITGLSTLRGGSPSRKPRSNSVSSNFKMAEDAENNTPTLVLPPSLASLNSQSTLSTVYTGNPAAAANPEASSSSSKSGNSATSSLRSGYKPMKRQYVLNEQLYLSRMKNSHLDDYYTRGIAPTMNDDEEDDTDLDTPDVNIDNDDQAFGSNVFTFHDRETSRSVDNELVMLSTKHLLGKMNWLRELDPGNPDIEAPLEFLARAENVSINSATPQDNRQDIEGMLGKLSRNPLVQERLEWQTMLWNVLRGDIVNSEKTKLAEQRTTDELTTQFSDELWLELKSWLYGRSVEDQRTWLQYLRASTDSIFERIIEFRLEDDIEIPDAVVKVESLLNEYYKVIPYWKNCQQMYKEKPITNSDDFKLRIETLNTYVVMYAAFKTEITALHQWIGNDDPEAEGAAGGIEDIKCAEKPIAEQVLKEKDIETIFQNKIFYRHGPWVFKAKLAAIEYGDYFNLMNLPSLNGYLTTLITFPMKLIKEIILIRLNYARKLQKPTMMMIDQMIDDFKSYIKLAVQIIYTINLYCSNKELQLGNVIDDTFDKTVNDAISYFFKLLNLKLVDSTKKSFKNFKEPEALFSHWEDLKNVGCHIDGANEVVPTGFVSLTLRLLNKLHAYILKEQNSVTEKVSKAECEKWIMVTLENIGLFKRKMNRFSNVLTKALQNSANYRINDIRLLLQNLKDTGHFLIYTGGYLEDSGTYLFASKELLGYSGTDILRIVKGMEVGSDLIPEVSITNSLSVYTAIEQGVCSDPIFVQEERPDGLSYYHVQSECNKRHIGKSRGKIIHSYDSFYGSETEGSELYELERKLKSLGYLVAVCPDEPILWEGEMYNLSYEKQLNAEDFPVNITPGMLTLMAQGSTYSMEYQCDKFQHFAGNSVVFTEKRCSIVPAEQTLQKINKAYFRITYHTLAHHHKLVSTIQRKFRGFESLNTVFIFCRDFAKNFLRSNVASYETKSVIIMQMLKVSIGWLTFLIDDCDPNDPKTFRWCVLAMEFAMQMTSGWNILGISGEQFKTLKDKISGCMALLISHFDIMGVRSREAENTVMPQVRAIMDFETDDEETVQQLNTKMRLKAINELEQNTVNTRRQVGKVLDATDKDNQYLLTLASSLSNVSIKWQKRSFIGGGSFGSVYSAVNLDTGDILAVKEIKFNDRKTIKQVFPSIRDEMTVLEMLNHPNVVQYYGVEVHRDRVNIFMEYCEGGSLASLLAHGRIEDEMVTQVYSLQMLEGLAYLHESGVDHRDIKPENILLDFNGIIKYVDFGAAKVLASNGSKKLNLEQHMEGEKMIGTPMYMSPEAISGTGYGKFGSDDIWSLGCVILEMVTGRRPWANLDNQWAIIYQVAAGQIPMFPSKNEMSQAGIKFLSRCLIQDPNQRSTAVELLMDPWIIEIRTIAFGDDTVEPVSKERPLNS

SEQ ID NO: 14011 - protein, 138 aa, Candida glabrata
MSLQSGNLHKVSEIPLSQIHRPIVPVLDYQKIDAMVSTMKGKPMASKTCSLEGATELNGQLPPIDVMCVRENGESYYFAFGGCHRFQAYDRLAQEQNDPHIPVRAKVLPATRHQLKLYVGESLDTMFEKADMQRQLEA

SEQ ID NO: 14012 - protein, 280 aa, Hibiscus moscheutos
GLPPAMAAKGHRVMTVSPRYDQYKDAWDTSVVVELKVGDKVETVRFCHCYKRGVDRVFVDHPMFLEKVWGKTASKIYGPRAGVDYKDNQLRFSLLCQAALLAPRVLNLNSSKYFSGPYGENVVFIANDWHTALLPCYLKSMYQSRGIYMSAKVVFCIHNISYQGRFAFADFSLLNLPDRFKSSFDFIDGYNKPVKGRKINWMKAGILESDRVMTVSPYYAQELVSGEDKGVELDNFIRKTGITGIVNGMDVQEWNPATDKYTCVKYDATTVMDAKPLLKE

SEQ ID NO: 14013 - protein, 329 aa, Pyrobaculum aerophilum
MKLDLRRITLAQDVLEAVGSQLLDVIIVGGGPAGLAAAMYATRFGLNTLIITEDVGGQLTKAGLIEDYLGFRSVQGPELARVFESHVRKYGVSILLDKVEDIRRDGGSFVIKTENSGDFRSLTAIIAVGERRKKLGVPGEEEFNARGVSYCAPCDAPLFRDKVVAVMGGGDAAAQAALLLTNYASKIYLIHKRDRLRAQPHYQKLLNHEKIEILWNTIVKELRGDKALREAVIKRTDTGEEGVLKIDGIFIEIGAEPPAEFFKRIGLITTDDGYVKVNEAMETNIPGLFAAGDCTSAMPRGFKQIQIAAAHGAIAAYSAYNYILKLRGG

SEQ ID NO: 14014 - protein, 613 aa, Coccidioides immitis
MSEDELRLRRRNGRIRFRTQFKLANMNELKSAARFPRDASVAASRENEPEQRVPGRDMSAQPSSRPVPCTRKVPRSYQKRLRASYVRSVGVTHWPISSVNGGVSHSSGSTPLALYLIRDSYEVGVPNQEKREGIFSPTTRRTAIRPAEELRDNTVTILSSTTPVYPQFHTSSELPREGPLNLGNALRSSSSQTPTPTITFDFTSFTTDNQQSTWPQPPSSQQPPAPSNPLHVPHNDFVLFPAPSRIRDWNSPQANPPRPAVPLNPASARNFRRHSFLAQQHQHELQARSSSSPVAQDPRVASIIGQSQGLCVPSTWSPPRPRVNISPQQRRNALLLARGASPHSVRPPVPLFPGTGSSTPQHPQTQHHRRAMSTSNLPLDIGTLLDLSTDQFVEDLGSSSHSSLLDQDQLDQLINFNSVAEQMPAQTVSPKDLMMDSSAPPSTSFTDMSTPSFESPGYFSHDTSPLIATDSDLGPGHEEWESLFPVESAMLPKFDEKVPLCSPKAPSALITPMTRTASSPGASPRNSRSSTRPSSISGVKPRNRDKPLPPIVYDTSDPVAAKRARNTEAARKSRARKVELQEQMERRIAELEKALEDSRQREAYWKSLAETQQ

SEQ ID NO: 14015 - protein, 256 aa, Peridictyon sanctum
CELDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYHEMVKNCMIQDLSWKGPAKNWEDVLLELGVEGSEP

SEQ ID NO: 14016 - protein, 280 aa, Hibiscus laevis
GLPPAMAAKGHRVMTVSPRYDQYKDAWDTSVVVELKVGDKVETVRFFHCYKRGVDRVFVDHPMFLEKVWGKTASKIYGPRAGVDYKDNQLRFSLLCQAALLAPRVLNLNTSKYFSGPYGENVVFIANDWHTALLPCYLKSMYQSRGIYKSAKVVFCIHNISYQGRFAFADFSLLNLPDRFKSSFDFIDGYNKPVKGRKINWMKAGILESDRVMTVSPYYAQELVSGEDKGVELDNFISKTGITGIVNGMDVQEWNPATEKYTCVKYDATTVMDAKPLLKE

SEQ ID NO: 14017 - protein, 256 aa, Psathyrostachys fragilis
CELDNIMRLTGITGIVNGMDVSEWDPTKDKFLAINYDATTALEAKALNKEALQAEVGLPVDRKVPLLAFIGRLEEQKGPDVMIAAIPEIVEEEDVQIVLLGTGKKKFERLLKSVEEEFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEP

SEQ ID NO: 14018 - protein, 311 aa, Mycobacterium smegmatis
MSTSQTVHDVIIIGSGPAGYTAAIYAARAQLKPLVFEGTQFGGALMTTTEVENYPGFREGITGPELMDQMREQALRFRADLRMEDVDAVQLEGPVKTVVVGDETHQARAVILAMGAAARHLGVPGEEALTGMGVSTCATCDGFFFRDQDIVVVGGGDSAMEEATFLTRFARSVTLIHRRDEFRASKIMLERARANEKITFLTNTEITQIEGDPKVTGVRLRDTVTGEESKLDVTGVFVAIGHDPRSELVRGQVELDDEGYVKVQGRTTYTSLDGVFAAGDLVDHTYRQAITAAGSGCAASIDAERWLAEQD

SEQ ID NO: 14019 - protein, 161 aa, Paxillus involutus
VVLIGDSGVGKSNLLSRFTRNEFNLDSKSTIGVEFATRSISVDGKTVKAQIWDTAGQERYRAITSAYYRGAVGALLVYDISKHATYVNVTRWLKELRDHADSNIVIMLVGNKSDLKHLRAVPTEEAKNFSTENELSFIETSALDASNVESAFQTILTDVYR

SEQ ID NO: 14020 - protein, 256 aa, Psathyrostachys juncea
CELDNIMRLTGITGIVNGMDVSEWDPTKDKFLAVNYDATTALEAKALNKEALQAEVGLPVDRKVPLVAFIGRLEEQKGPDVMIAAIPEIVEDDGVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVAITLKRAVKVVGTPAYQEMVKNCMIQDLSWKGPAKNWEDVLLELGVAGSEP

SEQ ID NO: 14021 - protein, 175 aa, Arabidopsis thaliana
MQSLQDKASVLSGVDQAEAFAIDESNLFDKLGLQTFINLSTNFYTRVYDDEEEWFQSIFSNSNKEDAIQNQYEFFVQRMGGPPLYSQRKGHPALIGRHRPFPVTHQAAERWLEHMQNALDDSVDIDQDSKIKMMKFFRHTAFFLVAGNELKNQNEKPKHKPQCACKPAANKPAEE

SEQ ID NO: 14022 - protein, 82 aa, Thinopyrum intermedium
MFRVRLENDTIILGYISGKIRSSSIRILMGDRVKIEVSRYDSSKGRIIYRLPHKDSKCIEDSKDSEDLKDSEDLKDTKDSKD

SEQ ID NO: 14023 - protein, 469 aa, Solanum tuberosum
MAPEFQKNAMYVSNELENGDVQKNFDDDGREKRTGTLLTASAHIITAVIGSGVLSLAWAIAQLGWVAGPAVLFAFSFITYFTSTLLADCYRSPGPISGKRNYTYMDVVRSHLGGVKVTLCGIAQYANLVGVTIGYTITASISMVAVKRSNCFHKNGHEASCSIESYPYMIIFAVIQIVLSQIPNFHKLSWLSILAAVMSFTYASIGLGLSIAKASGVGHHVKTALTGVVVGVDVSGTEKVWRSFQAIGDIAFAYAYSTVLIEIQDTLKSSPSESKVMKRASLAGVSTTTLFYVLCGTIGYAAFGNNAPGNFLTGFGFYEPFWLIDFANVCIAVHLVGAYQVFCQPLYGFVEGRCSERWPDSKFITSEYAMQVPWCGTYNLNLFRLVWRTTYVIVTAVIAMIFPFFNDFLGLIGAASFYPLTVYFPIEMYIAQRKIPKYSFTWVWLKILSWTCLISITCCSCWIDPGTCH

SEQ ID NO: 14024 - protein, 256 aa, Pseudoroegneria spicata
CELDNIMRLTGITGIVNGMDVSEWDPTKDKLLAVNYDVTTALEGKALNKEALQAEVGLPVDRKVPLVAFIGRLEEQKGPDVMVAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYHEMVKNCMIQDLSWKGPAKNWEDVLLELGVEGSEP

SEQ ID NO: 14025 - protein, 171 aa, Hordeum vulgare
MQSLQDKASEWSGVAAADAFAIDEVNVFEALGGTPQPFVDLSTNFYTRVYEDEEEWFREIFSGSKKEDAIQNQYEFLVQRMGGPPLFSQRRGHPALIGRHRPFPVTHRAAERWLHHMQQALETTQSINPDTKTKMMNFFRHTAYFLVAGNEMTRQTQSVPPCKHATNKPAE

SEQ ID NO: 14026 - protein, 107 aa, Lophopyrum elongatum
MTEKKNPIEAKVTFEGLVTEALPNGMFRVRLENDTIILGYISGKIRSSSIRILMGDRVKIEVSRYDSSKGRIIYRLPHKDSKRIEDSKDSEDLKDSEDLKDTKDSKD

SEQ ID NO: 14027 - protein, 525 aa, Arabidopsis thaliana
MELEEQERDILFPTDDEECQVDVSCDDEDDDSSSYSSLSQNDSAPWPRSYRQSVDILTGVTPPTISFIHRRSSQTSFTSSVASLYKRRPTSIANSFASSTSKQPLLSEKDDVLFLSSQIGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKSLDLANLPVAIGIFGFGFSGHAVLPSIYSSMKEPSKFPLVLLISFGFCVFFYIVVAICGYSMFGEAIQSQFTLNMPQQYTASKIAVWTAVVVPMTKYALALTPIVLGLEELMLPSEKMRSYGVSIFIKTILVLSTLVVALTFPFFAIMGALMGSFLAMLVDFIFPCLCYLSILKGRLSKTQIGICVFIIISGIVSGCCGTYSAIGRLVGKLDG

SEQ ID NO: 14028 - protein, 256 aa, Secale montanum
CELDNIMRLTGITGIVNGMDVSEWDPTKDKFLSVNYDVTTALEGKALNKEALQAEVGLPVDRKVPLVAFIGRLEEQKGPDVMIAAIPEIVKEEDVQIVLLGTGKKKFEKLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEP

SEQ ID NO: 14029 - protein, 86 aa, Brassica napus
  misc_feature (20)..(20): Xaa can be any naturally occurring amino acid
TQTKGNVSPGGGGVSGGGPXPLTPVMTTPLMGLVEARMSPEGTGLPFGLSNTLLGGIFLGGFGLFWTFSFPHPSSLAEDKKFGFSL

SEQ ID NO: 14030 - protein, 821 aa, Lotus japonicus
MMDSPEPSKINRSSSASALNASVNTPSSESPQVQESPFFRFASNLSPMRPAKACHVAPSFLGLNSPPLVFKSPRVNCDRESRYLERPQGTHLSSVEMSQSYNGGNSLRVAPGDSNESNSQLPLPERFATDTQQDIGLRNDTNTQSCSFPTSVDEYLADPGDTDEMYSVNPDVEQSTYAVESEPSNLTRTKKVILKCNGNDDPGDKAEEPSPLSEESNEIHQERPVENPETEGDKRVVERVSQEHTKLESNLAADVSHNSLTQHAGNGPDHSDCAAQSMSDPLQDVKESKDCHEMVSTLHVRQENISQDGSEASLKYHGIRRRCLKFGEAASSALGSNMSNMKLNATSSQMHFVNPFKPVSSLYLQRGIPETGSKPADYFSPSLKEPIALYPASGHDKRKLSPTDAGNSEGLDQHTPGKKKKKTSSTADGNGCKRCNCKKSKCLKLYCDCFAAGVFCLDPCSCQDCFNKPEYGEKVLETRQQIESRNPLAFAPKIVKSATNAPSNMEDVNLTTPSSARHTRGCNCKRSMCLKKYCECYQSNVGCSSGCRCEGCKNVYGKKEDYVAPDHALSKERVSSNVEKGSDSTMLNKPEMVASREDLFQKEFYDQHHLSPITPSLQCSDQGKDMFPSHRSLMLTDSCDSKSYENVQSPAPPCNSASCILQLTPLSNPDSTSGAPSIPAKPVGTSAPSSRVSHGCVRQLSGGSLRWRSSPVTPRNTNLGEAQHLQGLESDSRLFDIVEDETPAILKESSTPTKTVKANSPIQKRVSPPRVIGSSSSGGLRTGRKFILKSVPSFPPLTPCMDSKGNGNEDGNVDSGNGATK

SEQ ID NO: 14031 - protein, 240 aa, Oryza sativa
MAAAAPSRVSVRAAAPGQTGGFAKIRPQVVVAAAARSAGVSGRRARSVRASLFSPKPATPKDARPAKVQEMFVYEINERDRESPAYLRLSAKQTENALGDLVPFTNKLYSGSLDKRLGISAGICILIQHVPERNGDRYEAIYSFYFGDYGHISVQGPYLTYEESYLAVTGGSGVFEGAYGQVKLNQIVFPFKIFYTFYLKGIPDLPRELLCTPVPPSPTVEPTPAAKATEPHACLNNFTN

SEQ ID NO: 14032 - protein, 113 aa, Glycine max
MQTSLTFAAPNVVPLAQTKSFSHVAIFPTNLKAPRSSPRYSPIRVAIVEPDTSTVDYNSAFSVFPAEACETVGGEACMAEMYPEVKLQPEAKTPRVVTENVEREYLEYDDPKT

SEQ ID NO: 14033 - protein, 261 aa, Prochlorococcus marinus
MNTNQFGTVHLVGAGPGDPDLLTVKAQKLISKCDALVYDSLVPIELLELVSSNCQLHSVGKRRGHHSVPQRTTNDILFDLAKSYSCIVRLKGGDPFLFGRGAEEASYLHKKGVPVQVVPGVTSGIAAPAYVGIPITHRRAGSSVTFVTGHEGIDKKRPAVNWRSLAKSSDGIVIYMGVHNLKFISAELIAGGMNPETSAAVIEQGTVIGQRHIKSPLVKLFDRVQEENLRSPAIVVIGSVVDFQVEACSPKPAEVTFPIPI

SEQ ID NO: 14034 - protein, 527 aa, Oryza sativa
MAAAAARSGAHPPSFASSLGRCRVLPVVVVRRPGGAARPSPLLAPARCAAAVGTAAPKVEGGGRRSSEQGQLAVAPARLVDELVEEALVWSSQHGLVVGDKNHPVKCCPILIDPTGNSQLNHTDYRSGKAPGVGLLHAPFALLPMSFSKVYWDQAVELAPLFNELVDRVSLDGDFLQETLASFSLSFSRTKEVDSFTGRLLDIHAKMMKLNKKEDVRLGLTRSDYMIDGATDQLLQVELNTISTSSNGLACGVCELHRNLIRQHERELGLDPESVVGNTAIAQHAEALAGAWAEFNNQRFSVVLVVVQPEERDGLPVAVVYFRAGYTPNDYPSEAEWRARLLIECSSAIKCPSIAHHLVGTKKIQQELAKENVLERFLDNKADIEKVRKCFAGLWSLENDSIVMSAIESPELFVLKPQREGGGNNIYGDNLRETLISLKKDGSNELAAYILMQRIFPPASLCYLVRDGTCIRENAVSEFGIFGAYLRNKDRVIINDQCGYLMRTKAASLNEGGVVAGYAFLNSVFLT

SEQ ID NO: 14035 - protein, 372 aa, Unknown
  delta proteobacterium MLMS-1
MKIDYYKTLGVGTDASMEEIKKAYRKLALQYHPDRNPGDQEAEEKFKTATEAYEVLGDLEKRKIYDRYGVDGLRDSGYQGPGGFDDIFSSFSDIFGDLFGFGGARGGSRRASGGPIPGNDLRYDLVISFMEAAHGVEKEVEISKGETCWTCEGSGARPGHPPESCSTCNGIGQVLHAQGPFRVQSACPHCRGQGRVVTEPCQDCQGQGLVKRSKKVSLKIPAGVDSGARMRLKGEGEGGRRGGPAGDLYVIIHVQPHDFFQREGYDIVCSLPLSFTQAALGCSLEVPTIYGSHKLKIPAGTQPGQHFTINEMGVAKLRGGGYGDMICEVRVVVPKRLTKKQKKLLKEFADSEEDPSDDAAKGDGFLKKFFHL

SEQ ID NO: 14036 - protein, 609 aa, Arabidopsis thaliana
MDTPEKSETQIGTPVSKLKVEDSPVFSYICNLSPIKTIKPIPITCPLSSLNYASPPSVFTSPHAVSHKESRFRSQKDVSASKEVGEEEALVGSEPEQSYKNDCNTPRVTNDVKDNGCGKDLQVMMDNVKKKSDTPDWETLIAATTELIYGSPRESEAFSCLLKKTSNSEARLRGSITATSVAVTNTDVVNNESESVDALSILHRGVRRRCLDFEVKGNNQQTLGESSSSCVVPSIGLHLNTIAMSSKDKNVANEYSFSGNIKVGVQSSLTPVLHSQHDIVRENESGKDSGQIIEVVPKSLASVDLTPISPKKKRRKSEQSGEGDSSCKRCNCKKSKCLKLYCECFAAGFYCIEPCSCINCFNKPIHKDVVLATRKQIESRNPLAFAPKVIRNSDSIIEVGEDASKTPASARHKRGCNCKKSNCLKKYCECYQGGVGCSINCRCEGCKNAFGRKDGSLFEQDEENETSGTPGTKKTQQNVELFKPAAPPSTPIPFRQPLAQLPISSNNRLLPPQSHFHHGAIGSSSSGIYNIRKPDMSLLSHSRIETITEDIDDMSENLIHSPITTLSPNSKRVSLSHLDSPESTPWRRNGGGRNLIRSFPTFPSLTPHH

SEQ ID NO: 14037 - protein, 529 aa, Zea mays
  misc_feature (486)..(486): Xaa can be any naturally occurring amino acid
  misc_feature (497)..(497): Xaa can be any naturally occurring amino acid
MNTVASLPLAPRLLIKPSLACFSRKDVARYGGIKVYAVLREDGAEFARNNNLGALFQVDDPGPRAPVKKFLDVNEALEVVRFDIQYCDWRARQDLLTIMLLHSKVVEVLNPLAREFKSIGTLRKELAELQQELEKAHNQVHLSEARVSSALDKLAHMETLVSASSTAEPPTSSSLAATATATATASSTARVRAKNKQPRRRLDVSGPVKPYNPSLKNFWYPVAFSSDLKAPDTMVPIDCFEEQWVIFRGKDGRPGCVQNTCAHRACPLHLGSVNEGRIQCPYHGWEYSTDGKCEKMPSTKMLDVRIQSLPCFEQEGMVWIWPGDDPPKATIPSLLPPSGFTVHAEIVMELPVEHGLLLDNLLDLAHAPFTHTSTFAKGWSVPSLVKFLTPASGLQGYWDPYPIDMEFRPPCMVLSTIGISKPGKLQGKSTRQCSTHLHQLHVCLPSSRNKTRLLYRMSLDFAPWLKQVLNEDLRLVLGQQERMIDXRQRLELAGVVXKLGIRYRLWRDAVERGADDRLPFSSTQAESLS

SEQ ID NO: 14038 - protein, 301 aa, Kluyveromyces lactis
MGKSSKDKRDLYYRKAKEQGYRARSAFKLLQLDDDFHFLQQAVRVVDLCAAPGSWSQVLSRRLFPQSSDNSDRKIVAVDLQPMSPIDNVITLQADITHPKTLQTITELFEGKKADFICSDGAPDVTGLHDLDEYVQQQLILSALQLSTCLLRKGGNFVAKIFRGRDIDMLYSQLGYLFEKVICAKPRSSRGTSLESFIVCLGYNPPANWEPKLDVNSSVEDFFQGCDIGKLRLEDKCPNYHEEPRSIATFIACGGLSSFDSDATYHVDTSTPALDPVQSPTNPPYKKALELKRRGKMTRAI

SEQ ID NO: 14039 - protein, 280 aa, Hibiscus dasycalyx
GLPPAMAAKGHRVMTVSPRYDQYKDAWDTSVVVELKVGDKVETVRFFHCYKRGVDRVFVDHPMFLEKVWGKTASKIYGPRAGVDYKDNQLRFSLLCQAALLAPRVLNLNTSKYFSGPYGENVVFIANDWHTALLPCYLKSMYQSRGIYKSAKVVFCIHNISYQGRFAFADFSLLNLPDRFKSSFDFIDGYHKPVKGRKINWMKAGILESDRVMTVSPYYAQELVSGEDKGVELDNFISKTGITGIVNGMDVQEWNPATDKYTCVKYDATTVMDAKPLLKE

SEQ ID NO: 14040 - protein, 280 aa, Hibiscus dasycalyx
GLPPAMAAKGHRVMTVSPRYDQYKDAWDASVVVELKVGDKVETVRFFHCYKRGVDRVFVDHPMFLEKVWGKTASKIYGPRAGVDYKDNQLRFSLLCQAALLAPRVLNLNSSKYFSGPYGENVVFIANDWHTALLPCYLKSMYQPRGIYMSAKVVFCIHNISYQGRFAFADFSLLNLPDRFKSSFDFIDGYNEPVKGRKINWMKAGILESDRVMTVSPYYAQELVSGEDKGVELDNFIRKTGITGIVNGMDVQEWNPATDKYTCVKYDATTVMDAKPLLKE

SEQ ID NO: 14041 - protein, 544 aa, Medicago truncatula
MGVESLQMLTTSDYASIISMNLFVALLCACIVIGHLLEENRWVNESITALLLGLCTGVVILWISGGKSSHLLVFSEDLFFIYLLPPIIFNAGFQVKKKRFFVNFITIMSFGAVGTLISCSIITFGVSQIFKRMGIGTLDLGEAVAIGAIFAATDSVCTLQVLNQDETPLLYSLVFGEGVVNDATSVVLFNAIKSFDLEQLDHGIALQFFGNFLYLFIASTMLGVLGGLLSAYIIKKLYIGRHSTDREVALMMLMAYLTYILAELWYLSGILTVFFCGIVMSHYTWHNVTESSRITTKHAFATLSFVAETFLFLYVGMDALDIEKWRFVSDRPGTSVIVSSVLLALVLIGRAAFVFPLSFLSNLTKKSQNEKISFRKQVIIWWAGLMRGAVSMALAYNEFTMSGHTQLQFNAIMITSTITVVLVSTMVFGMMTKPLIRFLIPLGHPPKQKNSLANLEESSPKSITVPFLGGRQDSEEVDNDNDNDANDSHRPSSIRDLLTTPTHTVHRLWRKFDDAIMRPVFGGRGFVPVVPTSPTESDCQLQWD

SEQ ID NO: 14042 - protein, 175 aa, Mycoplasma pneumoniae
MGIKSIIIDQKQVEAGCNAALKWCNEHFAGKQVIVLGILKGCIPFLGKLISQFTFDLQLDFVAVASYHGGSRQQEAPKIVLDMSHDPKGKDILLIEDIVDSGRSIKLVLDLLHTRKAKSVILVSFIEKLKPREADIKVDYSCFKNQDEFLVGFGLDYQGFYRNLPYVGVFDPEDN

SEQ ID NO: 14043 - protein, 361 aa, Aspergillus nidulans
MATDTSTYKLNHTMLRVKDPKRSVEFYKFLGLNQVQQLDFPDNKFSLYFLAYNGPQSLQGDRHWTDRNAVLELTHNYGTENDPNYSITNGNTEPHRGYGHIAISVDNIEAACQRLEDAGYAFQKKLTEGRMRHIAFVKDPDGYWVEIIKRRDEAMSTSTDPATYRLNHTMLRVKDAEASLKYYQEVLGMTLVRTIENKEAAFNLYFLGYPASNPQATEGANNPVAEWEGLLELTWNYGTEKQEGKVYHNGNDEPQGFGHICVSVDDLNAACERFESLKVNWKKRLTDGRMKNVAFLLDPDGYWIEVIQNEALKRTSNWRIVQARCRPIWVKDSAVSNGGTITHEYKLIKGFARGLEFGGGI

SEQ ID NO: 14044 - protein, 256 aa, Thinopyrum bessarabicum
CELDNIMRLTGITGIVNGMDVSEWDPTKDKFLAVNYDVTTALEGKALNKEALQAEVGLPVDRKVPLVAFIGRLEEQKGPDVMIAAIPEIVKEEDVQIVLLGTGKKKFEKLLKSVEEKFPSKVKAVVRFNAPLAHQMMAGADVLAVTSRFEPCGLIQLQGMRYGTPCACASTGGLVDTIVEGKTGFHMGRLSVDCNVVEPADVKKVVTTLKRAIKVVGTPAYHEMVKNCMIQDLSWKGPAKNWEDVLLELGVEGSEP

SEQ ID NO: 14045 - protein, 280 aa, Hibiscus coccineus
GLPPAMAAKGHRVMTVSPRYDQYKDAWDTSVVVELKVGDKVETVRFFHCYKRGVDRVFVDHPMFLEKVWGKTASKIYGPRAGVDYKDNQLRFSLLCQAALLAPRVLNLNGSKYFSGPYGENVVFIANDWHTALLPCYLKSMYQSRGIYMSAKVVFCIHNISYQGRFAFADFSLLNLPDRFKSSFDFIDGYNKPVKGRKINWMKAGILESDRVMTVSPYYAQELVSGEDKGVELDNFISKTGITGIVNGMDVQEWNPATDKYTCVKYDATTVMDAKPLLKE

SEQ ID NO: 14046 - protein, 256 aa, Lophopyrum elongatum
CELDNIMRLTGITGIVNGMDVSEWDPTKDKFLAINYDVTTALEGKALNKEALQAEVGLPVDRKVPLVAFIGRLEEQKGPDVMIAAIPEIVKEEDVQIVLLGTGKKKFEKLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSKP

SEQ ID NO: 14047 - protein, 131 aa, Brassica napus
MSSTTRSSTAMNGDEPPRKMMTKQSPEISILSLPYDLLLNCVARVSRLYYPTLSLVSQKFRSVIASPDLYETRSLLHRTESCLYLCLRYNRDYPRNLDTYWFALCRKPNRTVTDRSSGHLFIPVSSPQLRP

SEQ ID NO: 14048 - protein, 256 aa, Triticum monococcum
CELDNIMRLTGITGIVNGMDVSEWDPTKDKFLTVNYDVTTALEGKALNKEALQAEVGLPVDRKVPLVAFIGRLEEQKGPDVMIAAIPEIVKEEDVQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEHVLLELGVEGSEP

SEQ ID NO: 14049 - protein, 235 aa, Colletotrichum sublineolum
LIPGCHKLPKGYYGTSIKLNWCMDPNRGVTVCYRMNGELLHPDHGKPVRIIIPGHIGGWSVKWLKRIIGTKEPNDNWYHIYYNRVLPTTDSPDVSADLPEVWKDQRYAIYDLNPNSATCYPAHDEVISLADGAKSYKVRGYAYSGGGRRITRVEVTLDRGKTWLLANIDYPEDTYRLAPEGETLYGGRVDMDWRETSFCWCFWDLDIPITRLADAADVMVRAMDESMMVQPRDMY

SEQ ID NO: 14050 - protein, 251 aa, Triticum monococcum
CELDNIMRLTGITGIVNGMDVSEWDPTKDKFLTVNYDVTTALEGKVLNKEALQAEVGLPVDRKVPLVAFIGRLEEQKGPDVMIAAIPEIVKEEDVQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEHVLLELGV

SEQ ID NO: 14051 - protein, 468 aa, Shigella flexneri
MSKQQIGVVGMAVMGRNLALNIESRGYTVSIFNRSREKTEEVIAENPGKKLAPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRSALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 14052 - protein, 918 aa, Shigella flexneri
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISCVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSIQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTPTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQRQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLAGENPEGLVDLIHKLHGSCGYSGVPRMKNLCQLIEQQLRSGTKEEDLEPELLELLDEMDNVAREASKILG

SEQ ID NO: 14053 - protein, 256 aa, Triticum urartu
  misc_feature (41)..(41): Xaa can be any naturally occurring amino acid
CELDNIMRLTGITGIVNGMDVSEWDPTKDKFLAVNYDVTTXLEGKALNKEALQAEVGLPVDRKVPLVAFIGRLEEQKGPDVMIAAIPEIVKEEDVQIVLLGTGKKKFERLLKSVEEKFPSKVRAVVRFNAPLAHQMMAGADVLAVTSRFEPCGLIQLQGMRYGTPCACASTGGLVDTIVEGKTGFHMGRLSVDCNVVEPADVKEVVTTLKRAVKVVGTPAYHEMVKNCMIQDLSWKGPAKNWEHVLLELGVEGSEP

SEQ ID NO: 14054 - protein, 181 aa, Brassica napus
MAYSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 14055 - protein, 160 aa, Unknown
  Synechococcus sp. CC9605
MSLDADAKKVLLRKIPHGLFICNVRNGDEVNGFTASWVTQGSFEPPLVVMGVRADSSSHAIIEATGKFSLNVLRADQKDLAAVFFKPQKALGGRFEAAPFEEGELGLPLLTDAIGGVECELVGSIKHGDHTVFVGEVKTARLITDGEALNLASTGWNYGG

SEQ ID NO: 14056 - protein, 175 aa, Pseudoalteromonas tunicata
MLKALLLSLTVLSANALASECDDFTNVEMKKLRSDKTINLCQFKDKPLLIINTASNCGFTPQFKGLEAIHKKYKDQGLVVLGFPSDDFFQEEDDEKDTAKVCFINYGVTFNMFAPISVRGKNADPIFKHLAEQTSSPKWNFYKYIVSKDRKTVLKFNSKTTPEDADFIKAIEESL

SEQ ID NO: 14057 - protein, 741 aa, Vitis vinifera
MESCDCIDPPWPGDELLMKYQYISDFFIALAYFSIPLELIYFVKKSAVFPYRWVLVQFGAFIVLCGATHLINLWTFGMHSRNVEVVMTTAKVLTAVVSCVTALMLVHIIPDLLSVKTRELFLKNKAAELDREMGLIRTQEETGRHVRMLTHEIRSTLDRHTILKTTLIELGRTLSLEECALWMPTRTGLELQLSYTLRQQNPVGFTIPIQHPVINQVFSSNRAVKISPNCPVARLRPLAGKYMPGEVVAVRVPLLHLSNFQINDWPELSTKRYALMVLMLPSDSARQWHVHELELVEVVADQVAVALSHAAILEESMRARDLLMEQNVALDLARREAETAVRARNDFLAVMNHEMRTPMHAIIALSSLLQETELTPEQRLMVEAILKSSSLLATLINDVLDLSRLEDGSLQLENGTFNLHALFREVLYLIKPIASVKKLFVSSSLAPDLPEFAVGDEKRLMQIMLNVVGNAVKFSNEGNISIFAFIAKSESLRDSRAPDFFPVHSDNHFYLRVQVKDSGAGIDPQDISKLFTKFAQCQSLAARNSGGSGLGLAICKRFVNLMGGHIWIESEGLGKGSTAVFIVKLGIPEYSNESKLPFFPKVSANHCQTNFPGLKVLVMDDNGVSRSVTKGLLVHLGCDVTTVSSADDCLRVVSQEHNVVFLDVCMPGVDGYEVAIRIHEKFTTCRQGPLLVALMGNTDRVTKENYLRVGINGVVLKPVSVDKMRCVLSEVLEHRFLFETC

SEQ ID NO: 14058 - protein, 421 aa, Oceanicola granulosus
MKDIEDVGAVMARIGENARAAAGTLAWTEAERKYAALIGAAEAVWARREEILEANREDLAFGEEKGLSPAMMDRLMLDQGRVRAIVDGLRAVAEQTDPVGEVITEWDRPSGLNIRRVRTPLGVVGVIYESRPNVTADAGALCLKSGNAVILRGGSESFHSSGAIHACLVQGLREAGLPETAIQLVPTRAREAVSLMLRDSANIDVIVPRGGKGLVGLVQREARVPVFAHLEGICHVYVDRWADPEMAERIVVNAKTRRTGICGAAECLLIDWRYYTEHGPRLIEALLEKGVEVRAGDELAKVPGTVRATDEDWGREFLDRIIAVKLVDGVDEAMAHIRRHGSQHTDAIVTRDQPTADRFFQRLDSAILMHNASTQFADGGEFGMGAEIGIATGKMHARGPVGAEQLTSFKYLVSGDGAVRS

SEQ ID NO: 14059 - protein, 283 aa, Streptococcus equi
MEHKWKLLLLVFGALVFLGGVLMVFQRGYATSYHNNQVKLPAKGTSQLKKTANAKLPEKKKEIYLAGGCFWGVEEYFSNVDGVLDAVSGYANGRGDTTSYQLLHQTGHAETVQVVYDANRISLKELLLHYFRIIDPTSLNKQGNDRGSQYRTGIYYTDPSDLTTIDMVFQEKASDYKKKIVVEKAPLKSFTKAEEYHQDYLKKNPNGYCHINVNEASYPVIDKTKYPKPSKEEIKKKLSKDEYRVTQNNETEKAFSNRYWDSFEAGIYVDVVTGEPLFSSKDK

SEQ ID NO: 14060 - protein, 407 aa, Campylobacter lari
MLNNTLFFKTQDFKKITAYANRMNDELESGDIGYYHLVDTSFDLIEESKEFIATKTHIENIVLVGMGGSSCGVKALKELLFDQVEEKKLFIIDNTSSHTFTQTMQKINPQKTLFIIASKSGTTIEVISLFKLIIAHFDFKNENLHENFVFITDLNSKLHKLGEELNIKCFFIPQNVGGRFSVLSAIGIVPLSFCGYDTKALLEGAKACYVDFFEKKCDQILQKAYHYCTHKSAHINVLFSYGDAFKGFNEWYIQLIAESLGKKQGFKRIGLTPIALIGARDQHSFLQLIMDGPKDKTVTFLKIKDSQKSPSIPNISFNHLQNCDFTNEVNLHDLLNAQCDATMHALIAENLSVDVIELEKLDAYHCGYLMYYYELFTSACGIMLGINTYDQPGVEVGKLILKNMLSK

SEQ ID NO: 14061 - protein, 676 aa, Candida glabrata
MSHIEFLERAGCSQYADLFEEYSLTDINDLMHIDRDILLEIGVKKLGDRIRILKESKKLQEPKDDAKHVQQLQELISNISELSTTSTNINEEVITERHCVIFILNDGSAKKVNISGCFNADSIKKRLIKRLPSNLLAVNTDGQTTQESSDYDVFIVDYSKNVLRLLYDIELVTICHSNDRVEKNRLIFVSKDQTPTDRAINASKKLYLKTITALNHIESYYDAQSGMPNTPVTQDGTLRIHKEGKDKLRKIFDQRPPSEFISTNIAGYFPHADTKRLEKALRESYRQSARISMKSNNSRHISSESNRVGDILLKHSNAVDMALLQSLDNNNAPSSKPEVIPPSTPQEEDNEGKIKLMEETESIDDYYMNSDEEHGTVSLPTKIVTPKNWLKGARIGSGSFGTVYLGMNAQTGELMAVKQVEIKPAIAATADANVEDKNAEKNVAKAPSTNLHRKMIDALQHEMSLLKELQHENIVTYYGSSQEGGNLNIFLEYVPGGSVSSMLSNYGPFEEPLIVNFTRQILIGVAYLHRKNIIHRDIKGANILIDIKGCVKITDFGISKKLSPLNQENQDKRTSLQGSVYWMSPEVVKQTATTSKADIWSTGCVVIEMFTGKHPYPDFSQMQALFKIGTNVTPEIPSWASPQGRDFIRKTFELDYQRRPTAIELLQESWLESHII

SEQ ID NO: 14062 - protein, 202 aa, Glycine max
MGTPETSREPCPDRILDDIGGAFGMGAVGGSAFHFLKGLYNSPKGDRFVGATQAVRLNAPRVGGSFAVWGGLFSAFDCTMVYARQKEDPWNSIVAGAATGGFLSMRQGLGASARSAAFGGVLLALIEGAGIMLNKFLSAQQPMPMIMDEPQPQPPQSSEQPWLGGWFGGGNKEETATTAGSGSETKILESFDAPPVPNFEYK

SEQ ID NO: 14063 - protein, 298 aa, Oryza sativa
MSSWLFRRSGPSGFSWASTADQVTAGLSAAGLTAIVTGASSGIGAETARVLAIRGAHVVMAVRNLAAAQPVRDAILADAPAASLDLMELDLASMDSVRAFASDFAAKGLPLNILINNAGVMATPFSLSKDGIELQFATNHVGHFLLTHLLLETMKKTSRESNVEGRIVNVSSEGHRYNSIGAYGQSKLANILHANELARRFKDEGVNITANSLHPGSIITNLLRHHSILDVLHRTLGKLVLKNAQQGAATTCYVALHPQVKGVSGKYFSDSNVNEASEKGNDMELAKRLWEYSIELIT

SEQ ID NO: 14064 - protein, 1329 aa, Vibrio parahaemolyticus
MDNKTFKLSTIAKTVLPLISIAVISGCGSDSTSDDTTNPGSGLYPAGENEVVIYYKRDIASASTASDYEGWGLHLWNGEGCTSTDLEAMGIAGTGTDWSAPRPFDGINDTYGAYYVLKVNPDASDPHECMNFILHKGDEKAFGSSNSKVELTKIGESKGLFGFHGSSELYYEPIEERPVDIDGQKAHWLDANTIAWEAAANADSMKLFYSLTNDIKMDEDKQISGGTAVELTKAGDLSDGLKSRFRHLASLQAAGIDVDDATLRTILKSQIVMVAYNANGDVISATEVQKPGVLDAVFADSKAGNAISQELGAIVEGGAATFKLWAPTAQDVALIIYDENLKEETTVAMKEDSATGIWVSEAQSNVVNKYYRYQVKVYHPTTGVIETRLVTDPYSLSLSKNSMYSQVIDLDDPSLMPQGWSDYERPTVKKDEDHVLYESHLRDFSFNDTKGTKEYNGKYLALTEADRESVSHLQALKDAGLTTLHILPAFDIATVDEEAANRVDITDTVGKLCGIKPEASVCDEVDGAKVIEDVLNSYDPATGSAQALMNDLRMLDSFNWGYDPFHYTVPEGSYATDPNGSKRILEFREMVQATHKMKLKLIMDVVYNHTNASGINDKSVLDKIVPGYYHRLNVNTGGVENSTCCDNTATENLMMGKLMVDSLKVWADDYKVDGFRFDLMGHQPKDVMVYALEQIRKIDENTLFYGEGWDFGEVSNNARFDQATQLNMAGTEIGTFSDRLRDAVRGGSPFDGGVDSEGKHPLRFNQGFGNAAYANEETKVDAESVNGRLHNQDLVRLGMAGNLADFVLLDYKGDTKLGKNVDYNGAPAGYTKVPSENISYVSKHDNQTLWDNNAYKIATATPSADRARMQSVSLSTVMLGQGIPFIHMGSELLRSKSMQRDSYDSGDWFNRVFFDGSDNNWNVGLPREDKDGANWELIKKIVSDTTAKPDATDIELTKQQFLELLKIRSSSELFRLDTAQEVMNRVDFRNVGKDQVEGLIVMSIDDGKSAGADLDSKYDAIVAVVNSTSSEKSFVVKGATGFELHEVQQNSADDIVKGASFANETFTVPALTTAVFVQPQDGAQGAGLPVNTDNKDVSSIPPFGETVVYVKGTMNNWSDNSDWAMTFIGNGMYSVTGVLEAGSHEFKFADTGWANPNIGCSVATVGSGSLELGAEENCKLTVAETGKYNFTLNALYVQDEKVEKPVVSVTKSADAPTFGETALYLRGTITSWDTPAQDSAAKFSYVANDVYSLDIDLAAGSYEMKIASADWAADTNFGGEGSVELGKALTMEVGGGSANLKIAIAEAGNYNFHFNAADKSAPIVTVTKN

SEQ ID NO: 14065 - protein, 288 aa, Glycine max
  misc_feature (59)..(59): Xaa can be any naturally occurring amino acid
  misc_feature (84)..(84): Xaa can be any naturally occurring amino acid
  misc_feature (102)..(102): Xaa can be any naturally occurring amino acid
MASSVAAAASAFLGTRLADPAPQNGRIVARFGFGKKKAPPKKAKAPPTTDRPLWFPGAXPPEYLDGTLVGDYGFDPFGLGKAPXEYLQYDVDSLDQNLAQNXWAGEIIGTRFEDADVKSTPFQPYAEVFGLQRFRECELIHGRWAMLATLGALTVEWLTGVTWQDAGKVELVDGSSYLGQPLPFTLTTLIWIEVLVIGYIEFQRNAELDPERRLYPGGSYFDPLGLAADPEKKETLQLAEIKHARLAMVAFLGFAVQAAATGKGPLNNWATHLSDPLHTTIFDTLGSS

SEQ ID NO: 14066 - protein, 247 aa, Brassica napus
RPRVRTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQHPVEYTVPIQLPVINQVFVTSRAVKISPNSPVARLRPVSGKYLLGEVVAVRVPLLHLSNFQINDWPELSTKRYALMVLMLPSDSARQWHVHELELVEVVADQVAVALSHAAILEESMRA

SEQ ID NO: 14067 - protein, 252 aa, Vibrio parahaemolyticus
MTTANSSLNSGFVSLVGAGPGDPDLLTVKGLKAIQAAEVVVYDRLVSKEILELAQASAEMIYVGKKLDFHCVPQDQINQILVEKAQEGKRVVRLKGGDSFIFGRGGEELEELAEYGIQYEVVPGITAAAGATAYAGIPLTHRDHAQSVQFITGHVQKDGREIEWHSLAQSNNTLVFYMGLKQSGHIMDKLITHGLDPEMSCAIIENGTRPEQRVFQGKLNELSSMAEQAVSPALIVVGSVTQLHNKLAWFGK

SEQ ID NO: 14068 - protein, 63 aa, Protea angolensis
MPGRWEYQVGPSVGIEAGDHIWCSRYLLERITEQAGVVLTLDPKPIEGDWNGAGCHTNYSTKS

SEQ ID NO: 14069 - protein, 976 aa, Pisum sativum
MEHLKKSPSSSSSSSMRPSFPRDPRGSLEVFNPTSNSSSPVRSPSNLKNWTEIEEPRNELSEQHNEFSDEVTNTSWMAIKEGETGAAVQRAAEWGLMLTTDAETGKPQGVAVRNSGGDEPSVKLETKRNSNNTVRTSGESSDGDDPRGFPRVSEDLKDALSAFQQTFVVSDATKPDYPILYASAGFFKMTGYTSKEVIGRNCRFLQGADTDPDDVARIREALEGGKSFCGRLLNYKKDGTPFWNLLTISPIKDDDGNVLKLIGMLVEVNKHTEGSKEKKLRPNGLPESLIRYDARQKEKATSSVSELLEAMKRPRALSESGQRPFIRKSGGGGGSEEDEEAVENKSRRKSDSVASFRPKPQGKIRHSMERISELPENKQKNSRRGSFMGFMRKSDSIDESIDNEVIVDVSSGSEDDERDDSFEFDDKEKLREKRKGLDLATTLERIEKNFVITDPRLPDNPIIFASDSFLELTEYSREEILGKNCRFLQGPETDPATVRKIREAIDNQTEVTVQLINYTKSGKKFWNLFHLQPMRDHKGEVQYFIGVQLDGSQHVEPLHNCIAEDTAKEGELLVKETAENVGEAVKELPDANQKPDDLWMNHSKVVRPKPHRKDDDAWRAIQKVLENGEQVGLKHFRPIKPLGSGDTGSVHLVELEGTGQYFAMKAMDKGVMLNRNKVHRACTEREILDMLDHPFLPALYASFQTKTHVCLITDYYPGGELFLLLDQQPTKVLKEDSVRFYAAEVVIALEYLHCLGIIYRDLKPENVLIQSNGHVSLTDFDLSCLTSCKPQLILPAIEEKKKRKKKKNKGQQKNQQVPMFMAEPMRASNSFVGTEEYIAPEIITGSGHTSAVDWWALGILLYEMLYGYTPFRGKTRQKTFANILHKDLKFPKSKPVSPHGKQLIYWLLHRDPKNRLGSLEGANEIKNHPFFKNINWALVRCTKPPELDGPILLDNDEKKEAKEIDPGLDDLQKNIF

SEQ ID NO: 14070 - protein, 234 aa, Archaeoglobus fulgidus
MKVYFVGFGPGNPELLTLKAYKLLKEADLVVYPGSIVPEKFFEEFKGEKVNSHGKTLEEIVDLIERYVKRGKRVVRVQSGDPSIFGAVWEQIRELRRRGIDCEVVPGVSSVFASAASLGIELTSPSTEGVAIVRPAGKTLEKDHLEELARLPLTLVILLGVDKIGEIAEKIARVRGWDEPCAVVFHASREDEIRIKGTLKDIAEKVREKGIRRTATIIVGKVVEGYDERSHLYS

SEQ ID NO: 14071 - protein, 641 aa, Streptomyces avermitilis
MTKRDRTPKTYTRLTHPLVRDSRDEPLRRATWEEALDRAARGLDAARGAFGMFSCARATNEMNYVAQKFARVVMGTNNVDSCNRTCHAPSVAGLSAAFGSGGGTSSYEETEHTDLIVMWGSNARFAHPIFFQHVLKGIRNGARMYAVDPRRTSTAEWAESWLGLNVGTDIPMAHAIGREIIHAGLANETFVERATSGFEEYRALVEPWTLSLAEKVTGVPARAIRELAHAYARAERAQLCWTLGITEHHNGTDNVRALINLSLLTGHVGRYGSGLQPLRGQNNVQGGGDMGAIPNRLPGFQDILDPDARLKFESAWDTVIQPHYGLNLTEMFEAMEEGTLRAVYCIGENPAQSEADSERAVRRMRALDFLVVQDIFLTRTAELADVVLPATAGWAETDGTTTNSERRVQRVRRAVTPPGEAREDIDILCALAARLGHDWKYADAEAVWNELRSVSPDHYGMTYERLAEHQGIQWPCPAPDRLEPPYLHGRLWSSDPAGRGRLAPFGIVQHDPPVDLTDEEYPIRLTTGRRLDSYNTGVQSGGFASPLRRGEFVELCPEDAERYGVVVGEQVQVASRRGAVVAPVWIDPALRPGLAFMTMHFPDEVDTNRLTIEANCPIAGTAEFKASAIRIEKLPVTAVRS

SEQ ID NO: 14072 - protein, 365 aa, Gypsophila paniculata
MVADRPKTLTSLEGDNKLNPNFIRDEDERPKVAYNTFSNDIPVISLAGLDGENRAEICRKIVEACEDWGIFQVVDHGVGDDLIADMTRLAREFFALPPDEKLQYDMSGGKKGGFIVSSHLQGEVVQDWREIVTYFSYPITSRDYTRWPDKPDGWKKVTEEYSNKLMGLACRLLGVLSEAMGLESEALTKACVDMDQKIVVNYYPKCPQPDLTLGLKRHTDPGTITLLLQDQVGGLQATRDGGRTWITVQPISGAFVVNLGDHGHFLSNGRFKNADHQAVVNSECSRLSIATFQNPAPEATVYPLAIREGEKSIMEEPITFAEMYRRKMSKDLEAARLKRLAKEELVIKEMDKAKLETKSIEQILA

SEQ ID NO: 14073 - protein, 679 aa, Pyrococcus horikoshii
MLNGIGMGVRVVCPYCGFGCNLLIDPKSRRVKPYPGEPNRGKLCPKGLYALEHVFSKDRLKHPLKKEGESFRRISWEKAISEISTKLKEIIEDYGPGSIAFIASSKVTNEENYLIQKIARLLGTNNVDNCARLCHESSVHALKLTLGDGVQTNPYSDLERFGAIMIWGYNPAETHPVVMQYILGAKRRGGKIIVIDIRETLTMRFADYRLVIKPGTDITLANAIMNVIIEGNLYNKEFVESRTTGFSEIRMGVKKYTPEYAEKVTGVPAELIREVAEVFAKAGSGAIMWGMGITQQISGVENVLALVDIALLLGYFGEKGGLYPMRGQNNVQGAAYMGTLSEFLPGYIPLSDSKFRRKVAKMWGVEDLPTERGFYLTEYWDAILKGDLKALYIVGENPAVSDANALKVRKALTKLDLLVVQDLFLTKTARFAHYILPAAAFCEKEGSYMNSERRIQWSFKVCDPPGESKPDWEILVMLARALGLKGFDYSKVEDITREYFKLFPALRNRSIEELKARGIIIPAPRLYVDSFNTHDGKARFVAVEQIMPWEEPNGEYPLILTTVRLINHYNTGEMTRRSPSLAKMSGESVVFISREDAREYGIEDGDYVIVETRRGSLRLKAKIAKIQKGVIAIPFHFDANLLTNDALNKAGTPEFKFSAARIRKIEKENYGTKCDEGKG

SEQ ID NO: 14074 - protein, 177 aa, Neisseria meningitidis
MGIYDFQMKDAEGNAVDLSGYRGKVLLIVNTATRCGLTPQYEALQKLYAQYTAEGLEILDFPCNQFREQAPESSGEIAQVCMMKFGTKFKIFDKIEVNGANTAPLYAYLKSVKPQDKGNHLFKDFVLKLAALGEKRDEGDIKWNFTKFLVNRDGEVVERFAPSVTPEEIEADIRALL

SEQ ID NO: 14075 - protein, 164 aa, Cucumis sativus
GTADAVRQFIWLFEDAKTKNVEHTLILSGDHLYRRDYMDFVQRHIDTNADITVSCIPMDDSRASDYGLMKIDDTGRILDFAEKPKGSDLEAMQVDTTVLGLSDEDARKNPYIASMGVYVFRTDLLLKLLTWSYPACNDFGSEIIPAAVKDYKVQAYLFNDYWED

SEQ ID NO: 14076 - protein, 283 aa, Mesoplasma florum
MFESLGSLTNTKRRSTKMAYKEVTRDELSAAGVQYGHQTKRWNPKMAPFIYGSKSKNHVIDLEKTLIQLRQAEKLVQSIGAKGEKVLFVGTRRSAKLAVKEAALRSGNYYVNQRWLGGTLTNFKTIVKRIKALWEIEESEKNGQLALRTKKEQILILKEKANLEKSLGGIKQMRKLPAALIVVDPKSDEIAVKEAIKLNIPVIGLCDTNVDPDIVTLPIPANDDLQESVNIMINALVDAFADGANLKLAPSVLKTVVVKRERTEGENNYSNNRSWNKPERTNN

SEQ ID NO: 14077 - protein, 528 aa, Unknown
  marine gamma proteobacterium HTCC2143
MRLSTALNAVGVHQKVISDVKETINVVWFKRDLRINDHGPLLAASKLSLPILPLYVVEPDYWKKSFSSRRHWHFIHDCLTDLNTAVSSLGQPLVIKVGDVCAAIENIHSDYNVQGIYAHEETGNLWTYQRDINVRKICELNNIPIHEYPLNGVVRKLASRNDWSVIRTKRMVEKIREKPKELKPLQRYISDKLPPKDDPMFGEEFVGTVQNGGRNAAVDDLRGFLNHRSSGYLRHISGPRLSAVYCSRLSAHLAWGSLSVREVVQSVKKRQQQLNTDDKKRFGRNLTAFNSRLAWRCHFIQKIEDQPSIETHCMHPAFEGLRENDHNEERYQAWATGHTGYPFIDACMRNLIADGWITFRMRAMLVSFASYQLWLDWRVIGDHLARLFTDFEPGIHYSQLQMQSGVTGINAMRVYNPVKQSIEHDPNGDYIRKWVPELADLPIEFIHEPWTWGKNLIDDASCILGTVYSEPIVDNASAAKDAKEKLAEIQKSEQFHAISKTVYNKLGSRKKALRKMKKTPSEGQLTLF

SEQ ID NO: 14078 - protein, 321 aa, Haemophilus influenzae
MIKKIAVLTSGGDAPGMNAAIRGVVRSALAEGLEVFGIYDGYQGLYNNKIKQLNRYSVSDVINRGGTFLGSARFPEFKDPNVRAKCAEILRSHGIDALVVIGGDGSYMGAKLLTEEHGFPCVGLPGTIDNDVAGTDYTIGYQTALQTAVDAIDRLRDTSSSHQRISIVEIMGRHCSDLTISAGIAGGCEYIVASEIEFNREELIQQIERSIIRGKRHAIIAITELLTDVHSLAKEIEARVGHETRATVLGHIQRGGSPCAFDRILASRMGAYAVDLLLQGKGGYCVGIQNEQLVHHDIIDAINNMQRVFKADWLKVAKRLE

SEQ ID NO: 14079 - protein, 220 aa, Vitis riparia
MGRRPARCYRQIKNKPYPKSRYCRGVPDPKIRIYDVGMKKKGVDEFPFCVHLVSWEKENVSSEALEAARIACNKYMTKYAGKDAFHLRVRVHPFHVLRINKMLSCAGADRLQTGMRGAFGKPQGTCARVSIGQVLLSVRCKDGNSHHAQEALRRAKFKFPARQKIIVSRKWGFTKFNRTDYIKWKSQNRILPDGVNAKLLGCHGPLANRQPGKAFINACT

SEQ ID NO: 14080 - protein, 382 aa, Rhodobacter sphaeroides
MAKRDYYEVLGVSRTASADELKKAYRTKAKELHPDRNADNPQAEAQFKEVNEAYDVLRDADKKAAYDRYGHAAFEGGMGGGARAGGGYGQQGDFASAFSDVFEDLFGDFMGGRGGAPRSRAQRGSDLRYNLRVTLDEAYRGVQKTINVPASVACDACKGTGAEGGAEAVTCPTCSGMGKVRAQQGFFTVERTCPTCNGMGQIVKNPCKVCHGAGRVEKERSLSVNIPAGVETGTRIRLAGEGEAGMRGGPSGDLYIFIEVREHALFQRDGVHLFCRVPVSIAAAALGGEVEVPTIDGGSSRVKIPAGSQTGKQMRLRGKGMPALRGGGAGDMLIELAVETPVNLTARQKELLREFEKLSEDNNPEGKSFFSKVKGFWDGMTG

SEQ ID NO: 14081 - protein, 335 aa, Arabidopsis thaliana
IQRTSLLLLHLPEKMDLLFCFRPNQTCRGISVLPAFSISNLSAVNRFRSTTSLRFGFPATPFRRTPNFTFKTHAKRKNKTSTVEPKPNKVEELIIEEEEEGEEEIVLPEEIQENQDELLLDDEYDEDDDDDFEFDESEEELYAGDGGGGGGIKLAGTLWDKEALALAVKVCESFDGDLGIYAFKTLPNSTIQVRIERLTNKFGSPTMEDIEAFSTIYRAKLAEAELAKSIPDNISLEVSSPGVERVVRIPQDLDRYKDRPMYVRYTNEDTETEGDGIFRLVSFDVEAKICIWGIADIRVNREKAGKGRPLSKKQREWRLETAFESLRLVRLHSEC

SEQ ID NO: 14082 - protein, 456 aa, Picea abies
QYSGVTFYRRTGRWESHIWDCGKQVYLGGFDTAHAAARAYDRAAIKFRGAEADINFNHSDYEEDMKQMNNLSKEEFVHILRRQSTGFSRGSSKFRGVTRHKCGRWEARMGQFLGKKYIYLGLFDSEIEAARAYDRAAIRCNGAGAVTNFEPGLYQDELIAEGENGGDDHNLDLSLGMSAPTYSTVPLDEHKRTQFKSNKAESANYSEVPDWKKTRLLNTRTEDCNIQQTQLGQLFNVSPSSTGEKILSFQQLSNAEGGNNFTFLQPQHQVKCAISDKGDRQELINITDYNSVRHSRPSEDKTVNLFSEQAPGWSGIHSRSILNRNVPNNGNYDLQHDRNRRADGSIVSLLPPEKTPGWAWQLQAAATSLPAAPVFASAASSGFSPQIISAAVPSHDWLQKAGFHYVDQSIGRTSFTEKPKVAFQEDIPLGIDHLLSLSSGSTTTKFKALGLSRETK

SEQ ID NO: 14083 - protein, 303 aa, Streptococcus thermophilus
MLIHSISELIGHTPLIDLQINIPNHSHIYAKLEMFNPGGSIKDRLGQYMIQDAINRGQVTEGVTTIIEPTAGNTGIGIALAAQQHHLPTILVVPEKFSFEKQQLMKALGAKIINTPSDQGIKGAIEKAEALHNQTPNSFVPMQFKNPANPDTYYHTLAQELLDDLNDPIDAFVAGAGSGGTFAGVARYLKEHNPATQTIVVEPEGSILNGGPAHPHRTEGIGVEFVPPFFKDVQIDKTLTIADADAFHQVKELAKKQGLFIGSSSGAALAASLKVAKALPENSTIVTIFPDSSERYMSENIYD

SEQ ID NO: 14084 - protein, 837 aa, Solanum lycopersicum
MEMSTRRSNYTLLSQVADDNYLPPPPKYSVTGGGGGGGGVAPYYESHSGEKGKGKTGDNRGFDWDLSDHRSNMMQASNRIGAAAFPGSIGLQRQSSGSSFGESSISGEYYMPSLSNAEASFGYLNDGGGGAEVRMKPLEANLFGGSSSKSWAQQTEESYQLQLALALRLSSEATCADDPNFLDHVPDESASRASASAASAETLSHRFWVNGCLSYFDKVPDGFYLIHGMDPYVWIVCSDLQENARVPSIESMRAVDPSVVPSVEVILIDRRTDPSLKELQNRIHSLSPTCGTTKEVVDQLAQLVCSHMGGATSAGEDELVPLWKECSYELKDCLGSTVLPIGSLSVGLCRHRALLFKVLADAIGLPCRIAKGCKYCNRADASSCLVRFGPDREYLVDLIGSPGCLCEPDSSLNGPSSISISSPLRFPRFREVEPTTDFRSLAKQYFSDCQSLNLVFEESSAGAAVDGDAGQTDRNNIERNSAVTGPSNRDEVSRLPVPAIRDMAPVKYVRPVLHGDTQLSDPRDIGNDMRFLERGSQLVPSKISRDIALEIEDFDIPWEDLVLKERIGAGSFGTVHRADWNGSDVAVKILMEQDFHAERFKEFLREVAIMKRLRHPNIVLFMGAVTQRPNLSIVTEYLSRGSLYRLLHKPGAREVLDERRRLSMAYDVAKGMNYLHKRNPPIVHRDLKSPNLLVDKKYTVKVCDFGLSRLKANTFLSSKSAAGTPEWMAPEVLRDEPSNEKSDVYSFGVILWELATLQQPWSNLNPAQVVAAVGFKGKRLDIPRDLTPQVASIIEACWAKEPWKRPSFAAIMDMLRPLIKPPVTPPQPGRTDTQLIA

SEQ ID NO: 14085 - protein, 265 aa, Aspergillus oryzae
MEQSTQSASQQQGRQQPVYDTRNGGHYGASAALSAQGYAPVAELYTGTWANVNQGLQGTARDILTTYWQHIINHLESDNHDYKIHQLPLARIKKVMKADPEVKMISAEAPILFAKGCDIFITELTMRAWIHAEDNKRRTLQRSDIAAALSKSDMFDFLIDIVPREEATSHAKRSSQAAGAPSGAPGPTGAAGQLPPSQHGVQHPSHHMAPPDYSLGQHGLQDQEYRQPAMYAGPVQSDPTAAYGQPQSQMFEGMYAAYPHLPPQQ

SEQ ID NO: 14086 - protein, 571 aa, Oryza sativa
MRSHEMNNSSSRYASEEERGSNSFLIESEEEEEDEEAHPHSSILLKDADSDSDSDDSSCATPRPSSYATHQWPQSYRQSIDIYSSVQSPNLSFLGTPTLSRLSNSFLTNSFRGKTPEILSNLVKPLLRPSSSSDDQQQQQQHDDDTRKSSQYLLPSRKPSLQQIPEDQKPLVPAHEVPAYQQCSYTQAVMNGINVLCGVGILSTPYAIKQGGWLGLVILCLFAVLAWYTGVLLRRCLDSKEGLETYPDIGHAAFGTTGRIAISIILYIELYACCIEYLILESDNLSKLFPNAHLTIGSMTLNSHVFFAILTTLIVMPTTWLRDLSCLSYLSAGGVIASILVVVCLCWVGVVDHVGFENKGTALNLPGIPIAIGLYGYCYSGHGVFPNIYSSLKNRNQFPSILFTCIGLSSILFAGAAVMGYKMFGESTESQFTLNLPENLVVSKVAVWTTVANPITKYALTITPLAMSLEELLPPNQQKYANIIMLRSSLVVSTLLIALSVPFFGLVMALVGSLLTMLVTYILPCACFLAILKRKVTWHQIAACSFIIVVGVCCACVGTYSSLSKIIQNYT

SEQ ID NO: 14087 - protein, 838 aa, Agrobacterium tumefaciens
MPRGCAEVPLRTSPLRRSRGVITMTQKLVIIGNGMAPGRMLENLFETAPGLYDVTIFNAEPRVNYDRIMLSPVLSGEKSYEDIVIHNDEWYAANNVTLHKGAKVTRIDRANKIVTSENGITASYDRLVIATGSLPFIIPVPGHQLPGVLAYRDLDDVTKMLEIAKGKGRAIVIGAGLLGLEAAYGLKRQGMDVTVIHLMPTIMERQLDPAAAYLLEKALNERGIDIITKANTKCILGEEKVEGIELEDGRIIKGDMVVMAVGIRPASGLAKEAGIAVNRGIVVDDGMMTSDASIYALGECAEHRGMCYGLVAPLYESARVLADRLCGGSAEYHGSVTNTKLKVTGINLFSAGDFAEGDDREEIVLRDATAGVYKRLILKENRIIGAVLYGETADGSWFFDLMKKSTDISAMRETLIFGQAYQGGSPLDPMAAVAALPDDAEICGCNGVCKGKITSAITSKGLTSLDDVRAHTKASASCGNCTGLVEQLMTLTLGDTYNPAAVQPMCKCTDLGHDDVRRLIKAKGLKTIPAVMQELEWKTSCGCAKCRPALNYYLVCDFPDEYADDYQSRYINERVHANIQKDGTYSVVPRMWGGVTNADELRAIADVVDKFEIPLVKVTGGQRIDLLGIEKEDLPAVWADLGKAGFISGQAYAKGLRTVKTCVGEQWCRFGTQDSTGLGIRIEKFMWGSWTPAKLKLAVSGCPRNCAEATCKDIGVICVDSGFEIHFAGAAGLDIKGTEVLGLVHTEDEALEHIVALTQMYREQARYLERIYKWAKRIGYDEVRRQIMDDADKRKAYFDRFVFSQKFAQVDPWSERVSGHDKHEFRPMAAIGFSEAAE

SEQ ID NO: 14088 - protein, 283 aa, Oceanicola granulosus
MDSETPLPALDWPVFEPGWVWLCGAGPGDPGLLTLHALNALRQADVVVYDALVDQAILDWAPGAEHLYAGKRGGKPSALQRDISLRLVELARAGKRVLRLKGGDPFVFGRGGEEGQTLVQHGVPIRIVPGISAGIGGLAYAGIPVTHRDVNQSVTFVTGHDQSGEAPSSLDWAAISRGSQVIVIYMGIKHIARIAGALLDAGRPAGEPVAVVTEATTPGQKVLETTLGGLEADLAASGLEPPAIICVGRSVLMRQVLDWQAMATGAPARDLDPLKRGRPAESA

SEQ ID NO: 14089 - protein, 311 aa, Nostoc punctiforme
MKNEKWNTENILSQKGRVAIVTGSSSGIGYETARVLANKQASVIIAVRNLDKGNKALAKILQQNKDADVKVMELDLANLASVKNFAENFQKNYVRLDLLINNAGVMIPPYSKTTDGFELQFGTNHLGHFALTGQLLERLIDTEDSRIVNVSSGAHSIGKIDFDDLNWEKRSYAKWKAYGDSKLANLYFTYELDRKLKDKGIDTLVTASHPGWTATELQRTAGGVVKYLNGILAQDITMGALPTLRAATEAGLKGAEYFGPNGFMEMRGYPIKVESNELSKDQAIAKKLWEVSEKLTNVKFEFNKKTQSAGK

SEQ ID NO: 14090 - protein, 398 aa, Zea mays
MGKSGKKPRESHRQGRGRRASHFCDEDDYDLPSSAYDATPRQNEESSEDNDDTSEATAEDEPERDTEAGEQDQWQGSMPSKFHLYQLSVQSPKGDISYLQKFFLMYVGGRAPLHLQEDFCGTALLSTEWIRTDARRTAIGLDLDLESLEWCLENNLSKIGADGYSRMLLFHGNVLQPMESRLVKQKFTNLVHGLDLNSNNGTGSNSCKQMGLADSKCLANLTMSEADFPARDIICAFNYSCCCLHSRKDLVLYFRHVRSVLSERGGIFVMDVYGGISSERKLRLQRKFPSFTYFWEQDEFDIISRQTRISLHFQGGKKQMLRYAFTYHWRLWSIPEIKDCLEEAGFKWVHVWMREMPNTQSGGNAKEYNANRDVKYEESQHFNQGDAWNAYVVGVANV

SEQ ID NO: 14091 - protein, 275 aa, Bacillus cereus
MELWFTEKQTKHFGITARINRTLHTEQTEFQKLDMVETEEFGNMLILDGMVMTTEKDEFVYHEMVAHVPLFTHPNPENVLIVGGGDGGVIREVLKHPSVKKATLVEIDGKVIEYSKQYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVIEERFHEIETKYYTKELHNAAFALPKFVGDLIK

SEQ ID NO: 14092 - protein, 903 aa, Agrobacterium tumefaciens
MWGRCPAGQRGVSVIRREGNSMPAETKTTCPYCGVGCGVIATVNDSGVVSVKGDPDHPANFGRLCSKGSALAETIDLDGRLLHPEIAGRRAAWDEALDLVASRFSDAIAEHGPDSVAFYVSGQLLTEDYYLANKLMKGFIGSANIDTNSRLCMSSSVAGHRRAFGADTVPGTYEDMELADLVILTGSNLAWCHPVLYQRLAAAKAARPGMKVVVIDPRRTMSADIADMHLAIRPDGDVALFTGLLAHLFASSAIDRGYVENHTAGFEAATQAASEHSLPEIAEATGLTIAELIPFYELFERTEKTVTCYSQGVNQSESGTDKVNAIINCHLATGRIGRPGMGPFSLTGQPNAMGGREVGGLANMLAAHMSIENADDRDRVQRFWASPAIAQKPGLKAVDMFRAVADGRIKALWIMATNPVVSMPDAGAVEVTIKACPFVVVSDVMANTDTARHAHVLLPSLGWGEKDGTVTNSERRISRQRSFLDAPGEAKADWWQMAEVARRMGFDAAFAYQQPSEIFAEHAALSGFENAGRRDFDIGGIERDSYETMAPVQWPKAGAGEAEVTRFFANGRFYHADGKARFIATALPETDRTSADYPLTLNTGRIRDQWHTMTRTGKSARLTAHIAEPFAEIHPRDAQALGIKSADLVELESPHGKVLLRALVSERQARGSVFAPMHWNDQFASRARIDVVVAPVTDPHSGQPASKNVGVRVTRFEASAYGFAICRSRPDAPDCAYWAVAKAEGGYRMELAFAEAPEDWTLWARRVFGIDVRIEPLGYSDRQTGDLRLAFFDGDTLLAALFIAREPVAVARNWAISQLSERHEDLRMRFALVAGRPGAGRADPGATVCSCFNVGVNQITAAIREGCHSVEAIGNALNAGTNCGSCRAEIRGIIDGCLKTAAE

SEQ ID NO: 14093 - protein, 488 aa, Agrobacterium tumefaciens
MDALKPQRNEPARMERLAKLPVFWGLEGKRVVLTGGSDGAAWKAELLLACGAQLDLYCEESGLSESLATLVAKSPMLTWHDRCWDADIFKGAELALADCEAEEEAGRFYHAARAAGVPVNVIDKPEFCQFQFGSIVNRSPVVVSISTDGAAPILAQAIRRRIETLLPLSLKDWGALAQTIRERVNLRLAPGAARRSFWEKFVDRAFTERLDEGSEERLLKDVATRTGLAESGRGFVTLVGAGPGDAELLTLKAVRALQAADVILFDDLVSAEVLELARREAKRMLVGKRGGRESCKQEDINDMMIRFAKAGRRVVRLKSGDPMIFGRAGEEIAALEAENIPVEVVPGITAASAMASRLGVSLTHRDHAQSVRFVTGHSRQGKLPENIDWQSLSNPSVTTVFYMGGRTAADIQSCLLAHGMPASTPVVVMISVSRVNEQRWCGSLAQLVAAVERLGVNEPVLIGVGDAFRSASVNGGEQTAAAPFQKAG

SEQ ID NO: 14094 - protein, 435 aa, Oryza sativa
MALPCAFLSAAAAANATSFSSSPESRRCRSVHRVPSRPRPPLAPPARVMGKGNSKRKAANTRLWMRLDRRGGCEMILCDKSFVARRSGLPARDLRVLSPLLSRSPSILAREKAMVINLEFVRAIVTADEVLVLEPLAQEVLPFVEKLRKHFPLKSLDVDDVSTHMHTENQDGELAQDVSCYEVEGANHELPFEFQVLDFALEAVCLSYNSTISDLNRSAIAVLDDLMKSVSTRNLERVWSLKSSLTRLLASVQKVRDEVEHILDDNEAMAHLCTARKTKGQKDLLNTILFPETRLCRTHSSIENSTGIRTCVPSDSDAHILDMLLEAYFKQLDGIRNRIFLVRQYIVDTEDYISIQLDNKRNELLGLQLTLIIASFGIAINTFIAAAFAMNIPHRGYHFVIGVPFGQFVGATSFLCMSIVILLFTYAWRNRLLCT

SEQ ID NO: 14095 - protein, 159 aa, Vibrio angustum
MTKIYDFYVKALSGEVLSLSDYEGKVLLVVNTASKCGFTPQYEALQALYEKYRDQGLVILGFPCNQFGGQEPGEESQIKQECLINYGVTFPMFSKVDVKGRDAEPLFSYLVKQLPGLLGNDIKWNFTKFLISREGEPMKRYAPTTKPFAIEDDIIKLLS

SEQ ID NO: 14096 - protein, 164 aa, Triticum aestivum
  misc_feature (84)..(84): Xaa can be any naturally occurring amino acid
  misc_feature (108)..(108): Xaa can be any naturally occurring amino acid
  misc_feature (117)..(117): Xaa can be any naturally occurring amino acid
  misc_feature (134)..(134): Xaa can be any naturally occurring amino acid
  misc_feature (136)..(136): Xaa can be any naturally occurring amino acid
  misc_feature (143)..(143): Xaa can be any naturally occurring amino acid
  misc_feature (148)..(150): Xaa can be any naturally occurring amino acid
  misc_feature (152)..(153): Xaa can be any naturally occurring amino acid
  misc_feature (159)..(159): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSXKWVPCLEFKQGWVIFREQNASPGXYYDGRYWTXWKLPMFRMNRRNQVINXVXEAKKEYXDAMSXXXGXXKCVRVXCVSSP

SEQ ID NO: 14097 - protein, 854 aa, Vibrio parahaemolyticus
MSKLKLVVIGNGMVGHRYIEDLVEKADVSQMDITVFCEEPRVAYDRVHLSSYFSHHTADELSLVKEGFYEKHGINMLIGERAININRENRIVYSSTGREVQYDKLILATGSFPFVPPIKGHESKDCFVYRTIEDLKAIEACAKKSKSGVVIGGGLLGLEAAGALKALGVETHVVEFAPKLMAEQLDLAGGNQLRQKIERMGVNVHTSKNTLEIAAEGKNARNVMRFADGTELETDFIVFSAGIRPQDKLARQMELELGPRGGVAINDHCQTSDENIYAIGECASWNEMFYGLVAPGYKMATVAVDHLLGNTESKFEGADMSAKLKLLGVKVGSIGDANGRTEGCKSYVYQNEEQEVYKRLIVSEDNKKLLGAVLVGDTSDYGDLLQLMLNEIDLPEHPDALILPAHAGAEKPALGADALPESAVICSCFDVTKGKIAQAVADGHHTLGDIKAVTGAGTGCGGCIPLVTSVLNAELAKSGIEVKNDVCEHFAYSRQELFHLIRIEEIKTFDELLEKYGKGYGCEVCKPLAGSILASCWGEHILKPQLVKLHDTNDNFLGNIQKDGTYSVIPRMAGGEVTPQALGALANVAAEYNLYTKVTGAQRIGLFGAQKDDLPEIWRKLIDAGFETGQAYAKALRMAKTCVGSTWCRYGVQDSVGLGSYIENRYKGIRTPHKMKFGVSGCTRECAEAQGKDLGIIATDAGWNMYVCGNGGMKPRHADLLASDLDKETLIKYIDRFMMFYIRTAAPLQRTSVWMENMEGGVDYLRAVIVEDKLGINAQLEADVAKLVDEYECEWTATINDASQLTRFAHFINSDKRDDNVVFVQEREQHRPATFTEKHPEAKGDILHVAITEA

SEQ ID NO: 14098 - protein, 197 aa, Brassica napus
MQSDSGKLFIGGISWDTDEERLKEYFSSFGEVIEAVILKDRTTGRARGFGFVVFADPAVAETVITEKHNIDGRLVEAKKAVPRDDQNTVTRSNSSSLQGSPGGRTRKIFVGGLPSSITESDFKTYFEQFGTTTDVVVMYDHNTQRPRGFGFITYDSEEAVEKVLLKTFHELNGKMVEVKRAVLRVVSSQLAEAPRGC

SEQ ID NO: 14099 - protein, 300 aa, Zea mays
DFDATTIATRIFTVDKSISHILGGVMFSGLGLWHLFNHITLFVSHASTSSSSYVAPAWFPAPRVRDLELIVMLAGGVCGLATQMLAYSPMPFNADGSIPPERLPNHEHAIMYASLLVYAGSAISLDRRHGRHRHDTLCMLLLAALFAQELFVFHVHSTDHAGVEGRLHWFLQAAAATCLATVLLGAGRLPAELQFAGCSLEDGGVNLRCDGDDDSLRHAIAVINLQFGWCMVLVTLFVLGLYVHVCKKYPAGDGEVIYGRLPEAEAADEDDDHHNMMKTCNCNCKQAVHDVHEFTSMEIE

SEQ ID NO: 14100 - protein, 680 aa, Aspergillus oryzae
MAAQFTEENVQELKFRLEDATIKCSERCLYQSAKWAAEMLDAIVPIDQYDTDPESPMDIPDTPSTRPNPYLRTQDPVEASLEAQESYKYLLAKSYFDTREYDRCAAVFLPPTIPPVALSTSSPNQKKRQSLTPQKGKSKSSQYAGGKDSNVSRNPYPRLSQKSLFLALYSKYLAGEKRKDEETEMVLGPADGGATVNRELPDLARGLEGWLTERREKGLEDRNQGWLEYLYGVILLKGRNEEEAKKWLIRSVHLNPFHWGAWQELNDLLSSTEDLKQVVDLLPQNIMTLLFHVYCSQELYQATEDTYQALSELETIFPNSAFLMTQRALLYYHSKDFEEASRIFTEILIASPHRLDSLDHYSNILYVMGARPQLAFVAQVATATDKFRPETCCVIGNYYSLKSEHEKAVMYFRRALTLDRNFLSAWTLMGHEYIEMKNTHAAIESYRRAVDVNRKDYRAWYGLGQAYEVLDMSFYALFYYQRAAALRPYDPKMWQAVGSCYAKMGRVPQSIKALKRALVAGSYYAEDPSQLGGSGRKILDPETLHQIATLYERLGDDEEAAAYMELTLQQESGQMPVEEDASSDNENDDNQSEAGAQKSSRRARQSSTYNQNDDDDDSWHGTGPTVTTSKARLWLARWALRNGDLERADQLAGELCQDGVEVEEAKALMRDVRARREGDE

SEQ ID NO: 14101 - protein, 478 aa, Arabidopsis thaliana
MASFGENLNASQFYITLCDDLDCLDGKYTVFGKITSGFETLTCIAKASVDAKNRPNKDIRIRHTYILTDPFDDPPQLAKMIPDEPYSARIKKVEKEINELAEKICNLGIKESDTGLAPPNQWDLVSDKQMMQEEQPLLVATCTQIISPNTEDAKYVVDIKKIGKYVVGLGDKASPTDIEAGMRVGVDQKKYQIQIPLPPKIDPSVTMMTVEEKPDATYSDIGGCKEQIEKIREVVELPMLHPEKFVRLGIDPPKGVLCYGPPGSGKTLVARAVANRTGACFIRVVGSELVQKYIGEGARMVRELFQMARSKKACILFFDEIDAIGGARFDDGVGSDNEVQRTMLEILYQLDGFDARGNIKVLMATNRPDILDPALLRPGRLDRKVEFCLPDLEGRTQIFKIHTRTMSCERDIRFELLAGLCPNSTGADIRSVCIEAGMYAIGARRKSVTEKDFLDAVNKVVKGYQKFSATPKYMAYYI

SEQ ID NO: 14102 - protein, 759 aa, Streptococcus pneumoniae
MYNYPMRIHYHRKNGEYDTCSFVKSQDQRIDLLTYKEDYFGALFSFEHPSSHVIESLNFVVHTGQTSKEYSIRFNHYPLLTEVWILEGDDRIYYSENPAIASPFYKNQNPFAFDKAINSASFDHHWGYQGELGCRVEDNQAHFSLWSPTATEVQVVVYESAANDAPVWKTFEMKRGNSYSYNHKDNTIGVWSLDVEEDLVGKTYQYQVQFPHHQTLTRDPYTIATSPDGKRSAILSHVEKQVENFEVKHGSEATWRLENPCKAVICEMHIRDLTKSPTSGVDEHLRGTFLGAAQAGTVNQYGQSTAFDYIKKLGYNYVQLQPIADRHKEYDEDGNVTYNWGYDPQNYNAPETSFSTNPDDPAQVIRDLKVMVQAYHDAGIGVIMDVVYNHTFSVVDAPFQTTVPDYYYRMNPDGTFQNGTGVGNETASEHEMFRKYMIDSLLYWVQEYNIDGFRFDLMGIHDVKTMQMIRQSLDEIDSNIILYGEGWDMGTGLAPYDKAKKDNAYQMPNIGFFNDNQRDAVKGGEVYGAIKSGFVSGAATEPILAKAILGSRELGSYTHPNQVLNYVEAHDNYNLHDLLATLHPDQSSEQIMRKVETATAMNLLMQGMAFMEIGQEFGRTKLVATGENGELTHDDRERAMNSYNAPDSVNQVNWNLINERQDSIEFIRQVIRLKTKTGAFSYSSYDEIYHHVFVHSAIEHSGCLIYEVHGKEHLLVVVNAKSEPYQFENAGNLAMLVTNSRSKEDNVLNDISLAVLSVL

SEQ ID NO: 14103 - protein, 338 aa, Mesorhizobium loti
MQIGMMGLGRMGANMVRRLMRDGHECVVYDINPASVAALVSDGALGAASLTEFVGKLAKPRCVWLMLPAAITGKIIDQVSALMEPGDIVIDGGNSYYHDAVNQAAKLAAKGIHLVDVGTSGGVWGLERGYCLMIGGPDVAVQHLDSIFATLAPGADAGAPAPDKAAGTAPFGYLHCGPSGAGHFVKMVHNGIEYGVMAAYAEGMNILKSANAGKRQRTADAETSPLENPQYYQFDIDLPQVAEVWRHGSVIGSWLLDLTAGALKSDPGLAQFGGRVSDSGEGRWTLKAAIDTGVPAPVLSSALFDRFSSQGESEFADKLLSAMRYAFGGHVEKPKAGK

SEQ ID NO: 14104 - protein, 510 aa, Unknown
  Synechococcus sp. WH 5701
MPPFSPLQVRVLLATAALSSSVGLVLELMLVTQASYLLGDVALATGMVIGTFLAAMGLGAWLSQFVGGGERPQQRLLSAFLLVELCLSPLCLLGPLALFALFSVDGPLWLALVVVTVLVGVLGGMEVPLLTRLLESQQHLRKALARVLALDYLGALLGSLLFPLLLLPRFGLLPTAGLLAMMPLISSAVLCWVFPGCRRWRWPVSGALPLAALAAWALVPLGNRIEDGLYDDPVVGRVQSRHQRIVLTSRRGDLRLFLDGNLQFSSLDEYRYHEALVHPALALHGRPERVLLLGAGDGLAAREILRWPGVRRLDLVELDPQMLQLARAHPFLRRLNQASLDDPRVQTHIGDAFELVRRLPGPYDVVIADFPDPDSPALARLYSVTFYGRLLGRLAPAGLLVTQASTPFFTPKVMASIQATMAELDLVTRPYSVDVPSFGPWGFVLAHRPGRPLQVATPPFEGRWFDRAQLETLFVLPRDLRPPGDAVVLPNRLTRPVLDGYQRQSLWRQD

SEQ ID NO: 14105 - protein, 487 aa, Ustilago maydis
MPMIPPALRRTQAAATPTTSSPAASSSTTATLDSQSLCALPRIRVSASTLNSIVTPVKKITSETDVEAWKASAAYSIYTLFLQRVCEACVGKPTRLPTRSTDAPVTPVDKLVSLLWELDSWTQEIEPHEKPQRFGNLAFRDWGARLEERIDSLLSDLLPSRLHAFAVELRVYLLDSFGSFTRIDYGSGHELAFFAWLCFLYRLGFFDASEEQEQDETLADIQVEERIGLDIFPLYLMVVWKLQDRYGLEPAGSHGVWGLDDFQFLPYVIGAAQLRRQSGLRPNQVIGASSHASILQTQLATRTDPASLISTTLVLPASSLVGTQVEVPLPNLYLSSLLRIHVLKRGPFHEHSPLLNDIASSVPNWLKVYFGMLKMYAAECLAKKVVVQHFAFGGVGWVWTHQAHSELPRLATPSAPVAARRHLPLGGIQGNMTSMGVPTPRITRPPATPDSFDHPLRLPPRSTPSRPSTTPSVPPLAASTRPAPKPE

SEQ ID NO: 14106 - protein, 255 aa, Pyrococcus horikoshii
MGKMLREVTITRAIVESYYRDLLNNLELDVAIVGAGPSGMVAAYYLAKGGAKVAIFEKKLSIGGGIWGGGMGFNKVVVQDEAREILDEFGIRYEEFEKGYYVADAIEVATTIASKVVKSGVKIFNMIEVEDLVIKDNRVSGIVINWTPVLMAGLHVDPLTIEAKYVIDSTGHGAQVAQFLVKRGLLKEIPGEGAMWAEQGEKLTVKNTREVFPGLYVTGMAANAIAGAPRMGPIFGGMFLSGRKAAQEILKKLKS

SEQ ID NO: 14107 - protein, 220 aa, Triticum aestivum
  misc_feature (24)..(24): Xaa can be any naturally occurring amino acid
  misc_feature (51)..(51): Xaa can be any naturally occurring amino acid
  misc_feature (90)..(90): Xaa can be any naturally occurring amino acid
  misc_feature (96)..(96): Xaa can be any naturally occurring amino acid
QGPWSTLEDVAMTGLEQEKAFCFXFKPSVDGYKSCAKEMTKLSGISEIIPXEMEICDFDFEPCGYSMNAIHGSAFSTIHVTPEDGFSYAXYEVMGXDPASMAYGDLVKRVLRSFGPSEFSVAVTIFGGRNLAGTWGERLNVGVYDSTNMVVQELPDGGALIYQSFTAVGEDSTGSPRSVLNCNVHGNLESGSKMDAFLCWEDDAAQEKDERGAVKRMKSC

SEQ ID NO: 14108 - protein, 431 aa, Escherichia coli
MVSLEKNDHLMLARQLPLKSVALILAGGRGTRLKDLTNERAKPAVHFGGKFRIIDFALSNCINSGIRRMGAITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKVTEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 14109 - protein, 63 aa, Protea mundii
  misc_feature (30)..(31): Xaa can be any naturally occurring amino acid
MPGQWEYQVGPSVGIEAGDHIWCSRYLLEXXTEQAGVVLTLDPKPIEGDWNGAGCHTNYSTKS

SEQ ID NO: 14110 - protein, 702 aa, Unknown
  Candidatus Protochlamydia amoebophila UWE25
MEYYLMQRETISVPVGAQEIIFETGKIARQAGGAVVVRCGETVVFTTACAAPNADSTTDFLPLRVDYQEKFSSAGKTLGGFIKREGRPTEKEVLVSRLIDRPIRPMFEEGYYNEVQLLSFVWSYDGINSPEPLAICGASAALVISDIPLIKPVGAVRIGFIDAQFIVNPTIEQQKQSKLDLLIAGTEEAVLMIEGFCDFLTEDQVLEAIEIGHRSIKTICQTLEQWRAKVGKPKNRETLRQLPKELYADVESIANPLLEKALRICEKQKREEALAEVTKAVNDRLMPENEEPKYPAKHIAYVIKDVSSKMMRQMILNENVRSDGRTSTDIRFIDIEQSLLPRAHGSSLFTRGETQALAVCTLGGASMAQRFEDLEGEGNNRFYLQYSFPPYSVGEVGRVGAPGRREIGHGKLAERALMAVIPTKEQFPYTIRLESNITESNGSSSMATVCGGCLALMDAGVAIKRPVAGIAMGLILENERFIILSDILGIEDALGDMDFKVTGDQNGITAFQMDIKVEGITIEIMRVALKQAKEGRVHILNKMLAVCPTYKGEMSRYAPRIETIQIKPSKIAVVIGPGGKQIRAIIEQTGVQIDIDDTGLVNIAAIDLVSIEKAKAIIHGLTAEIEIGRIYSGKAISIAPFGVFVEILPGKEGLCHISEFDVNRINSLDEFVKQGDMLMVKVLDINERGQIKLSRKATLQSQ

SEQ ID NO: 14111 - protein, 257 aa, Prototheca wickerhamii
MSQNIKKIIKLEDMVQSGMHFGHFTSEWNPRMQPFIYGKRHGRHILDLVQTYYLLNNLLAFLEKSAMQGKKFLFVGTKKQIAPLIAKTAISCNSYYVNQRWLGGMLTNWKTIQNSLYQLQEFRKAEQLGEWNLLKKKEIAQKKRQKLRLDKNLSGLENMKSLPDIVIIIGQAEELNAVKECRQLGITTVTLLDSNCDPFLADWYIPANDDSVAAVQYLLSNFKEAIISGQKTNNANQSLVNAKSNIKKLGRAKAKKT

SEQ ID NO: 14112 - protein, 739 aa, Ustilago maydis
MSTERQASGLGPSMTASSPRAHHSQAVPRDMQRPVKSEASASQPPPASPDRKRPRYEPALASRGTAEEELDELEESEDTTKRPRGESDEPKFERKGSGPESISRSSSAAAHHAHWAGRSASANLDSRYHQQQQQQQQQQQQQQQQQQQQQQQQQQQQQQQQQQQQQQQQQQQQQHQQHRGRQGIDSGGAQEPRRYEFERPHPSRYDPGPGVREDGRHIGGLVGERYGGEADRESRGRFAMEGKMEYNSSTTRMPPPGAGDHPNLPPGFRNRPSSPPPRLPGFASLEHEGLGHRAREDGVMGGAYASSPRRSIPFHGPSYGNYALPPSRTPLMHHHPSPTPSTSYGNPPMIHPALAGLPGAGGGPGGKQQPSFVSKLYSMLEDPSIADLISWGSSGTVFSVANPAEFSRLVLPNWFKHSNWQSFVRQLNMYGFHKVNHSYQGNPTDEVQVWEFRHPSFRRGEIALLHDIKRKSSRQKRGGSPRGSIGGADMRADRSGGSSTPSPEVPLATIPGHDGMRIMGGMGPGGHRGGREFAYGDDRMDGHAYVDRREMRGYAGERDYSASGPRGIPADEYGYMRGGKMEGQLGITTGGPGAGAGMGPPFAPGSDENARRAVEPIMERAEAMGRFEDLSERTDAIIRHASFLESQIRLLTDQLIDARAFTESAVRDEMILMLDRLERALSSPTPPGVDPTAKMVEVLRGQLSYYSHRSAGPNDRVNKPPAPTGSAVGTGTDPKRPSV

SEQ ID NO: 14113 - protein, 65 aa, Protea cynaroides
MPGQWEYQVGPSVGIEAGDHIWCSRYLLERITEQAGVVLTLDPKPIEGDWNGAGCHTNYSTKSMR

SEQ ID NO: 14114 - protein, 786 aa, Ehrlichia ruminantium
MLLGHENFDSLLDTDPLSHDTQESTDFIDEKSSNEFEESKELVDHKDTIESIPDVDHTSDAFGKELDVPQTSDQELIDMNAEGNSSVNVLSDQYQDTASELSSSESSDGTESRGSESDDQVLEPELQANTYYATDNEVLDVASLELGLPGVAVGNVEPVQEGSETKPEAVEVEGNESEGVVNVTEEHSDSAASSESIDKESSEDSQLDQTSMEEQDKVEEFERDSNAEDTSVDKEVSEKPDIVEPAPEDSGTKPEAVEVEGNESEGVVNVTEEHSDSAASSESIDKESSEDSQLDQTSMEEQDKVGESERDSNAEDASIDGKEVRGKPDIVEPAQEGSETKPEAVEVESNESEGVVSVTEEHSDSAASSGNIDKESSEDSQLDQTSMEEQDKVGESERDSNAEDASVDKEVSGKPDIVEPAQEGSETKPEAVEVESNESEGVVDVTEEHSDSAASSESIDKESSEDSQLDQTSMEEQDKVGESERDSNAEDTSVDKEVSEKPDIVEPAQEGSTEEESTSVLDEDSKRDVEESEEEGHDTSSDEGTEVDEVDSDGDSADVEKGSNDTLENDLEAEESKVELTEELAVKDMPEESVTEGHGMKKASVVTDDMSEGLAAVHQVDSGKEFKLQEKMGLEGAQSIHIPKSLKSEEKDAVSKKSSTAKKTESTDSKDNAKEKKGTSTSNKTKKTSLPKIMSGVKILVNQYAKQISTGLSESFDKFFEDTESKKRGKRKLSKEDIESMVRDLEQLLVSLKDKKSKLTDPSEIANIEDDIRKLESTIKSILDNQ

SEQ ID NO: 14115 - protein, 793 aa, Solanum lycopersicum
MEVPVRRSNYAILQQQPPYDEFNSDEKSKSRGDKGLYWDLIDRRKGTTPFQASIVLPTQSSEGSFAESSISGVSFGYMNAYSDVGGSLSKSWAQQTEESYQLQLTLALRISTEATCADDPNLLDYVPDESVSHASASSASVEAMSHRFWVNGSLSYFDKVPDGFYFIQGMDPYIWTVCSDLQESGRIPSIESLMAVDPSVVPSVEVILIDRQSDPRLKELQNRIHSMYRSCNTTKEVVDQLAKLVCNHMGGAASVGEGDFIPIWKECCNDLKDCLGCFVFPIGSLSVGLCRHRTLLFKVLADIIDLPCRIARGCKYCKESDAFSCLVRFGLDREYLVDLIRDPGCLYEPNSLLNGPSSISIPSPLRLPRFGQVEPAMDFTSFAKQYFSDCLSLNLAFDDSSAGTAVDGDAGQTDRSSMDKSSAVPSSSNRDEVSRLPLPSINAWNKGCDKGSQLPAKYHPPNMSISMSQEKDLIHLKNVPPIRYVDAHLIAISEARTDTINDQRYFEGVGRLAPAKPSRGLVLDVEDLDIPWNDLVLKERIGAGSFGTVHRADWNGSDVAVKILMEQDFHAERYKEFLQEVAIMKRLRHPNIVLFMGAVTEPPNLSIVTEYLSRGSLYRLLHKPGAREVLDEKRRLCMAYDVAKGMNYLHKRKPPVVHRDLKSPNLLVDTKYTVKVCDFGLSRLKANTFLSSKSAAGTPEWMAPEVLRDEPSNEKSDIYSFGVILWELATLQQPWSNLNPPQVVAAVGFKGMRLEIPRDLNHPVTTIIEACWVNEPWKRPSFSTIMDMLKPLI

SEQ ID NO: 14116 - protein, 178 aa, Erwinia carotovora
MMKHTVEVMISEQEVMARVTELGQQISEHYRDSGSDMVLVGLLRGSFIFMADLCRAIDVPHEVDFMTASSYGSGMNSTRDVKILKDLDEDIRGKDVLIVEDIIDSGNTLSRVREILQLREPKSLAICTLLDKPERREVAVKVEWVGFSIPDEFVVGYGIDYAQHYRHLPYVGKVVPQE

SEQ ID NO: 14117 - protein, 46 aa, Unknown
  marine gamma proteobacterium HTCC2143
MLTLLGNRVPIALKTFLVSLAVIDNLGAIVIIALFYTADLSVVSNE

SEQ ID NO: 14118 - protein, 134 aa, Brassica juncea
NQDTQSCMDPNVMEAKIVVSSCGHDGPFGATGVKRLKSIGLIDHVPGMKALDMNTVEDAIVRLTREVDLDMIVTGMEVAEIDGAPRMGPTFGAMMISGQKAAHLALKALAQPNVIDGSYVGELSPELVLAAPDS

SEQ ID NO: 14119 - protein, 97 aa, Triticum aestivum
  misc_feature (6)..(6): Xaa can be any naturally occurring amino acid
  misc_feature (13)..(14): Xaa can be any naturally occurring amino acid
  misc_feature (30)..(30): Xaa can be any naturally occurring amino acid
  misc_feature (36)..(36): Xaa can be any naturally occurring amino acid
  misc_feature (38)..(38): Xaa can be any naturally occurring amino acid
  misc_feature (40)..(41): Xaa can be any naturally occurring amino acid
  misc_feature (43)..(43): Xaa can be any naturally occurring amino acid
  misc_feature (46)..(46): Xaa can be any naturally occurring amino acid
  misc_feature (48)..(50): Xaa can be any naturally occurring amino acid
  misc_feature (52)..(52): Xaa can be any naturally occurring amino acid
  misc_feature (54)..(56): Xaa can be any naturally occurring amino acid
  misc_feature (60)..(67): Xaa can be any naturally occurring amino acid
  misc_feature (69)..(70): Xaa can be any naturally occurring amino acid
  misc_feature (72)..(75): Xaa can be any naturally occurring amino acid
  misc_feature (77)..(79): Xaa can be any naturally occurring amino acid
  misc_feature (81)..(96): Xaa can be any naturally occurring amino acid
MEVKLXNDKRERXXLESLADLYAIIKATEXLERAYXRXLXXAXDYXAXXXKXIXXXNCLXXXXXXXXTXXAXXXXYXXXCXXXXXXXXXXXXXXXXF

SEQ ID NO: 14120 - protein, 458 aa, Staphylococcus epidermidis
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFVFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 14121 - protein, 287 aa, Erwinia carotovora
MSQKEIWYETLHANFGQYFSVDRVLYHEKTDHQDLIIFENDALGRVMALDGVVQTTERDEFIYHEMLTHVPLLSHGNAKRVLIIGGGDGGMLREVSRHHGVEQITMVEIDAGVVEFCRQYLPNHSAGSYDDPRFNLVIDDGVNFVRQCSEKFDVIISDCTDPIGPGESLFTSDFYQGCARSLNEGGIFVAQNGVCFLQQDEAIGSHKKLSHYFNDVSFYQAAIPTYYGGIMTFAWASNNPALRQMDIVTLRQHFAQSGITCRYYTPDVHIGSFALPQYLLSALQNAQ

SEQ ID NO: 14122 - protein, 286 aa, Alkalilimnicola ehrlichei
MRRDDNWFTEVLEEEGMAFSLRVREKLHEERTAFQHIEVYETEAWGRLLVIDGCVMLTSRDNFVYHEMMSHPALFTHPDPRRVAIIGGGDCGMLREVLKHPGIESVVQVDIDAGVTRAAERYFPELTEANDDPRATLLFDDGVAWIQDQPAGSLDVVIVDSTDPVGVAEGLFGPGFLGQVYRVLGDQGLMVQQSESPILHRDTILERLHGHMRGSGFAPVVTLPYPVVSYPSGWWSATLASKGPHPAAFRESDARAKAFATLYYNADIHRAALAAPEFCKGLLTDQ

SEQ ID NO: 14123 - protein, 465 aa, Alteromonadales bacterium
MSHLAISELLKGNVAVDSQVTIKGWIRTRRDSKAGISFLAVHDGSCFDPIQAVVPNSLNNYDEVTSLTAGCSVSVTGVLVQSAGKGQSFEIQANTVTVLGWVENPDSYPMSAKRHSIEYLREHAHLRPRTNMIGAVTRVRNCLAQAIHRFYHEQGYYWISTPIITASDCEGAGEMFRVSTLDMQNLPRTDKGDVDYSEDFFGKEAFLTVSGQLNGETYASAMSKIYTFGPTFRAENSNTSRHLAEFWMVEPEVAFADLEDIAKLAENMLKYVFKAVLEERRDDMEFFAQRIEKTAISRLEEFVEKDFAQVDYTDAVEILKNCGKKFEFDVEWGVDLQSEHERYLAEEHFKAPVVIKNYPRDIKAFYMRQNEDGKTVAAMDVVAPGIGEIIGGSQREERLDVLDARLEEMGLNKEDYSWYRDLRKYGSVPHSGFGLGFERLVAYVTGMGNVRDVIAFPRTKGSATY

SEQ ID NO: 14124 - protein, 258 aa, Unknown
  Candidatus Desulfococcus oleovorans Hxd3
MELNEVTISRAIIDRFYEKLIANLEVDVAVVGGGPSGLVAAWRLARAGRKVALFERKLSIGGGMWGGAMLFNEIVVQKSALHVLDAMEIGYRLYAEDYYTADAVEAISTLTSQAAKAGVAIFNCVTVEDVMIRPDRIVGLVLNWSPVEMAGLHVDPLAMRASFVIDATGHATEVVHVVAKKVPGTLRTDSGKIEGEKSMWSDRAESLTLENTREVYPGLYVAGMAGNATFGGPRMGAIFGGMLLSGEKVAAEILERLE

SEQ ID NO: 14125 - protein, 998 aa, Lactococcus lactis
MAMMTMIDVLERKDWENPVVSNWNRLPMHTPMDLLEKQSLNGLWNFDHFSRISDVPKNWLELTESKTEIIVPSNWQIEFKDKSDVPIYTNVTYPIPIQPPYVPEANPVGAYSRYFDITKEWLESGHVHLTFEGVGSAFHFWLNGEYGGYSEDSRLPAEFDISNLAKEGQNCLKVLVFRWSKVTYFEDQDMWRMSGIFRSVNLQWLPDNYLLDFSIKTDLDEDLDFANVKLQAYAKNIDDACLEFKLYDDEQLIGECHGFDAEIGVVNPKLWSDEIPYLYRLELTLMDRSGAVFHKETKKIGIRKIAIEKGQLKINGKALLVRGVNKHEFTPEHGYVVSEEVMIKDIKLMKEHNFNAVRCSHYPNDSRWYELCDEYGLYVMDEANIETHGMTPMNRLTNDPTYLPLMSERVTRMVMRDRNHPSIIIWSLGNESGYGSNHQALYDWCKSFDSSRPVHYEGGDDASRGATDATDIICPMYARVDSPSINAPYSLKTWMGVAGENRPLILCEYAHDMGNSLGGFGKYWQAFREIDRLQGGFIWDWVDQGLLKDGNYAYGGDFGDKPNDRQFSLNGLVFPNRQAKPALREAKYWQQYYQFELEKTPLGQVFAFTVTNEYLFRSTDNEKLCYQLINGLEVLWENELILNMPAGGSMRIDLSELPIDGTDNLFLNIQVKTIEKCNLLESDFEVAHQQFVLQEKINFTDRIDSNEEITLFEDEELLTVRSAKQKFIFNKSNGNLSRWLDEKGNEKLLHELSEQFTRAPLDNDIGVSEVEHIDPNAWLERWKGIGFYELKTLLKTMIIQATENEVIISVQTDYEAKGKIAFSTIREYHIFRNGELLLKVDFKRNIEFPEPARIGLSLQLAEKAENVTYFGLGPDENYPDRRGASLFGQWNLRITDMTTPYIFPSENGLRMETRELNYDRLKVRAMGQSFAFNLSPYSQNQLAKKGHWHLLEEEAGTWLNIDGFHMGVGGDDSWSPSVAQEYLLTKGNYHYEVSFKLT

SEQ ID NO: 14126 - protein, 384 aa, Clostridium difficile
MSTKRDYYEVLGISKGAEAQEIKKAYRKLAMKYHPDRNPGDKEAEEKFKEINEAYEVLSDDTKRKTYDQFGHDGLNGQGGFGGQGGFGGQGFGGFEDMFGDIFGDMFGGSFGGGRARRRGPQRGADIRQSVTISFEEAAFGKKMSIKVNRSEECEECNGTGAKPGTSKKTCSTCNGTGQVRTVQRTPFGNIASSRPCSACNGTGEVIESPCSKCHGTGNTRKVKTIEVDIPAGIDDGQMIKLSGQGEVGEKGAPRGDLYIVVNVKSHPLFTRDGNDIYFEMPITFVQATLGDEIEVPTLDGKVKYSVPEGTQTGTVFRLKEKGIPRIRGNSRGDQYVKVVVEIPKKLNDKQKELLREFAKECGSNVHEKKKTFGQKIEDMFKKK

SEQ ID NO: 14127 - protein, 499 aa, Nicotiana tabacum
MSVTVSSPAGRSFHISRSPYKKISKPRVIIAAVRSGVSLAVAPILTKLQKDCATPLPVLRHVADAMAVDMRAGLAVDGGSDLKMILSYIDTLPTGNEKGLFYALDLGGTNFRVLRVQLGGKEERVIATEFEQVSIPQELMFATSEELFDFIASELGKFSQSEGGKFEMQQGRTREIGFTFSFPVKQTSVKSGILIKWTKGFAVSGTAGKDVVACLNEAMERQGLGMQVSALVNDTVATLAGARYWDNDVMVAVILGTGTNACYVERVDAIPKLPQRMSNSPETIVNTEWGAFSNGLPLTEFDREMDAESINPGEQIFEKTISGMYLGEIVRRVLVKMAKVGGLFGGGYVPEKLVTPFVLRTPDICAMQQDTSRDLEAVESVLYDIAGVKSDLSARKTVVDICDTIANRGGRLAGAGIVGILQKMEEDSKGVIFGKRTVVAMDGGLYEHYPQYREYLQEAVTELLGSEISKNVVIEHSKDGSGIGAALLAAANSKYEHDY

SEQ ID NO: 14128 - protein, 380 aa, Streptococcus pneumoniae
MKNEMLALILAGGQGTRLGKLTQSIAKPAVQFGGRYRIIDFALSNCANSGIHNVGVVTQYQPLALNNHIGNGSSWGLDGINSGVSILQPYSASEGNRWFEGTSHAIYQNIDYIDNVNPEYVLILSGDHIYKMDYDDMLQSHKDNNASLTVAVLDVPLKEASRFGIMNTDANNRIVEFEEKPAQPKSTKASMGIYIFDWQRLRNMLVAAEKSKVGMSDFGKNVIPNYLESGESVYAYEFSGYWKDVGTIESLWEANMEYISPENALDSRNRQWKIYSRNLISPPNFLGANAHVEDSLVVDGCFVDGTVKHSILSRGAQVREGAEVLDSVIMSGAIIGQGAKIKRAIIGEGAIISDGVEIDGTDEVQVVGYNEVVGVATDED

SEQ ID NO: 14129 - protein, 215 aa, Pseudomonas syringae
MTLRSKILVNKNVLPTAEQALPGRETPMALPETHFVNGNPLLGPFSSNVEFAIFGLGCFWGAERRLWQQEGVVSTVVGYAGGFTPNPTYEEVCSGLTAHTEVVLVVYEPEKISYKSLLKVFWEAHNPTQGMRQGNDIGTQYRSVIYCTTPKQLDAAKASAAEFQAELRKAGLGAITTEIEEAPTVYFAEAYHQQYLAKNPQGYCGLGGTGVCLPA

SEQ ID NO: 14130 - protein, 503 aa, Aspergillus oryzae
MDSVKLLFLSPEVNPSNRKAMSIPILNPFDKYGRVYFFSWLGFMVAFLSWYAFPPLLTVTIRKDLKMTQPEVANSNIVALLATLLVRFVAGPLCDRFGPRLVFIGLLLCGSIPTAMAGLVTNAQGLIALRFFVGILGGTFVPCQVWCTGFFDKKIVGTANSLAAGWGNAGGGITYFVMPAIFDSLVHNQSLPAHKAWRVAYIVPFIIIVVIAVAMFFTCEDTPTGKWSERHLWAEETSRFEGNIVNINSGISSSHPSSPPSTTNIVADLEKKGNPSPPESIAPMPGQLESLRTDTVVAPTFKEAMNVLLSLSTAAVAIPYACSFGAELAINSILGDFYAENFPYMGQTKTGQWAAMFGLLNVICRPAGGFIADLLYRHTQSVWSKKILLSFLGVGMGAFQLALGFSNPKSEATMFGLTAGLAFFLEACNGANFAVVPHVHPFANGIVSGAVGGMGNLGGIIFAIIFRYNGSHYARSLWIIGIIAIAANLAVSWIRPVPRRQMV

SEQ ID NO: 14131 - protein, 1097 aa, Aspergillus oryzae
MPLLEAPRNGGAVNNGVLSGVSHSQSFGIDTESHLDDPNRRQQIVVVGLGMVAISFLEKLVKQDSERRKYDIVVIGEEPHVAYNRVGLSSFFEHRNIEDLYLNPKEWYGSFKDRSFDYHLNTRVTDIFPDRKTVKTSTGDIIAYDLLVLATGSDAVLPTHTPGYDANGVFVYRTISDLERLIEFASNHKGETATTVGGGLLGLEAAKAMTDLEDFGKVKLIDRNKWVLARQLDGDAGTLVTRKIRELGLDVMHQKRVAKIKTDDNNNVTGIVFEDGEEIDCCCVCFAIGVRPRDELGTTAGIQCASRGGFVINESLQTSIPEIYAIGECASWENQTFGIIAPGIEMADVLAFNLTNPDKEPRSFRRPDLSTKLKLLGVDVASFGDFFADRDGPKFLPGRRPSVATIPRVKDTTEKESPVKALTYKDPFGGVYKKYLFTMDGKYLLGGMMIGDTKDYIKLNQMVKSQKELEVPPSQFILGAQNGGEENGDDLADDTQVCSCHNVTKGDIVESVKSGTCKSIGEVKSCTKAGTGCGGCMPLVQSIFNKTMLDMGQEVSNNLCVHIPHSRADLYNIVAIKQLKTFEDIMKAVGRSPDSLGCELCKPAIASILSSLFNGHIMDHEYHELQETNDRFLANIQRNGTFSVVPRVPGGEITADKLIAIGQVAKKYNLYCKITGGQRIDMFGAKKQDLLDIWTELVNAGMESGHAYAKSLRTIKSCVGTTWCRFGIGDSVGMAIRLEERYKSVRSPHKLKGAVSGCVRECAEAQNKDFGLISTEKGFNIFVGGNGGAKPRHSELLAKDVPPDMVIPIIDRYLIFYIRTADKLQRTARWIENLPGGINYLREVVIDDKLGICAEMEQQMQELVDSYFCEWTETIRNPKRRKYFQQFANTDETVDTVELVKERDQERPTYWPSEGAKEDFKGHQWSALSWQPIIKADHFSDGPPAISSANVKRGDTQLAIFKVKGKYYATQQMCPHKRAFVLSDGLIGDDDAGKYWVSCPYHKRNFELNGEQAGRCSNDEAMNIATFPVEERDDGWIYLKLPPVEELDSVLGTEKWKVKKGEAPDPFQKCDKKYKGTRGKKAGDRPSPTKQSKTIDW

SEQ ID NO: 14132 - protein, 328 aa, Unknown
  Synechococcus sp. WH 7805
MSRVYADNSQAIGNTPLVRLNHVTKGCKATVLAKVEGRNPAYSVKCRIGANMIWDAEKRGELTDGKVIVEPTSGNTGIALAFTAAARGYKLVLTMPESMSIERRRVMAVLGAEIVLTEAAKGMPGAIAKAKEIADSDPAKYFMPGQFDNPANPDIHFKTTGPEIWNDCDGAIDVLVSGVGTGGTITGVSRYIKNEAGKAIESVAVEPSHSPVITQTLNGEEVKPGPHKIQGIGAGFIPKNLDLSIVDKVEQVTNEESIAMALRLAKEEGLLVGISCGAAAAAAIRLAQQDDYAGKTIVVVLPDLAERYLSSVMFAEVPAGIIEQPVPA

SEQ ID NO: 14133 - protein, 198 aa, Bordetella pertussis
MLNMRTAEITRNTNETRIRVAVNLDGTGKQTIDTGVPFLDHMLDQIARHGLIDLDIKADGDLHIDAHHTVEDVGITLGMAIAKAVGSKAGLRRYGHAYVPLDEALSRVVIDFSGRPGLEYHIDFTRARIGDFDVDLTREFFQGLVNHALMTLHIDNLRGFNAHHQCETVFKAFGRALRMALEVDPRMGDAVPSTKGVL

SEQ ID NO: 14134 - protein, 131 aa, Candida glabrata
MSAKAEKKPASKAPAEKKPAAKKTAPSSDGKKRTKARKETYSSYIYKVLKQTHPDTGISQKSMSILNSFVNDIFERIASEASKLAAYNKKSTISAREIQTAVRLILPGELAKHAVSEGTRAVTKYSSSTQA

SEQ ID NO: 14135 - protein, 448 aa, Oryza sativa
MSEPEFEQARKELVSTLEASSLFTKNPEYKKALEVVSVPERVIQFRVVWENDKGECQVQKGYRVQFNSALGPYKGGLRFHPTVNLSILKFLGFEQIFKNALTGLNMGGGKGGCDFDPKGKSDNEIRKFCVAFMRELNKHIGADTDVPAGDIGVGGREIGYLFGAYRAERNRWEGVLTGKGGSWGGSLIRPEATGYGLVYYVEHMINYASGGKESFAGKRVAISGSGNVAQYAALKIIELGGTVISLSDSKGALIADDDKGFTPEVINEIAALKLQRKALTALENHSFRYVEGARPWKEVKKVDVALPSATQNEVSEDEAKALIESGAKFIAEGSNMGCTQEAIEVFEAHRRENKGSAIWYAPGKAANAGGVAVSGLEMAQNSQRLSWSAEEVDEKLKGIMKDCFENCLSTAKEYFTPSEGEFPSLVGGANVAGFRKVAAAMHDQGDWW

SEQ ID NO: 14136 - protein, 343 aa, Mesorhizobium loti
MTGEAVSGQDVSNPGKSSWRVTVLGGGAWGTALALAMLRAGHKVRLFARDPQTVAAIGQGQNPRYLPGIAIAPGIEATSDIAAALSGADCVLAVTPAQSLRATLAVAKDNMPDGIPLVLCAKGIERDTGALLSAIVEEILPRNPVAALSGPSFATDVARGLPTAVVVAARDEALAADLAARFSAQNLRCYSSDDLIGVEIGGALKNVFAIAAGAVTGAGLGASAQAAMVTRGFVELRRIGAAFGARPETLMGLSGLGDLLLTCSSAQSRNFAYGLTLGQGKALAGLPLAEGVPTAAIAARIAVERGIDAPIIAAVAAILDGAITISQAVTALMTRPLKTETND

SEQ ID NO: 14137 - protein, 742 aa, Aspergillus nidulans
MYHDHPVRSVQDLIGFSGLISHAIRHPLDFHYSVGPTLSELSGGLLSSSFEPERDLPGLSGKVIFVTGGNTGLGKETVLQLARHRPERIYLAARTAIKATNAIASIQEALPCRADIRHIPLDLASFASIRAAAKQFQAECERLDILILNAGVMGHPPSLTEEGYEIHLGTNHIGHFLLTKLLLPTLRETVSRSESPDVRVITLSSLAANTAPSYDSITSTPALLSLGWASRYGASKAANVLFAAELARRHPEILSVSVHPGAVVTDLYQQTKKAGLFYEAGVGLMMKFFRSIRTGALTQIWAAAAPREQLINGGYYVPIAVKGVSRYHQYLPDLSLPRFQVMRNQDAHEYAEAFKKGRNPPWLHALYTHWKDLAQEPFKGVTTDGNVRPNLFTLQDEQVPIDTIVSATKHLFSLLSPDQQQTLSYHIDSPEWRTWSNPEFLLSHKGLRLDEVNPEIRDAILAVLQATLSPEGYDKAIKAMRINHFLGELVESPRVMNEYSYNFVLFGNPSTTRPWGWSFYGHHLCLNIFLYKSQIVASPWFTGAEPNLIDSGPYSGTRILHVEETLGLKLMQSLPPHIQRKAQTYALMKDPAMPPGRWNRDDQRHVCGAYRDNRIVPNEGVPVTLFTEDQKATLYEILNQYLLYLPTYARALRIAHIKQYESETYFSWIGGYGDHDPFYFRIQSPVILVEFDHHSGVFLNNEEPKKFHIHTLLRTPNGGDYGFALRPLVPPIEDANGKEISW

SEQ ID NO: 14138 - protein, 66 aa, Protea amplexicaulis
MPGQWEYQVGPSVGIEAGDHIWCSRYLLERITEQAGVVLTLDPKPIEGDWNGAGCHTNYSTKSMRE

SEQ ID NO: 14139 - protein, 254 aa, Desulfovibrio vulgaris
MAYVSMKQMLETGVHFGHQTRRWNPKMRPFIFGARNGIHIIDLQQTVKMFRVAHDKVVDTVANGGRVMFIGTKRQAQEAVATEAGRAGQFYVTNRWMGGTLTNFFTIQKSIDRLKKLEAMFADGTVNRYQKKEILRLQREMDKLLATLGGIKDMDKLPQLAFVIDPHREDIAIKECRKLGIPIVAVTDTNCDPDLIDFVIPGNDDAIRAIKLFVAAIADACLEGDALRKERKGQDAEEELKKASEPKAAEAAAE

SEQ ID NO: 14140 - protein, 344 aa, Datura stramonium
MEVLSSTHTNGSSLLKNGVITMNGHHNGNSDHRNGGTTVHENGRKLLGNSNSIKPGWFSEFSALWPGEAFSLKIEKLLFQGKSDYQDVMLFESATYGKVLTLDGAIQHTENGGFPYTEMIVHLPLGSIPNPKKVLIIGGGIGFTLFEVLRYPTVEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKDETHANSKLGPLKFYNTDIHKAAFILPSFARSMIES

SEQ ID NO: 14141 - protein, 222 aa, Nicotiana sylvestris
MTRRYWNINLEEMMEAGVHFGHGTRKWNPKMAPYISAKRKGIHIINLTRTARFLSEACDLVFDAASRGKQFLIVGTKNKAADLVEWAAIRARCHYVNKKWLGGMLTNWSTTETRLHKFRDLRMEQKTGRLNRLPKRDAAMLKRQLSRLQTYLGGIKYMTGVPDIVIIVDQHEEYTALRECITLGIPTICLTDTNCDPDLADISIPANDDAISSIRLILNKLV

SEQ ID NO: 14142 - protein, 271 aa, Brassica napus
  misc_feature (244)..(244): Xaa can be any naturally occurring amino acid
MDFLGFSSASYTFRVIIFLSLFFFLCNGFSYPDSSLFYTHHHRHNLAKHNYKDALTKSILFFEGQRSGKLPPNQRMTWRRDSGLSDGSALHVDLVGGYYDAGDNIKFGFPMAFTTTMLSWSVIEFGGLMKSELGNAKVAIRWATDYLLKATSRPDTIYVQVGDANKDHSCWERPEDMDTQRSVFKVDKNTPGSDVAAETAAALAAAAIVFRKSDPSYSKILLRRAIRVFAFADRYRGTYSAGLXPDVCPFYCSFSGYQDELLWGAAWLQKA

SEQ ID NO: 14143 - protein, 387 aa, Triticum aestivum
MEMILLQMSIIVNAGDQQAEVINDMEKEVEDAKVDSGKELDGTTFADTGNLDYDTGANAENTQENVVLVGSEEATKQCEVSHMDDSALMEQQNECGSAILEKTESVPFEVQGKPMETFLNDGIGEGPEAAPLESRVRTMENTLNDAIGAGAEDAALESRVGTMENTLDDAIGEEPEAVPVENRGKTMESTLKDAGSLPSNGSAEPEPEPALPESATNGPPPCEHDGGALHGDSADSEVSSGSQGDLQKEQDGDDASETTQGNVIATKPAETLACAAGVNSAVPVAAPEAEMPEEGAEGASPEEEEAAAHDNGPKGGDDAKNKGLDDENQKLKEMLQKVLASGNDQMGVIAELSDKVKSLERKLARKRRPKVRVQPRPARNATANDVL

SEQ ID NO: 14144 - protein, 917 aa, Arabidopsis thaliana
MAASVDNRQYARLEPGLNGVVRSYKPPVPGRSDSPKAHQNQTTNQTVFLKPAKVHDDDEDVSSEDENETHNSNAVYYKEMIRKSNAELEPSVLDPRDEYTADSWIERNPSMVRLTGKHPFNSEAPLNRLMHHGFITPVPLHYVRNHGHVPKAQWAEWTVEVTGFVKRPMKFTMDQLVSEFAYREFAATLVCAGNRRKEQNMVKKSKGFNWGSAGVSTSVWRGVPLCDVLRRCGIFSRKGGALNVCFEGSEDLPGGAGTAGSKYGTSIKKEYAMDPSRDIILAYMQNGEYLTPDHGFPVRIIIPGFIGGRMVKWLKRIIVTTKESDNFYHFKDNRVLPSLVDAELADEEGWWYKPEYIINELNINSVITTPCHEEILPINAFTTQRPYTLKGYAYSGGGKKVTRVEVTVDGGETWNVCALDHQEKPNKYGKFWCWCFWSLEVEVLDLLSAKEIAVRAWDETLNTQPEKMIWNLMGMMNNCWFRVKTNVCKPHKGEIGIVFEHPTLPGNESGGWMAKERHLEKSADAPPSLKKSVSTPFMNTTAKMYSMSEVKKHNSADSCWIIVHGHIYDCTRFLMDHPGGSDSILINAGTDCTEEFEAIHSDKAKKMLEDYRIGELITTGYSSDSSSPNNSVHGSSAVFSLLAPIGEATPVRNLALVNPRAKVPVQLVEKTSISHDVRKFRFALPVEDMVLGLPVGKHIFLCATINDKLCLRAYTPSSTVDVVGYFELVVKIYFGGVHPRFPNGGLMSQYLDSLPIGSTLEIKGPLGHVEYLGKGSFTVHGKPKFADKLAMLAGGTGITPVYQIIQAILKDPEDETEMYVIYANRTEEDILLREELDGWAEQYPDRLKVWYVVESAKEGWAYSTGFISEAIMREHIPDGLDGSALAMACGPPPMIQFAVQPNLEKMQYNIKEDFLIF

SEQ ID NO: 14145 - protein, 376 aa, Rubrobacter xylanophilus
MRTGLEDARGAREAAGGISKPLPGRLFVDHRGSGRPDPEDPTGDMGLNAEMRWEAMAREGYLTPVGLFFVRNHAPTPRVDPLRWRLRVEGPGVRRALELGYEDLLRMSGVSLVRALECAGNGRAFFAGERGRPAPGTQWRLGAVGVAEWTGVPLREVLLRAGLRREAREVMLEGLDACRMRRPLPLEKALEEDTLLAYGMNGEPLPPDHGYPLRAVVPGWAAVASVKWLGRIYVSDVPLLSPWNTARYVLTGGPFGEGRLPVGPQVPKSALELPWPARLPSGRHVITGRSWSPSAGIRHVKYSLDGRSWRPAQLFGPNIPRAWARWRFVWEASPGRYRIRVRATDAAGNTQPDKATPNELGYLYGAVVGHPVTVEP

SEQ ID NO: 14146 - protein, 195 aa, Unknown
  Candidatus Desulfococcus oleovorans Hxd3
MKRSASVQRQTAETQVSVTVLLDGIGTQTISTGIPFFNHMLSLFAAHGFFDLTVQASGDIDVDFHHTVEDVGIVLGNSVNKALGDRKGIRRYGYAVTPMDEALAHAVIDLSNRPFLVFNVPSIPAAETGFGVQLAKEFFRAFAVNCGMTLHIRVDYGENEHHVIESVFKAVARALDMATSMDDRITGPLSTKGCI

SEQ ID NO: 14147 - protein, 721 aa, Unknown
  Mycobacterium sp. JLS
MPSTTVHTFCRYCLASCGVEVTVEDNRVRKISADRLNPHSWHDFCAKGRTAAELVDHPRRIRAPMRRVGDRYVEATWDEAITDIAARMNAAIEADGPDAVGAYYGNPTGFSGSNVIFMNAWLDAVGTHNRYFVGSVDQNAMHVVAEAMYGSMLMAPVSDIDNCDYFLLVGTNPAVSAWNWLETVPGGWRRALERQKRGATLVVVDPVRTESADHADVHLAVRPGQDWALLLAMVKVVLDEGLEHRGDCTDLAVGVPELRSLVAEADLDDLAQRCGVDRATIERVARDFAAARGAMVVTRTGVSLHAAGTVAEWLGHVLNVVTGRMDRPGGRRFEPGYVDALRLAALAKGKPHVSRVAGREMVSGAHALAELPDEITTPGPGQIKAILINCGNPVVSGPDGAKLDRALATLDLLVVIDLVQRESHRHAHWLLPAAHWLERDDLLAFTSSMHDEPFVQYGRRAVEPPPGAREEWQIFTDLALAMGLPLFGVRGMNGFVRATRRAAALTRRPALAFGPQWLNRILVATSRKVNGRKLRWRDVANSPHGLVLGPREFGHFRDALRTPDKKVHAAPPEFVTRTRELLAAPHPSAPAGYPFQLGNRRHRHSMNSWLNDLPGLHPGGKRNEVVIHPEDAAALGVADGDRVRVFSPVGAVEVHATVSDQPRRGLVVLDHGWGSRVFDPRGDAEPQSYGVNRNLLVDGTGLDPLSQTSTLSEAWVGVQKV

SEQ ID NO: 14148 - protein, 112 aa, Alkalilimnicola ehrlichei
MKLVTAIIKPFKLDDVREALSEIGVQGITVTEVKGFGRQKGHTELYRGAEYVVDFLPKMKIEVALADDLVDRACEAVAKAANSGKIGDGKIFVFPLEQAIRIRTGETGSDAL

SEQ ID NO: 14149 - protein, 370 aa, Oryza sativa
MVYISNAQDASKLIVTAKGGGGEADDAAASSAAVVLDLWRQPAKIPAPFVWPRADVALPPSSPPTGELDVPVVDLAAALRDAAGMRRAVAQVAAACASHGFFQVSGHGVPPSLARAALDGAAGFFRLPPAAKQRARRAPGTVTGYTAAHADRFVDNLPWKETLSFGHRHANAAGNNSSTVADYFSTLGDDFKHLGEVYQEYCEAMEEVTKAIMAVLGESLGVGGGYYREFFEDSSSIMRCNYYPPCPEPERTLGTGPHCDPSALTVLLQDGDVDGLQVLVAGAWRPVRPLPGAFVVNIGDTFMVCTLVLGRDMDLGSIDRRVVSSCPAMMVSHRDLDVDLDVRRRLAPLAPPVLLASAVRQRTSSYSLAS

SEQ ID NO: 14150 - protein, 65 aa, Arabidopsis thaliana
  misc_feature (13)..(13): Xaa can be any naturally occurring amino acid
  misc_feature (31)..(31): Xaa can be any naturally occurring amino acid
  misc_feature (34)..(35): Xaa can be any naturally occurring amino acid
  misc_feature (39)..(39): Xaa can be any naturally occurring amino acid
  misc_feature (47)..(48): Xaa can be any naturally occurring amino acid
  misc_feature (57)..(57): Xaa can be any naturally occurring amino acid
MASSMLSSATMVXSPAQATMVAPLNGLKSSXAFXXTGKXNNGITSIXXNGGRVKCMXVWTTIGKK

SEQ ID NO: 14151 - protein, 340 aa, Streptococcus pyogenes
MKKQLRARLIYNPTSGQELMRKSVPEVLDILEGFGYETSAFQTTAQKNSALNEARRAAKAGFDLLIAAGGDGTINEVVNGIAPLKKRPKMAIIPTGTTNDFARALKVPRGNPSQAAKLIGKNQTIQMDIGRAKKDTYFINIAAAGSLTELTYSVPSQLKTMFGYLAYLAKGVELLPRVSNVPVKITHDKGVFEGQVSMIFAAITNSVGGFEMIAPDAKLDDGMFTLILIKTANLFEIVHLLRLILDGGKHITDRRVEYIKTSKIVIEPQCGKRMMINLDGEYGGDAPITLENLKNHITFFADTDLISDDALVLDQDELEIEEIAKKFAHEVEDLEQELEE

SEQ ID NO: 14152 - protein, 444 aa, Haemophilus influenzae
MTNNNKTMEILMKSGDLNKYDLVKNTLVLVLAGGRGSRLHELTDKRAKPALYFGGNRRIIDFALSNCINSGLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTIGCIEVPRSEAHEFGVMAVNENLKVKAFVEKPKDPPAMVGKPDVSLTSMGIYVFDADYLYKMLDREVGTPNTSHDFGKDVLPKCLEEGALYAHPFSRSCMGRNTEGEIYWRDVGTLDSFWQSNIDLVSENPQLDIYDQSWPIRGNPVQAYPSKFFYKHSNVHPVDNSLIGGGCVITDASISNSVLFDRIKIDSFSKVDHCVVLPQVKIGKNCVLKNCIIDRECEIPDGMQIGVDMEEDKNRFRISSTGKVILVTPKMLKILEGHEIGEEGHLD

SEQ ID NO: 14153 - protein, 133 aa, Novosphingobium aromaticivorans
MTVPGTPYEAFGGEAAIRALCGRFYSLMDELPGAAACRAVHPPSLERAEERLFEYLTGWLGGPPLYTDKYGHPRLRMRHFIAPIGREEVEGWLLCFRQAWSETIPASPLADAIMEKVEGLAWHMGNKPDIAGS

SEQ ID NO: 14154 - protein, 658 aa, Haemophilus influenzae
MFKIYNNGNPIPMGYSQAVENNVQITNFALFSAAAIGVELCLFDEQNQETRLPMVRTENVWHLAVTGVKTGTEYGFRIHGEFANPNKLMLDPYAKAVNGKPDLSSEESCSWFLLSDNRDNAHLAPRAVVISEDFNWENDTLPNTPWAETIVYELHVKGFSQLNEKIPAALRGTYTGLAHPVNLAYLKELGVTVVELLPVNFHINEPHLQARGLQNYWGYNPLAMFAVEPKYAATNNPLAEFKAMVKAFHNEGIEVILDVVFNHSAESEQTYPTFCQRGIDDQTYYWRNDQGRYINWTGCGNMLNLSSDVGRKWVVDCLRYWVEQCHIDGFRFDLASVLGRDTPDFNSSAQLFTDIKNEPSLQNIKLIAEPWDIGHYGYQVGNFPSYFAEWNDRFRDDLCRFWLWKSGEIGAFAERFAGSIDLFKKNDRLPHTTLNFITAHDGFTLKDLVSYNQKHNEANGEENHDGRNENYSYNHGVEGSTESLSEPQKSAVENNRTFAQSGLLMSLLLANGAPMLLAGDEFGNTQYGNNNAYCQDNEITWLKWANFNEELFELTKQTIALRKRMGSLNQDQWWSDENVQWLNIAGEPMTVEDWQNQQTKALQVVLDNRWLLLINAKAEGQVFHLPNGKWKPQIGTHNVTLEEQAELSSMGFCMLNDE

SEQ ID NO: 14155 - protein, 132 aa, Bacillus cereus
MSKQPMTPFEAIGGEQCIAILVDTFYSYVSKHPDLSPIFPDDLTETARKQKQFLTQYLGGPNLYTEEHGHPMLRARHLPFEITPKRAEAWLSCMEQAMDDTGVHGHIREFVFERLALTAQHMVNTPNETGEI

SEQ ID NO: 14156 - protein, 251 aa, Persicaria hydropiper
AYNQFSSDIPVISLAGIDDVGGKREEICGKIVAACEDWGVFQVVDHGVDTQLVSEMTRLAREFFALPAEEKLRFDMTGGKKGGFIVSSHLQGEAVQDWREIVTYFSYPIKNRDYSRWPDTPEGWLKATEHYSEQLMGLACKLLGVLSEAMGLEAEALTKACVDMDQKVVVNYYPKCPQPDLTLGLKRHTDPGTITLLLQDQVGGLQATRDDGKTWITVQPVEGAFVVNLGDHGHFLSNGRFKNADHQAVVN

SEQ ID NO: 14157 - protein, 476 aa, Nostoc punctiforme
MTLQSFGVIGLAVMGENIALNVERNGFPIAVYNRSREKTDAFMAQRATGRNVKAAFTLEEFVALLERPRKILVMVQAGKPVDAVIAQLKPLLEEGDIIIDGGNSWFEDTERRTQELEPAGLRYLGMGVSGGEEGALNGPSLMPGGTTSSYEFLSPIFNKIAAQVDDGPCVTYIGPGGSGHYVKMVHNGIEYGDMQLIAEAYDLLKNVAGLNPSQLHDVFAEWNTTDELDSFLIEITKNIFPYIDPETNKPLVDLIVDAAGQKGTGRWTVQTALELGVAIPTITAAVNARIISSIKDERVAASKVLTGPSGKYDGQTKDFINKVRDALYCSKICSYAQGMALLSTASKTYNWNLDLGEMARIWKGGCIIRARFLNKIKKAFSENPALPNLLLAPEFKQTILDRQTAWREVIATAATVGIPVPAFSASLDYFDSYRRDRLPQNLTQAQRDYFGAHTYLRLDKPGSFHTEWVPIAEAGK

SEQ ID NO: 14158 - protein, 181 aa, Pyrococcus horikoshii
MALRPAKIDRYVDKPAYTRREYIRGAPGPKITIFDMGNPAGDFEFEVALHTAEPVQIRQNALEAARQQVNRYLQKNVGRSNYHFKIRVYPFQVLRENPMATGRKADRYGNGMRRPFGKPIGLAARLKRDQKILSIRVNRQHLKFAIEGARRAAMKFPCKCYYRIYDKEGNDVTTKILSQGL

SEQ ID NO: 14159 - protein, 358 aa, Oceanicola granulosus
MNRSDDSFIVHRTRPLNAEPTPTALMSGFFTPQHLFYIRSHGDTPELPADHEVRLSGLVTSPLRFSLERLRREFPKRKVIATLQCAGNRRAEMQDVRQTSGDPWRIGAVGTAEWTGVALADVLAKAGIDETRARHVAFRCADVVDIDGEIAPYEVSISVERAMAGDVLVAWALNGEDLDPAHGAPMRIIVPGYAGARSAKWLLEIDVRDAPSDSPVQARDYKLFPPSVARQDANWDEGVTIEQMPVTSAICLPRPDEPIPPGRTTVKGYAMAYGRKVARVDVSTDGGRSWRQAGLMSERTTAAWTLWALDVDLPAGRHELVVKAVDEAGQSQPECLEGIWNFAGYLATAWHRVIVDVG

SEQ ID NO: 14160 - protein, 1054 aa, Oryza sativa
MVPKCGYIRKAVAAARGGATATVDLDLSALPGAADAFDKVARYCYGANFEISVRNAAALLCAAAFLDMHPTDGGLARRVEEFLAKVGLRTLPGAVAVLRSCEGLLPAAEEIGVVQRSADAIALRICNEVLFPTRSPPEWWTAELAALSPASFHKVITALRCRRAEPEVLVAAATAYAELLLAEVLAADGHAADHSGMHRALVESVVAVLPSTDDAPLPAAFLCHLLHVAITIGASAKTCRDLELRVAAVLDQATAGDLLTVALDGAGERVQNVDAVRRIITAFVERDSAASSGGGANGRNRRASLSGAGALQGGGGAMQTVAKTVDEVAAEIATEESLPISKFVGLAGAVPKEARATHDCLYRAVDIYLKAHPALEEMEREKVCSVMDPLKLSYQGRLHASQNNRLPLQAVLSALYYDQLKLRSGDEGGSGWDAYGNGVMRSSAAGSAWKQAKEEASLARENEALRSELARMRAYVSGMQQQSKGSSSSRGKKGSWLRTLSRLNPFKAGIWGKDTSGIVDGKTDAMNSVKAKRRRHYITPPETYRTVIFFPVSLFFHGSDQWRRTSPVLGRNSLGRRTPYTSGFSCVHRCSRHARRRLKLSGCGAQWDPRVGLILSIRAVKSTVALTTDVENGSAHECPCDGHVPHPAELERRDASPSPPPSAHHLLLLLALASDMEDAHHHHWTMVERRGTQLWASGRPFIIHGFNTYWLMSFAADQATRLRVTAAIAEAGLNVCCTWAFSDGGYRALQTAPFHYDEDVFRALDFVVSEARRHNMRLILSLCNSWEDYGGKAQYVRWGKEAGLDLTSEDDFFSDPTIKSYYKAFVEAVVTRINTVTNETYKDDPTILAWELINEPHCPSDPSGDTLQAWMEEMASYVKSIDPVHLLEIGIEGFYGPSIPELLPVNPDEYSGHAGTDFIRNHQAPGIDLASIHVYSDIWLPHSIKENHLQFVDKWMQQHIDDAANLLGMPIVVGEFGVSVKDGKFGNEFREDFMKTIYRIFLSSWKEGVIGGGCLLWQLFPEGAEHMDDGYAVIFAKSPSTLSLLANHLRCLEC

SEQ ID NO: 14161 - protein, 66 aa, Faurea galpinii
MPGQWEYQVGPNVGIEAGDHIWCSRYLLERITEQAGVVLTLDPKPIEGDWNGAGCHTNYSTKSMRE

SEQ ID NO: 14162 - protein, 166 aa, Vitis vinifera
LGAVGAIAPEILGKLGLIPPETALPWFKTGVFPPAGTYNYWADPYTLFVFEMALMGFAEHRRFQDWANPGSMGKQYFLGLEKYLGGSGDPAYPGGPLFNPLGFGKDEKSLKDLKLKEVKNGRLAMLAILGYFAQGPVTGVGPLQNLLDHLADPVNNNIITSLKFHN

SEQ ID NO: 14163 - protein, 593 aa, Oryza sativa
MMGAAVTMVDRRMAFAAEADVDSKAAFGFFGGECFVGEGDLVNPAPPPPQQQQVHEGGFAAEDESDGDDDDDDDDDVDDIEELERRMWRDRVRHKRLKELQQSRAGRESRAGDAGGGGRQQRQSQEQARRKKMSRAQDGILKYMLKMMEVCNAQGFVYGIIPEKGKPVSGASDNLRSWWKEKVRFDRNGPAAIAKYQADNAVPGCDGDAGGAAPAGPHSLHELQDTTLGSLLSALMQHCDPPQRRFPLEKGVPPPWWPEGSEAWWPEAGVPKELGPPPYKKPHDLKKAWKVAVLTAVIKHMSPDVDKVRRLVRQSKCLQDKMTAKEIVTWLAVLKQEEDLYLKLHPGALPPPLSAASFNASVSGEYDVEGVDGDEAGNNNLQKAQNDATAFMDLTTTMDAALSNNKFLIMPLMKEEAIDVDFIQKRSEPELMLSSDSHARVYTCGNVQCPHSNYALGFLDRNERNAHQYACKHNAAAAAAESKPPPPHIFEPLGSFDFDLPVDGQRCLAGLMTMYDNDVAAATQMHHHHHQQQQANFFIRDDAPFGGDVAATAAAAPEFRFSSNFNVTGGGAVDYGGAMQQPPAKYAGSNWFY

SEQ ID NO: 14164 - protein, 98 aa, Unknown
  Nostoc sp. PCC 7120
ATFKVTLINEAEGTKHEIEVPDDEYILDAAEEQGYDLPFSCRAGACSTCAGKLVSGTVDQSDQSFLDDDQIEAGYVLTCVAYPTSDVVIQTHKEEDLY

SEQ ID NO: 14165 - protein, 110 aa, Buchnera aphidicola
MINTKIINVNEENFEKNILQEKNFILVDFWAEWCNPCKILAPILEEIANEYQDKLIVAKINIDENPNIAPKYSIRGIPALLLFKNGTLLKTKIGALSKIQLQTFLNKYLI

SEQ ID NO: 14166 - protein, 491 aa, Haemophilus influenzae
MDAVELLMNVTPNETRIALVETGMLREVHIERQAKRGIVGNIYKGRVTRVLPGMQSAFVDIGLEKAAFLHAADIVSHTECVDENEQKQFKVKSISELVREGQDIVVQVVKEPLGTKGARLTTDITLPSRHLVFMPENSHVGVSQRIESEEERARLKALVEPFCDELGGFIIRTATEGASEEELRQDAEFLKRLWRKVLERKSKYPTKSKIYGEPALPQRILRDFIGTNLEKIRIDSKLCFGEVKEFTDEFMPELSDKLVLYSGNQPIFDVYGVENAIQTALDKRVNLKSGGYLIIEQTEAMTTIDINTGAFVGHRNLEETIFNTNIEATKAIAQQLQLRNLGGIIIIDFIDMQTDEHRNRVLQSLCDALSKDRMKTNVNGFTQLGLVEMTRKRTRESLEHVLCDECPTCHGRGRVKTVETVCYEIMREIIRVYHLFSSEQFVVYASPAVSEYLINEESHGLLPEVEMFIGKRVKVKTEQFYNQEQFDVVVM

SEQ ID NO: 14167 - protein, 375 aa, Nostoc punctiforme
MVNQNLTATEIGFTHEDFAALLDKYDYHFSPGDVVPGTVFSIEPRGALIDIGAKTAAYIPIQEMSINRVDSPEEVLQSNETREFFILTDENEDGQLTLSIRRIEYMRAWERVRQLQAEDATVRSGVFATNRGGALVRIEGLRGFIPGSHISTRKPKEELVGEELPLKFLEVDEERNRLVLSHRRALVERKMNRLEVGEVVIGTVRGIKPYGAFIDIGGVSGLLHISEISHEHIDTPHSVFNVNDEVKVMIIDLDAERGRISLSTKQLEPEPGDMIKNRDLVYDKAEEMAAKYREQLLAKQQGATAAPAAPADVLAEEDIPPATELEDEIPPAAELEEEIPPAAEIEEVTPVVAEIQEKIPATTETEEEIPAAIEE

SEQ ID NO: 14168 - protein, 416 aa, Salmonella typhimurium
MLEQMGIAAKAASYKLALLSSGEKNRVLEKIADELEAQMESILSANVQDVEQARANGLSEAMLDRLALTPARLKAIADDVRQVCNLADPVGQVIDGGLLDSGLRLERRRVPLGVVGVIYEARPNVTVDVASLCLKTGNAVILRGGKETYRTNAATVRVIQKALKACGLPEAAVQAIDNPDRSLVNEMLRMDKYIDMLIPRGGAGLHKLCREQSTIPVITGGIGVCHIFVDSSADIAPALKIIVNAKTQRPSTCNTVETLLVHQDIAERFLPALSKQMAESGVTLHGDETVMQVLHGPAKLVPLKPEELDNEFLSLDLNVVVVENMDGAIAHIREHGTQHSDAILTCDMHNAARFVNEVDSAAVYVNASTRFTDGGQFGLGAEVAVSTQKLHARGPMGLEALTTYKWIGFGDGTIRA

SEQ ID NO: 14169 - protein, 411 aa, Unknown
  uncultured bacterium 577
MQMVGREARTASHTMAKVDSSSKNKALTEIAASIKKNEKNLLSANKDDLEAAKAQGLDSALIDRLTLTSKGVTNMVEGLLQIASLADPVGEISDLNYRPSGIQVGKMRVPLGVIGIIYEARPNVTADAAGLCIKAGNAAILRGGSEAYNCNQAIAACVKEGLKISGLPETVIQVINTIDRDAVGELITMKEFVDVIVPRGGKGLIKRISDEACIPVIKHLDGVCHVYIDEGADLDKSIGIADNSKTQRYGTCNTMETLLVHEKIAREVLPPLCKIYLDKGVELRGDRSSCAIVVKMTQVTEDDWKTEYLAPILSVRIVSSLDQALEHINLYGSHHTDSIVTEDYSRARRFLREVDSSSVMVNTSTRFADGFEYGLGAEIGISTDKIHARGPVGLEGLTSQKFIVLGNGQIR

SEQ ID NO: 14170 - protein, 466 aa, Salmonella typhimurium
MSVVPVADVLQGRVAVDQEVTVRGWVRTRRDSKAGISFLAVYDGSCFDPVQAVINNSLPNYNEEVLHLTTGCSVVVTGKVVASPGQGQSFEIQATKVEVAGWVEDPDTYPMAAKRHSIEYLREVAHLRPRTNLIGAVARVRHTLAQALHRFFDEQGFFWVSTPLITASDTEGAGEMFRVSTLDLENLPRNDQGRVDFDKDFFGKESFLTVSGQLNGETYACALSKIYTFGPTFRAENSNTSRHLAEFWMLEPEVAFADLEDNARLAEAMLKYVFNAVLEERADDMKFFAERVDKDAIARLERFVSTDFAQVDYTDAVAILERCGKTFENPVFWGVDLSSEHERYLAEEHFKAPVVVKNYPKEIKAFYMRLNEDGKTVAAMDVLAPGIGEIIGGSQREERLDVLDARMAEMGLNKEDYWWYRDLRRYGTVPHSGFGLGFERLIAYVTGVQNVRDVIPFPRTPRNASF

SEQ ID NO: 14171 - protein, 256 aa, Nicotiana tabacum
MGSGKLGESGMIELTAKIMMVVIIFLFLVVVFIFFLHLYTKWFWRYRQEDTGNPNGGTRRRRRRRFNFAGGYQEVNVLRRGLDPSVLKTIPVVPFNMKDFKDGLECSVCLSEVSEGENTRVLPKCNHGFHVDCIDMWFHSHSTCPLCRNPVSEQSAESISETIGSSVEEGSASTETQNIPTNVLFWGDETSTTSSASTSNRPEGILVIDIARQNTEQEEEEGQKTPTSTRLRSLTRLFSRVNPCNVDVEQGSRSQS

SEQ ID NO: 14172 - protein, 949 aa, Methylobacillus flagellatus
MDKQADYGTPASRTTEQQVTLEIDGMQVTVAKGTSIMRAAMEAGVSIPKLCATDTLEPFGSCRLCLVEIEGRRGYPASCTTPVDEGLKVHTQTPKLADIRRGVMELYISDHPLDCLTCSANGDCELQDMAGAVGLREVRYGYDGSNHLHAEKDLSNPYFQFDPSKCIVCSRCVRACEETQGTFALTIQGRGFDSKVAAGNFDNFLESECVSCGACVTACPTATLMEKTVIEHGQPEHSVITTCAYCGVGCSFRAEMKGEQVVRMVPDKNGGANHGHSCVKGRFAWGYATHRDRITTPMIRKSIHDPWQEVSWEEAITYAASELKRIQAKHGRNSIGAITSSRCTNEETYLVQKLVRAAFGNNNVDTCARVCHSPTGYGLKQTLGESAGTQTFDSIMKSDVIMVIGANPTDGHPVFGSQMKRRLREGAKLIIADPRAIDLVSGPHVKADYHLKLRPGTNVALITALAHVVVTEGLVDEAFVRERCEWDSYQYWSEFVAQPEHSPEAMQDVIGVPAQDLRAAARLYATGGNAAIYYGLGVTEHSQGSTMVMGIANLAMATGNIGREGVGVNPLRGQNNVQGACDMGSFPHEFPGYRHVSDDTTRALFEAAWGRPLDKEPGLRIPNMLDFAIHGSFKALYCEGEDIAQSDPNTQHVTQALSSMECVIVQDLFLNETAMYAHVFLPGCSFLEKNGTFTNAERRISPVRRVMTPKNGYEDWQITAMLSEALGYPMPYRHASEILDEIARLTPTFHGVSFKKLEEMGSIQWPCNEEHPNGTPIMHVDEFVRGKGRFMITEYVPTSERVNEKYPLILTTGRILSQYNVGAQTRRTDNVTWHPEDMVEIHPHDAEDRGIKDGDWVGITSRAGNTVLRAKITERVQPGVIYTTFHHPESGANVITTDNSDWATNCPEFKVTAVQVTRVSQLSDWQRRYQEFSNSQIALVKQRDMARMG

SEQ ID NO: 14173 - protein, 300 aa, Cryptococcus neoformans
MPRFYENKYPEVDQLVMVQVQSIEDMGAYVKLLEYDNIEGMILLSELSRRRIRSVQKLIRVGRNEVVVVMRVDPDKGYIDLSKRRVSAEEVVKCEEQYEKGKAVDSIITQVAKKRGVTPESLYEKIAWPLHRQYGHAYEAFKLSISEPEAVFGSLELDEETLADLRSGIARRLTPKPVKVRADIEVKCFSYAGIDAIKRALTAGEAVSTPDVPIKVRLVAPPLYVMSTTSTDKNAAIELMEKAVEVIGETVRKDKGDITIKMKPKVVSETEDAELKALMEQFEAANMDQAGDDESSEEDE

SEQ ID NO: 14174 - protein, 345 aa, Burkholderia xenovorans
MFLRNMWYVAAFSADVKPGKCLARTFLNEPVVLFRTASGSLGALIDRCSHRAMPLSEGHVDGDIIRCPYHGLEFNAAGVCAHIPGQERIPAAANVRSYPVSERDGLIWIWMGEPEKADLRSIMSNPEHRDPGWSWRPYYMHVNSNWQLLVDNILDLTHVAYIHANTIGGNPQTHFNADMSVQFDGEKVTLLRKMPNSVPPKTYVAAGGFKGNVDRWQMVEYRPCGGNVLRVNAGACEVGTGAYEGRRDNGFTLLNVHGVTPETETTTHYIWTICTDAPRESGVPDMLFDQFYETICEDERALEAQQRRINDMPDMRFVGIASDGAVSRARLLLERLHENETAVTS

SEQ ID NO: 14175 - protein, 296 aa, Saccharomyces cerevisiae
MITTPLVHVASVEKGRSYEDFQKVYNAIALKLREDDEYDNYIGYGPVLVRLAWLISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 14176 - protein, 458 aa, Oryza sativa
MAAHRVGRCMLLQPPRLATCVLFLLLPLLLPCSASSSVITHLPGFHGRLPFHLETGYVGVDEETGTELFYYFVESERSPSTGPVILWLTGGPGCSGFSGVVFEVGPMKYVLEPYNGSLPRLVYNQYSWTQMASILFLDTPVGSGFSYAHDPKGYNVGDISSSLQVVTFLKKWFNDHPRYLSNHFYVGGSSYAGKVIPIIMKFISEVGNPITGSKIDDNFKIPYSHGVGIISDQLYEAAVANCNGDYVTTTNELCAKALNAIDNLMSEVDYGNILDDKCVRATPKPINEVSRSRSLQEDYIRLSEPTVRPTINCFSYRYYLSFLWMNNNLTREALKIKKGTVGEWIRCKTGLPYVQDVASSIKYHFDLTTGGYRALVFSGDHDLILPFLSTQAWIRSLNFSIVDEWRAWHVDGQAAGFTILYANNLTFATVKGGGHTSIETNPKQGFAMGKRWLDNKPL

SEQ ID NO: 14177 - protein, 374 aa, Pseudomonas putida
MAKRDYYEVLGVERGANEGDLKKAYRRLAMKYHPDRNPGDKESEEQFKEANEAYEVLSDASKRAAYDQYGHAGVDPSMGGGGAGFGGANFSDIFGDVFSDFFGGGRGGSRGGAQRGSDLRYTLELNLEEAVRGTTVSIRVPTLFNCNPCDGCGANKGSTPSTCPTCGGIGQVRMQQGFFSVQQTCPRCHGQGKIITDPCGACHGEGRVEEYKTLSVKVPAGVDTGDRIRLSGEGEAGTHGGPTGDLYVVINVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKANGWFDGVKRFFGDL

SEQ ID NO: 14178 - protein, 262 aa, Pyrococcus horikoshii
MVKVGYIQMEPKILELDKNYSKAEKLIKEASKEGAKLVVLPELFDTGYNFESREEVFDVAQQIPEGETTTFLMELARELGLYIVAGTAEKSGNYLYNSAVVVGPRGYIGKYRKIHLFYREKVFFEPGDLGFKVFDIGFAKVGVMICFDWFFPESARTLALKGAEIIAHPANLVMPYAPRAMPIRALENRVYTITADRVGEERGLKFIGKSLIASPKAEVLSIASETEEEIGVVEIDLNLARNKRLNDMNDIFKDRREEYYFR

SEQ ID NO: 14179 - protein, 178 aa, Oryza sativa
MGRRPVRCYRQIKNKPYPKSRYCRGVPDPKIRIFDVGQKKRSADDFPLCVHPGEAWKKENVSSEALEAARIACNKYMAKHAGKDAFHLRVCAHPYHVLRINKMLSCAGADRLQTGMRGAFGKPTGTCARVRIGQVLLSVRCRDANAAHAQEALRRAKFKFPGRQRVIFSAKWYPTCVR

SEQ ID NO: 14180 - protein, 440 aa, Burkholderia xenovorans
MLSHQDNEILVRVGPGTPTGQFMRLFWLPFLPSSDLSVDGQPQRVRLLGEDLLAFRDSEGRVGLVDHACPHRGAPLVFGRNENSGLRCVYHGWQFGVDGRVIETPAEPIESRLKEKVRIKSYPCRERNGIVWTYMGDASADGLPPLPNLEWNMVPVENVHFSFRVQECNWLQAVEGEIDSAHAPILHGRIDSQGAINEWTAKRDLRPVFECQRQDFGISIASRRVLDEEHHYWRVNQFLFPFYTLVPPQSKYPELSGHAWVPIDDENTLCLMFSYTPATPLYEKTRQLFEQGHQGRETGHASVNAYEPRPVTNPYAKYWTRYNLESAFQFDYDAQTKTWFSGLPGLWVQDAACQSGVAPIYDRSKENLGISDTGVAMTRRLLLENVRKLAAERVSTVQVDEPDLWMVRAVSLTLQAGASWQNDGAVHMRARLGADFGYKP

SEQ ID NO: 14181 - protein, 457 aa, Streptomyces avermitilis
MNVSVVLFTSDLRLHDHPPLRAALDGARQVVPLFVRDRAVDGAGFAAPNRLAFLADCLRDLDAGLRERGGRLVLRSGDVVDQVCKVAAEADADEVHLAAGVSAYAHRREQRLRSALEADGRRLHVHETVITAVAPGAVTPSSSDHFAVFTPYFRHWEREHLRDALGAPRGVRVPESVGSERLPTRTELSGLSQGLAAGGEEEGRKRLMAWLRGGITAYEDRHDDLAGDATSHLSPHLHFGTLSPVELVHRARRTGGPGAEAFVRQLAWRDFHYQVLAARPDAATADYRGRGDRWRSEAAAREEVEAWRTGRTGYPVIDAAMRQLRHEGWMHNRGRLLTASFLTKTLYVDWRVGARHFLELLVDGDVANNQLNWQWMAGTGTDTRPNRVLNPVTQAKRYDPDGAYVRRWVPELEGLRGAAVHEPWKLKGLDRAAYDYPDPIVELADGLARFRHARGRD

SEQ ID NO: 14182 - protein, 112 aa, Mesorhizobium loti
MKIVMAIIKPFKLDEVREALTAVGIQGLTVTEVKGYGRQKGHTEIYRGAEYAVSFLPKIKIEVAVSADTVDKAVEAITAAAKTGQIGDGKIFVFGIDQAVRIRTGETDTDAL

SEQ ID NO: 14183 - protein, 247 aa, Trichodesmium erythraeum
MTTTLATPDTSLATIQAALPIDPQPYIIADRPTGLIVVDVLNGFCTVGFGPLAPQEPNEQIATMVSESDRLARTFVEKGWPVLAFLDTHEPGKPEPPYPPHCEKGTGEEELVPELQWLHDNPLATLVFKDCINGFIGSIDIDTQGNVLLDWINKNKLEALVVVGICTDICVMDFVVTILSVRNHGLAPTLKDVAVYDQGCATFDMTAQMAAEKGLPKTAIHPQKISHHVGLYTMAERGAFIASTIKL

SEQ ID NO: 14184 - protein, 216 aa, Triticum aestivum
  misc_feature (89)..(89): Xaa can be any naturally occurring amino acid
  misc_feature (192)..(192): Xaa can be any naturally occurring amino acid
  misc_feature (195)..(195): Xaa can be any naturally occurring amino acid
  misc_feature (202)..(203): Xaa can be any naturally occurring amino acid
  misc_feature (208)..(209): Xaa can be any naturally occurring amino acid
MVGFFRSGNLASRVFDRQFLSPRPGATLYSISLASSNEYICEDFFLYMECHQYGLFATSTARSNESSVTEGAIHGVPSIEKITFYLVRXIHVLQIRDSGSLVEVRRIGAFCREDDELFLYSHGQAAQGSSFLPGIKQRLLSFIFRKTWNEEPDQALRVQHLKKKFYFHFQDYVDLIIWKVQFLDRHHLFIKXFGXVNGRVTXXTDQKXXFFAVYNM

SEQ ID NO: 14185 - protein, 481 aa, Kluyveromyces lactis
MSDPKLTKAVDSICDQFIVTKSKISQLTEYFIDCMEKGLEPCESDISQNKGLPMIPTFVTDKPSGQEHGVTMLAADLGGTNFRVCSVELLGNHEFKIEQEKSKIPTFFFQDDHHVTSKDLFQHMALITHQFLTKHHKDVIQDYKWKMGFTFSYPVDQTSLSSGKLIRWTKGFKIGDTVGQDVVQLFQQELNDIGLSNVHVVALTNDTTGTLLARCYASSDAARAINEPVIGCIFGTGTNGCYMEKLENIHKLDPASREELLSQGKTHMCINTEWGSFDNELNHLPTTSYDIKIDQQFSTNPGFHLFEKRVSGLYLGEILRNILLDLEKQELFDLKESVLKNNPFILTTETLSHIEIDTVENDLQDTRDALLKAADLETTFEERVLIQKLVRAISRRAAFLAAVPIAAILIKTNALNQSYHCQVEVGCDGSVVEHYPGFRSMMRHALALSPIGPEGERDVHLRISKDGSGVGAALCALHANY

SEQ ID NO: 14186 - protein, 715 aa, Escherichia coli
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 14187 - protein, 145 aa, Glycine max
MGAFTDKQEALVSSSFEAFKTNIPQYSVVFYTSILEKAPVAKDLFSFLANGVDPTNPKLTGHAEKLFGLVRDSAGQLKASGTVVIDAALGSIHAQKAITDPQFVVVKEALLKTIKEAVGDKWSDELSSAWEVAYDELAAAIKKAF

SEQ ID NO: 14188 - protein, 339 aa, Pisum sativum
AQIGICYGMMGNNLPPANEVIALYKANNIKRMRLYDPNQPALNALRDSGIELILGIPNSDLQTLATNQDSARQWVQRNVLNFYPSVKIKYIAVGNEVSPVGGSSWLAQYVLPATQNVYQAIRAQGLHDQIKVTTAIDMTLIGNSFPPSKGSFRSDVRSYLDPFIGYLVYAGAPLLVNVYPYFSHIGNPRDISLPYALFTSPGVMVQDGPNGYQNLFDAMLDSVHAALDNTGIGWVNVVVSESGWPSDGGSATSYDNARIYLDNLIRHVGKGTPRRPWATEAYLFAMFDENQKSPELEKHFGVFYPNKQKKYPFGFGGERRDGEIVEGDFNGTVSLKSDM

SEQ ID NO: 14189 - protein, 181 aa, Fagus sylvatica
MASSMISSATVATVSRATPAQATMVAPFTGLKSTAAFPATQKSNNDITSLASNGGRVQCMKVWPPLGLQKFETLSYLPPLSLESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPK

SEQ ID NO: 14190 - protein, 482 aa, Unknown
  marine gamma proteobacterium HTCC2080
MVKHSNTEDPWALKVLAAVAELGPQRYYDPVITSEVVKNDLVSLIRASQKLKEKVAIASPEARHDRRNIIGAIRGYSEMLLEDSEVLPAAVRAHLLQILAAAKNEPKPASESATPTKSVTLLPSEEPGVILAVDDLPENRELVSRLLQKTGHTVISAESGEEALELLDTMGVDVVLLDLVMPGIGGAEVLKRLKEDERLRATPVVMISGQQDMDQIVMCIEAGADDYLLKPFNPVLLQARISAGIERKRWHDREELYREQLERREQFIRATFGRYLSDDIVDEILERPEGLELGGDLREVTIMMSDIRGFTTLVEHLPPQQVVTLLNRYLGRMTEIILEFGGTIDEFLGDAVLAVFGAPRRNDDDPDRAVRCALVMQEAMADINIANSADGLPEVEMAIALNTGSVVAGNIGSERRSKYGFVGHAMNVTSRIEDVAKPGEILISQTTYEKLESDYKFGNSRSLSVKGIEAELRVHAVLGGIQ

SEQ ID NO: 14191 - protein, 112 aa, Unknown
  Synechococcus sp. PCC 7002
MKKVEAIIRPFKLDEVKIALVNAGIVGMTVSEVRGFGRQKGQTERYRGSEYTVEFLQKLKIEIVIDDDQVDAVVDKIVAAARTGEIGDGKIFISPVDQIVRIRTGEKDLEAV

SEQ ID NO: 14192 - protein, 112 aa, Escherichia coli
MKLVTVIIKPFKLEDVREALSSIGIQGLTVTEVKGFGRQKGHAELYRGAEYSVNFLPKVKIDVAIADDQLDEVIDIVSKAAYTGKIGDGKIFVAELQRVIRIRTGEADEAAL

SEQ ID NO: 14193 - protein, 187 aa, Leptospira interrogans
MQPLDSKLESSPMEQATLGGGCFWCLEAVYQMVEGVESVTSGYAAGRTKNPDYRSVCSGTTGHAEVIQISFDPKIISYSEILEVFWISHDPTTLNRQGNDIGTQYRSIILCHSKEQKIQAEESIRKTEGHFLDPIITQVEELKEFYPAENYHQNYFRTNPEQSYCHYVIKPKIEKYLKTGFKVKSTN

SEQ ID NO: 14194 - protein, 892 aa, Oryza sativa
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVVVADAKDFDYGSGDVCGVLVQYPGTEGEVLDYAEFVRDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAHGLKKLGTVTVQELPFFDTVKVKDADANAIAQEACKNEMNLRVVDATTITVAFDETTTLEDVDKLFKVFNGGKPVNFTAESLVSEVSSSIPSSLVRKSPYLTHPIFNMYHTEHELLRYLHKLQSKDLSLCHSMIPLGSCTMKLNATVEMMPVTYPSFANMHPFAPTEQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICRIIHENGGQVYMDGANMNAQKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKVKYQYTAICFHILDCRVDNVYGDRNLICTLQQGSQVAEEAAAATA

SEQ ID NO: 14195 - protein, 65 aa, Protea laevis
  misc_feature (64)..(64): Xaa can be any naturally occurring amino acid
MPGQWEYQVGPSVGIEAGDHIWCSRYLLERITEQAGVVLTLDPKPIEGDWNGAGCHTNYSTKSXR

SEQ ID NO: 14196 - protein, 255 aa, Chlamydomonas reinhardtii
KIPFWEGQSYGVIPPGTKINSKGKEVPHGTRLYSIASSRYGDDFDGQTASLCVRRAVYVDPETGKEDPAKKGLCSNFLCDATPGTEISMTGPTGKVLLLPADANAPLICVATGTGIAPFRSFWRRCFIENVPSYKFTGLFWLFMGVANSDAKLYDEELQAIAKAYPGQFRLDYALSREQNNRKGGKMYIQDKVEEYADEIFDLLDNGAHMYFCGLKGMMPGIQDMLERVAKEKGLNYEEWVEGLKHKNQWHVEVY

SEQ ID NO: 14197 - protein, 164 aa, Bacteroides fragilis
MAAQNKSFYDFTVKTIDGKEYPLSGLKGKKVLVVNVASKCGLTPQYAELQELYDQYKDQNFVIIGFPANNFMGQEPGTNEEIAKFCSVNYDVTFPIMAKISVKGKDMAPLYHWLTEKKLNGKQDAPVQWNFQKFMIDENGNWVGFVAPKESPFSETIISWIEKK

SEQ ID NO: 14198 - protein, 174 aa, Streptomyces coelicolor
MATDVTTATAKPPLATIDSAHFRRVLGHFPTGVVVITAMADGEPAGLAVGSFASVSLDPPMVGFFPGKSSTSWPLVQRAGSFVVNVLGDHQQDVCRAFATSGGDKFTGIPWRRASNGAPALHDVIAWIECDIDTVTDAGDHWFVLGRVRDLALSTNTESPLLFFQGRYARVGAA

SEQ ID NO: 14199 - protein, 751 aa, Ralstonia eutropha
MTDKQHTRSVSESENPAIPSPTPKVSRPRRNKDWWPNQLDLSVLHTHSHLSCPLEEEFDYADQFKGLDVDALKQDLIQLMTTSQDWWPADYGHYGPLFIRMSWHAAGTYRIADGRGGGGEGQQRFAPLNSWPDNANLDKARRLLWPLKKKYGQKVSWADLLIFAGNVAYESMGFKTFGFGFGRPDVWEPEDIFWGPEDTWLGDERYSGDRELAKPLANVQMGLIYVNPEGPGGNPDPLAAARDIRETFARMAMNDEETVALIVGGHTVGKTHGAAPAAGNVGLEPEGAPIEEQGLGWKNKFGSGKGSDAITSGLEGAWTNNPTKWDNGFLENLFKYEWELTTSPAGAKQWKPKNPEANDTVPDAHGASRRHSPTMLTTDLSLRMDPIYGPIAKRFHDNPDQLEDAFAKAWFKLLHRDMGPRSRYLGPWIPEAQLWQDPIPPVDHELVSEQDIDALKRTILGSGLSVPELISTAWGAAASFRGTDKRGGANGARIRLAPQKDWESNEPSRLAKVLTALERIQNDFNGSQSGGKKVSLADLIVLGGCAAVEEAARKAGFNISVPFAPGRTDASQEQTDESIFDVLEPIGDAFRNYFRAEDPLSPETRLLDRANLLKLTAPQMTVLVGGMRMLDANHGQSRHGVFTDKPGTLSNEFFVNLLDIGTAWRPSVADKSVYEGIDRTSGKTRWTATAADLVFGAHSQLRALAEVYACDDGKERFVRDFVAAWNKVMNLDRYDLLGTRNGRRAVTSKPV

SEQ ID NO: 14200 - protein, 154 aa, Pinus taeda
AVTALPGFLSVASETVGDLESSSGKSALHLFGVYDGHGGSEVANFCKERLHGALIEELEAEMREGDRGEDECSWQRQWERAFVACFNKVDAEIGGVEPRNLRCENAAVEVGGRGNDESSARAAPEAAPADAVGSTAVVAVVGSSQIIVSNCGDS

SEQ ID NO: 14201 - protein, 590 aa, Unknown
  uncultured proteobacterium
MSNTTASTRVIYAATLTLAACSLLYELLIAQALATFAANTVTWYSVTVGLYLAGMGLGALLHDKHPTANLWARFFRVEVALSAAGAIAVPLLHLSHTGGLLLDINGYSLLGQLLFFGTGLLLITTIGVLTGVELPLLIDVANTASDKKRLTNRVLAADYMGSLLGGLAFPLLLVPHLSLVTIGLTTASMNITLAILALRTFIPSRSQFAFRFIPSGSLAVTIALGLYCAEPLDRYFTKLYYFYREQSHDLGQLFASMDNAEDVFRARSSYQRIDLVHAKKGFQADYLHGFYSNKFSEKPLLPKNYALFLNGDFQLSSNYEEYYHEFFAHFPIITNGSVPSRVLVMGGGDGLLLRELVKYADIQSIVHVDLDRELVELATTNPVLAAMNEGALNDPRIIRHFDDAYHYIRSTTDTYDAIYLDFPSPKDYNLAKLYSRELYHFARQKLRRDGFITLDAPGIETSKEMREIYTSTLAAAGFKFVTPYISKIENVNEDALEFLLASGYDSTKAKKIMARQAASMRLGFVIARDTWPDRPIYRDPEVVLYAINDARLFLTLNKNQYLPPVNPDKVNSIFRPTLQNMSVWNLRSAW

SEQ ID NO: 14202 - protein, 608 aa, Zea mays
RGVEDEWCCPRSADAVSFSSSSPEGEPENRFSQQSRQNKSKMRSSVSERSLIIESDDDDDDHPQSRSSAAARSRRRHHQHEEDSAAGSDSDSGSSSSSCGTPRGPATDSSYTQQWPQSYRQSIDILSSVQSPNLSFLGTPTLSRLSNSFRGKTPEIISNLVKPLLRPTTSDDHHHHHQQQPEERKSSQYLLPSRKPSLQQIPEDQKPVPVAHEVSPYHKCTYTQAVVNGINVLCGVGILSTPYAIKQGGWLGLVILCLFAILAWYTGVLLRRCLDSKEGLETYPDIGHAAFGATGRIAISIILYVELYACCIEYLILEGDNLSKLFPNAHLSVGSLTMNSHVLFTILTTIIVMPTTWLRDLSCLSYLSAGGVFASILGVICLFCVGVVDNVGFENKGTALNLPGIPIAIGLYGYCYSGHGVFPNIYSSLKKRNQFPSILFTCIGLSTILFAGAAVMGYKMFGEATQSQFTLNLPENLVVSKIAVWTTVANPITKYALTITPLTMSLEELLPPNQQKYSNIVMLRSALVVSTLLIALSVPFFGLVMALVGSLLTMLVTYILPCACFLAILRRKVSWHQVAVCSFIIVVGVCCACVGTYSSLSKIIQNYT

SEQ ID NO: 14203 - protein, 789 aa, Hordeum vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTFDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGIEVILDVVFNHTAEGNENGPILSFRGVDNTTYYMLAPKGEFYNYSGCGNTFNCNHPVVRQFIVDCLRYWVMEMHIDGFRFDLASIMTRGSSLWDPINVYGAPIEGDMITTGTPLVTPPLIDMISNDPILGGVKLIAEAWDAGGLYQVGQFPHWNVWSEWNGKYRDIVRQFIKGTDGFAGGFAECLCGSPQLYQAGGRKPWHSINFVCAHDGFTLADLVTYNNKYNLPNGEDNRDGENHNLSWNCGEEGEFARSSVKRLRKRQMRNFFVCLMVSQGVPMFYMGDEYGHTKGGNNNTYCHDSYVNYFRWDKKEEHSDLHRFCCLMTKFRKECEGLGLEDFPTAEQLQWHGHQPGKPDWSEKSRFVAFSMKDETKGEIYVAFNTSHLAAVVELPERIGHRWEPVVDTGKPAPYDFLTDDLPDRALTVQQFSHFLNSNLYPMLSYTSVILVSRPDV

SEQ ID NO: 14204 - protein, 428 aa, Hordeum vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTPDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGIEVILDVVFNHTAEGNENGPILSFRGVDNTTYYMLAPKGEFYNYSGCGNTFNCNHPVVRQFIVDCLRYWVMEMHIDGFRFDLASIMTRGSR

SEQ ID NO: 14205 - protein, 899 aa, Vibrio angustum
MISQGIKSACPYCGVGCGVVTKQSEIIGDVSHPTNRGALCVKGSSLAASMSQPNRLLYPQIKGEVVEWDQATSQIAETISRVIAESGPEAIGMYLSGQLLTEDYYVANKLMKGFIGSSHVDTNSRLCMASAVAAHNRAFGEDIVATNYSDLDNTDLIVLVGSNLAWTHPIVFKRIQQAKKQNPLLKIVVIDPRKTVTAEQADLHLALANDTDIDIYNGLIRYLIENNAVDRDFIAQVTEGFDALQQEVMKDKYSLLEVSKSSGIAIEQLATFYQWIKEAPRAVTVFCQGVNQASCGTDKANSIINSHLVSGKIAKQGCGPFSITGQPNAMGGREVGGLANQLAVHRGFDDISISQVKAFWQAPNIATTAGHKAVDLFKSVENGDIRVLWIMATNPVISMPDNEQVRRALEKCEYVIVSDVTPESDTAAYADCLLPAAAWGEKSGMVTNSERMMSRQRAFTAMPGEVKADWQMICDVAKKLGFSKAFDYQSEADIFREHAALSGINNSTDLLFDISCLALLSDDDYQTWQPQQWPLNSTSNRVFEQHNNLPLFSTPTRKAQLVVTPSPTENSLSNVMLAQDVSQSIFWLNTGRQRDQWHTMTRTGHVPVLAQSEVEPSLYIHPTSAKHVGLVDGSFVCIESLESYQDLNKHLARVVFDSTLSQQQVFMSMHWAGKYGAKSAINQSVIVACDPISGQPSFKSAQVKLTPISMEFHGVSLGDIPAQLDYEYASFQTYQNEHYQHKGIWRYAGKACLDKTALLRSLSESKQQYLLVEQKWGFALVQLAKVINPDAKLNTTAIHLFSEQPINVDMTTLVNSVNQPFVMTDVLEALGCQHSKQTLVCSCFQITDLMIEQAIVTNNITSLSDLTKQLKCGTNCGTCLPQVERHFYESQQLIPTVQL

SEQ ID NO: 14206 - protein, 459 aa, Arabidopsis thaliana
MASGCALHGGCPSDYVAVAISVICFFVLLSRSVLPCLIHKAPRTNSSSFWIPVIQVISSFNLLFSIMMSVNLLRFRTKHWWRYCYLWAVWIEGPLGFGLLMSCRITQAFQLYFIFVKKRLPPVKSYIFLPLVLLPWIFGAAIIHATKPLNDKCHMGLQWTFPVAGLHALYVLALIAFTRAVRHVEFRFDELRDLWKGILVSATSIVIWVTAFVLNEIHEEISWLQVASRFVLLVTGGILVVVFFSISSNQPLLSQISLKKRQNFEFQRMGQALGIPDSGLLFRKEEFRPVDPNEPLDKLLLNKRFRHSFMEFADSCYAGETLHFFEEVYEHGKIPEDDSIRRIYMARHIMEKFIVAGAEMELNLSHKTRQEILTTQDLTHTDLFKNALNEVMQLIKMNLVRDYWSSIYFIKFKEEESCHEAMHKERYSFSSPRLSSVQGSDDPFYQEHMSKSSRCSSPG

SEQ ID NO: 14207 - protein, 104 aa, Glycine max
  misc_feature (19)..(19): Xaa can be any naturally occurring amino acid
FVPKENQANPPSGKGLFVXKRKSVFPTIKQFGGFVKNFSVGEEAPPLKASFAGTKWAYPVEKNQKRAGPSFVYPVAQDNAPFEYAKRVKEKGFLFDIENDPPPV

SEQ ID NO: 14208 - protein, 295 aa, Vibrio angustum
MDDFSTIKRTAKQVLKSRFQSHDDQGDKKVLKPLSPASRKPDSGFVSLVGAGPSDPDLLTIKALHALEQAEVVVYDRLVSQDIIALANPDAIHIYVGKRCGKPSLSQEEINQILILEALKGQYVVRIKGGDPLIFGRGGEEALALVDANVNYEFIPGITAAIGCAASAGIPLTHREVSRSVTLVTGHVATGAFNAWSQLVANGQTLVFYMGLEKAQQIQNQLIEAKLSEETPVAVICHGCSVNQAVYIEQLKGLASLAEDLKGESPALIIIGDVVELREQLQRTARQLTEQVCLL

SEQ ID NO: 14209 - protein, 419 aa, Mycobacterium leprae
MPPWQRWAAADRFGAMREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 14210 - protein, 199 aa, Oryza sativa
MSMPEAGRSERDGREQDDDYEQQQARVLMALMQGFCAARYRKADNIPCPIVQGLYLGSVGAAMNKDALKSLNITHILIVARSLNPAFAAEFNYKKIEVLDSPDIDLAKHFDECFSFIDESISSGGNVLVHCFAGRSRSVTIIVAYLMKKHQMSLENALSLVRSKRPQVAPNEGFMSQLENFEKSMQVEQERKLMQPVQN

SEQ ID NO: 14211 - protein, 344 aa, Hordeum vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTFDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGQQQYILP

SEQ ID NO: 14212 - protein, 476 aa, Oryza sativa
MGAHRTRQCSLLQLQPLRTCILFLLLLLLLLPCSASSSVITHLPGFHGRLRFYLETGYVSVDEETGTELFYYFVESERSPSTDPVILWLTGGPLCSGFTALVFEVGPMNFVLAPYNGSLPRLVNNQYSWTKIASIIFLDTPVGSGFSYARDPKGYNVGDISSSLQVVTFLKKWFNDHPSYLSNHFYVGGSSYAGKGYMVGSPLTDPKYDRNSIIPYAHGVGIISDQLYEAAVANCKGDYVNPTNEICANVLNAVDNLMSELDNGDILLDKCAGRLIPKPINGVSSRALLEEYSRLSEPTARPTINCFSYRFYLLNIWMNDKATRDALKIKKGTVGVWTRCNTEVFPYARDVPSTIQYHLNLTTRGYRALVFCGDHDLMVPFLGTQAWIRSLNFTIIDDWRAWHLDGQAAGFTVMYDNNLTFATLKGSGHAPISYKPKQGFAMGQRWLDHYITRWKLNVLTVDGETDFTVKVTGKMK

SEQ ID NO: 14213 - protein, 838 aa, Vibrio angustum
MNNGMDKQHLIVIGNGMVGHHFIDQLVDKGGLAHYCITVIGEESVAAYDRVQLSAMFADKSQQDLMLGDVSWYQNQGIDLRLGQQVVEINRAQQTVNIRDVVTSELICLDYDKLVLATGSTPFVPPIKGNDRQNCFVYRTVDDLAAIKNACSQAKTGAVIGGGLLGLEAANALRLLGLETHVVEFAPRLMPVQLDDLAGDLLAKKITKLGVHIHTDMRTEKITDGETATHRLWFENDTPLDVDVIVFSAGIRPQDTLARQCELEIGERGGIVIDDTCLTSDANIYAIGECALWQARIFGLVAPGYSMARTVASQLVSDTEAKFIGADMSTKLKLLGVEVASIGDAQMRTEGAKEVVLQDSAGGRYKKLVVNADSTQILGAILVGDSSDYDALLQCYLNQTILTEHPAQLLFDTSMLAPSTDENSVVCSCHNVTRGALISQVQQGCHELGEIKQVTKAGTGCGGCSSMVKQIVDEQLASMGMEVNNHVCQHFSYTRQELFHLCQVEKIQDFETLLSTHGKGLGCDICKPTAASIFASLWNEHVLESPYQPLQDSNDAFLANIQKDGSYSVVPRVPGGEITPDKLITLGEVAKKYDLYTKITGGQRVDLFGAQLSQLPDIWAELIEAGFETGHAYGKSLRTVKSCVGSTWCRYGVDDSMALSIELENRYKGLRSPHKLKFAVSGCTRECAEAQSKDIGIIATEQGWNLYVGGNGGMRPRHGDLFAVDLDKPTLIAYIDRILMFYVKTADRLQRTSVWLENLEGGLDYLKQVVIEDKLAINTSLEQQMEHVINSYQCEWKTTLSSEQKLNRFRQFVNLKDEEISLPYQRIRGQRIPIKEEL

SEQ ID NO: 14214 - protein, 133 aa, Vibrio parahaemolyticus
ILHTMLRVGDLDKSIKFYTEVMGMQLLRTNENKEYEYTLAFVGYGDESQGAVIELTYNWGKTEYDLGTAFGHIAIGVDDIYATCDAIKAAGGNVTREAGPVKGGTTHIAFVKDPDGYMIELIQNKQASAGLEG

SEQ ID NO: 14215 - protein, 394 aa, Unknown
  uncultured bacterium
MINTPDPSKRALILRLLERFIQTESSGGVIMIIFAALAMIAANSALAGWYGAFVDAPITLGSITEPVNGWVKDVLMVLFFLTVGMELKREMAEGLLAQKGQVFMPLLAAIGGMAVPALLFYALNHSNPETVKGWAIPSATDIAFALCILMMFGKSVPASAKILLLAIAIFDDLGAIIIIALFYNTKIAVVPLLFTAGGAGLLALLNRCKISAITPYILTGIYLWFCLHEAGIHTTIAGVAVGMAIPMRDRKHSSNSPLNKCMHFLHPWVSFGVLPIFAFVSAGVNFADMHLSELFEPLPLGIALGLFVGKQIGIFGMIFLLVKAGLAKLPEGTGFGHVYAVSIIAGIGFTMSLFISLLAFPGHHLQEVAKIGVIAGSLLSTLYGGLVLFCVSKR

SEQ ID NO: 14216 - protein, 449 aa, Streptococcus mutans
MTHIKFDYSKVLGKFLASHELDYIQMQVTAADEALRKGTGPGAEMTGWLNLPQNYDKEEFARIKKAAEKIKSDSEVLVVIGIGGSYLGARAAIDFLNSSFVNLENKEERKAPQILYAGNSISSNYLADLVDYVADKDFSVNVISKSGTTTEPAIAFRVFKDLLVKKYGQEEANQRIYATTDRVKGAVKVEADANGWETFVVPDSVGGRFTVLTAVGLLPIAASGADLDQLMAGAEAARQDYSSAELSENEAYQYAAIRNILYRKGYVTEVLANYEPSLQYFSEWWKQLAGESEGKDQKGIYPTSANFSTDLHSLGQFIQEGNRNLFETVIRVEKARKNILVPEAAEDLDGLAYLQGKDVDFVNKKATDGVLLAHTDGGVPNTFLTIPEQDEFTLGYVIYFFELAIGLSGYLNGVNPFDQPGVEAYKKNMFALLGKPGFEELGAELNARL

SEQ ID NO: 14217 - protein, 714 aa, Methylobacillus flagellatus
MTAIKKTITYGQHELTLETGEIARQADGAVMVSYGDTVVLVSVVGKREVKEGQDFFPLTVDYQEKTYAAGKIPGGFFKREGRPSEKETLTSRLIDRPLRPLFPEAFYNEVQVVATVMSSDPEIDADIPAIIGASAALAISGIPFYGPIGAARVGYINGEYVLNPTASQLKETALDLVVAATESAVLMVESEAKELPEDVMLGSVVYGHEQMQIVISAINELAAEVGKEPWDWAPPEPNTELIAKVEALAGADINEAYKIKSKSARSSKLDEIRSRVLGELITETTSTSEANEIKSIFHNLEAKVVRSQILNGEPRIDGRDTRTVRPISIRTGVLPRTHGSALFTRGETQALVVATLGTGRDEQIIDALQGEYADRFMLHYNMPPYATGETGRVGTPKRREIGHGRLAKRALLAVLPSQEEFGYTIRVVSEITESNGSSSMASVCGGCLSLLDAGVPLKAHVAGIAMGLIKEGNRVAVLTDILGDEDHLGDMDFKVAGTESGITALQMDIKITGITAEIMRVALSQAKEGRLHILGLMKEAVGEQPQELSEFAPRIITMKINPEKIRDVIGKGGAVIRALTEETGTTIDIEEDGTIKIGCTSAEAGEEAKKRIEAITAEVEVGQVYDGTVLKLLDFGAIVSLLPGKDGLLHISQIAHQRVNAVADFLKEGQVVKVKVLEVDDKGRVRLSAKALIEAPSAEAPEEPAVAATGADQQ

SEQ ID NO: 14218 - protein, 519 aa, Desulfovibrio desulfuricans
MNKRIVTTALALATLLGVALLSGCQDVSTELKAPKYKTGIAETETKMSAFKGQFPQQYASYMKNNEDRIMTDYKGSVPYHKNDNVNPLPKGFKHAQPYLKNLWLGYPFMYEYNETRGHTYAIDDFLNIDRINRFAADGKGNLPATCWNCKTPKMMEWVSQYGDKFWSMDVNEFRAKDKINAHDETIGCANCHDPATMELRLYSEPLKDWLKRSGKDWQKMSRNEKRTLVCAQCHVEYYFTHKDNGPAAKPVFPWDNGFNPEDMYQYYKGHGAKGPDGKPGPFVDWVHAASKVPMIKMQHPEYETFQDGPHGAAGVSCADCHMQYVREDGKKISSHWMTSPMKDPEMRACRQCHADKTGEYLRQRVLYTQQKTFDQLLKAQEMSVKAHEAVRLANAYEGHRAANYEALMAEAREMVRKGQLFWDYVSAENSVGFHNPAKALDTLMTSMECSQKAVDLATEATDFGIAPALAGDIKKLVPPILTLSRKLQQDPEFLKQNPWTRLLPALPKAEQVWEGQDRA

SEQ ID NO: 14219 - protein, 418 aa, Triticum aestivum
MVLQTAQQEPSLTRPPHCSVASARSPAAMDTSPATPLLLQPPAPSIDPFAAKAAVNKGGGAATAVYDLRREPKIPAPFVWPHAEVAPHHGPGAGRARWWTWACCAMATPRGSGRAVAQVAAACATHGFFQVSGHGVDEALARAALDGASGFFRLPLAEKQRARRVPGTVSGYTSAHADRFASKLPWKETLSFGFHDRAGAAPVVVDYFTSTLGPDYEPMGRVYQEYCGKMKELSLRIMELLELSQGVEKRGYYREFFADSSSIMRCNYYPPCPEPERTLGTGPHCDPTALTILLQDDVGGLEVLVDGDWRPVRPVPGAMVINIGDTFMALSNGRYKSCLHRAVVNRRQERRSLAFFLCPREDRVVRPPPGLRSPRRYPDFTWADLMRFTQRHYRADTRTLDAFTQWFSSSSSSAQEAA

SEQ ID NO: 14220 - protein, 374 aa, Trichodesmium erythraeum
MARDYYEILGVSRSADKEELKRAYRRLARKYHPDVNKEPGSEERFKEINRAYEILSDPEMKARFDRFGEAGVSGGAASGFSTDFSDSFADIFESFFSGFGGAGTQGRRRTGPVRGDDLRLDLNLEFIEAIFGGDKELTIKHLETCGTCNGSGAKPGTKPQTCSTCGGTGQVRRATRTPFSSFTQVSVCPSCNGSGQIIEEKCVDCGGRGQKEATKKIKITIPGGVDNGTRLRVSNEGDAGRMGGPPGDLYVFLSVKNHPEFQRDGINIISQIKISYLQAILGCCLEINTVDGKTELTIPSGTQPNAILTLEDKGVPRLGNSVSRGAHLITIEIDIPTKITPEEKELLEKLAKIKGERTGKGGIEGFLGSWFQQK

SEQ ID NO: 14221 - protein, 225 aa, Oryza sativa
MSSPATAAAAAASCGVLRHHHPPASPRPPPTTTTTTSRLLLASRSRGLQRPLRVNHAPPRRLPPTAARAQSAAAAGYQPESEFYKVEAILRPWRVPYVSSGLLQMGIRGVTVSDVRGFGAQGGSTERHEGSEFAEDTFIDKVKMEIVVSKDQVEAVVDKIIEKARTGEIGDGKIFYHFPVSHCSPLYQMIPVSDVIRIRTGERGERAERMAGGLADKLSSAMPIS

SEQ ID NO: 14222 - protein, 483 aa, Rhizobium leguminosarum
MAKDAAKPVILWFRKDLRLDDNQALTAAHRSGRPIIPLYIGEPAAAGTGPLGAAQAWWLHHSLEALNRSLQKRHGRLVLASGEALEVLRAFIKESGAEAVFWNRRYDPAGISIDARIKHELEKQAIEARSFGGQLLHEPSRLMTGNGTPYRVYTPFWRALEGGDEPEPPLEAPAELRLTSQLPTSETLESWKLLPTKPDWAGDFVDLWTPGEEGAQQRLHAFVEDALEGYKENRDYPARPATSMLSPHLALGEISPARIWDATRGLSQRVPAADIVHFRKEIAWREFSYHLLFHFPRLASANWNDRFDGLEWCNDSDDFEAWRRGMTGYPIVDAGMRQLWRHGWMHNRVRMIVASFLIKDLMIDWRRGEAWFRDTLVDADPANNAASWQWVAGSGADASPFFRIFNPVLQGEKFDPNGDYVKTYVPELRELGAKYIHRPFEAPKSMLDEAGITLGQTYPRPIVDHASARNRALAAYSATRDAA

SEQ ID NO: 14223 - protein, 715 aa, Clostridium cellulovorans
MFNISKKKAQALLLSGILGATSFTPAVLVKGETTATPTFNYGEALQKSIMFYEFQRSGKLPTDIRSNWRGDSGTKDGSDVGVDLTGGWYDAGDHVKFNLPMSYTVAMLAWSLSEDKAAYEKSGQLDYLVKEIKWATDYLMKCHTAPNEYYYQVGDGGADHKWWGPAEVMQMARPAYKVDLQKPGSSVVAETAAALASTAFALKDIDKAYSEQCIQHAKELYNFADTTKSDAGYTAANTYYNSWSGYYDELSWAAAWLYMATNDASYLEKAESYVPFWKVEQQTTTIAYRWAHCWDDVHFGAQLLLARLTGKSIYKESVERNLDYWTTGYDGNKIKYTPKGLAWMDSWGSLRYATTTAFLADVYASSDVCSISKVDTYKNFAKSQADYALGSTGRSFVVGFGENAPKKPHHRTAHSSWSDQQVNPTDHRHVLYGALVGGPDASDGYTDAIDNFTNNEVACDYNAGFVGLLARQYSKYGGDPIPDFKAIEKPTNDEFFVEAGVNCTGPNFVEIKALVNNRTGWPARMGDKLSFKYFINVSEFVNAGYSADDLKVTVGYNTGGTVSNLIPWDKENNIYYVNVDFTGVKIYPGGQSDYKKEIQFRISGIQNVNIWDNSDDFSYEGITKTPGETPVKVTNIPVYDNGVKVFGNEPGTTKPPVIAGDVNNNGIVNSMDLAMLKKYILGYEVEMNKEASDLNKDGKINAIDFALLKKLLLSQ

SEQ ID NO: 14224 - protein, 169 aa, Streptococcus mutans
MERAIFAGGCFWCMVQPFEEQDGILSVRSGYTGGHVVNPTYEQVCSKMTGHTEAVEIIFDESKISYADLVEIYWRQTDPTDSFGQFEDRGDNYRPVIFYFDEQQRKIAEQSKANLQASGHFNRPIVTTIEAAQPFYEAEKDHQAFYRKNPERYARSSAIRHHFLKENWS

SEQ ID NO: 14225 - protein, 303 aa, Acidobacteria bacterium
MPAEKFTIGLIQMSCGPVPEENMAKALDRVRDAAKQGATVICLPELFQTQYFCQREDTALFELAESIPGPATKKMGDLARELGVVVVASLFERRAPGLYHNTAAILDEAGALKGIYRKMHIPDDPLYYEKYYFTPGDLGFKTFETKFGPIGTLVCWDQWYPEGARLTALQGAQVLFYPTAIGWHPAEKAEFGESQHDAWRTIQRSHAIANGVYVGVVNRVGKEYGDIRGNRAEGAGLEFWGGSFIADPFGQVIAEASHDKEEILLADIDVKRMEDVRRNWPFLRDRRIDSYGKITHRFDDENR

SEQ ID NO: 14226 - protein, 340 aa, Pseudomonas aeruginosa
MTEQQPIAVLGGGSFGTAIANLLAENGQAVRQWMRDPEQAEAIRTRRENPRYLKGVKVHPGVDPVTDLERTLADCQLIFVALPSSALRKVLQPHQAALTDKLLVSLTKGIEAHTFKLMSEILEEIAPQARIGVISGPNLAREIAEHELTATVVASEDDELCARVQAALHGRTFRVYASRDRFGVELGGALKNVYAIMAGLAAAMDMGENTRSMLITRALAEMTRFAVKLGANPMTFLGLAGVGDLIVTCSSPKSRNYQVGHALGEGLSLEEAVSRMGETAEGVNTLKVLKEKSDEMQVYMPLVAGLHAILFEGRTLAQVIQLLMRGEPKTDVDFIPTTGF

SEQ ID NO: 14227 - protein, 315 aa, Buchnera aphidicola
MSKIYQDNSLTIGNTPLVRLNRIGNGNILVKIESRNPSFSVKCRIGANMIWHAEKNNNINKNVKLIEATSGNTGIALAYVAASRNYRLTLTMPETMSIERKKILKSLGAELILTDGRYGMKGAISKANDIISRNPSKYFLLKQFENPANPEIHQITTGPEIWNDTNGNLDILISAVGTGGTITGITRYIKKIKRKKNLISIAVEPSESPVITQFLAGKAIEPGPHKIQGIGPGFIPKNLDLTIIDQVITVSSEEAILTAKELMKKEGILAGISSGAALYAAIKIQQQKKFSDKKIVVILPSSGERYLSTELFSEL

SEQ ID NO: 14228 - protein, 313 aa, Xanthomonas axonopodis
MELGMVGLGRMGANMAERLVNGGHRVHGYDPGANARTSAQAKGIVTADALAALVSALPSPRVVWLMVPAGKIVDDTLAQLLPLLQAGDIVIDGGNSYYKDSQRRAALLQASGIAFVDCGTSGGIWGLQEGYSLMVGGDEAAVTGLHPILATLAPAPDKGWGRVGPSGAGHFTKMVHNGIEYGMMQAYAEGFALMQHKADFALDLHQVAEIWRDGSVVRSWLLDLTADALTHNPTMAGIAPFVADSGEGRWTVAEAIDLEVSAPVITLSLMERLRSRDKDSFTDKLLAAMRNQFGGHAVMTTTSAAPTIGSKDA

SEQ ID NO: 14229 - protein, 77 aa, Arabidopsis thaliana
  misc_feature (8)..(8): Xaa can be any naturally occurring amino acid
  misc_feature (13)..(13): Xaa can be any naturally occurring amino acid
  misc_feature (52)..(52): Xaa can be any naturally occurring amino acid
METPHTSXKPCPXPILQGIGGAFGMQAEWKNSPLISLKGLTTSPKGMRFFEXTHTASMKTPRSEGSFSHWRGLFFSF

SEQ ID NO: 14230 - protein, 328 aa, Guillardia theta
TFKMTPPCQVVPETLPYSNSNVNSPSKVTVPAQAHQQPSTPFDGYKFEPIREATVNRAMTSRYFRDLEAYAESDIVIVGAGSAGLSCAYELSKIAPDVKVAIIEQNVAPGGGAWLGGQLFSAMVIRKPAHLLLDELEVPYEDEGSYVVCKHAALMTSTLLSKVLKNGNVKLFNATAVEDLIVKQDPQGLKYCAGVVTNWTLVALNHDTQSCMDPNVIESKVIVSGCGHDGPFGAQCVKRLAKLGMLDEYAQNGIQGMGALDMNSAEDKIVNNTREVVPGMILTGMELAEVDGSPRMGPTFGAMFVSGQRAAHLALAALRKKQEEETKV

SEQ ID NO: 14231 - protein, 306 aa, Triticum aestivum
  misc_feature (267)..(267): Xaa can be any naturally occurring amino acid
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPXDQQRLIFAGKQLEDGRTLADYNIQKESTLHLVLRLRGGQ

SEQ ID NO: 14232 - protein, 171 aa, Ehrlichia canis
MDNKFSIFKKGQYVLDLGSFPGGWSQFAAQKVSHGNNNLVFSVDIQNMDAIPNVIFIKCDISNEIEILNDKFHNKKFDVILSDMAPKACGNKQVDHANIINLCEMSLDIVIKFARENGTFITKILQGEYEKEFYQSMKSNFKLVKYFKPKASRKDSSEIYLVGLGFKKDFQ

SEQ ID NO: 14233 - protein, 285 aa, Unknown
  uncultured bacterium 311
MSLVEGKNCLITGATSGIGRSTALALSEKGANIFFIARNQQKAEELTEEVERVSGKSPNAIIADLSSFKQIERAAEEFKSLNKPIDVLLNNAGIMNTERRVTEDGLEEVFAVNHLAYFLLTNLLIEKILESGLKRVVNVSSDAHRFLKSMNFDDLQSEKEFKMFAAYGQSKLANILFTRKLSSLYQEEGLTTNCLHPGFVSTSIGAQNENLAFFARLIRWVSPLIAKPSDKGAETSIYLCSSEEVSSTSGEYFIDCKKAPITKAAESKEDAEKLWQISLELTGLK

SEQ ID NO: 14234 - protein, 740 aa, Cellulomonas flavigena
APAYNYAEALQKSMFFYQAQASGDLPANYPVSWRGDSGMSDGSDVGVGLTGGWYDAGDHVKFGFPMAFTTTMLAWGAVESPAGYTKSGQLDELKGNLKWVNDYFIKAHTKPNELYVQVGGGEADHKWWGPAEVMTMARPAYKITASCPGSDAAAETAAAMASSSLVFADSDPSYAATLVTHAKQLYSFADTYRGAYSDCVKDAQAYYKSWSGYQDELVWGAYWLYKATGDATYLAKAEAEYDKLGTENQSTTKSFKWTVAWDNKQFATYALLAMETGKQKYVDDANRWLDYWTVGAEGQRIAYSPGGMAVLDSWGALRYAANTSFVALVYSDWITDSTRKARYQDFGVKQINYALGDNPRKSSYVVGFGTNPPTMPHHRTAHGSWLDSITTPAASRHVLYGALVGGPSAANDAYKDDRQDYVANEVATDYNAGFTSALAYLVDRYGGTALTNFPVAETPDGDEIFVEAQLNQAPGSTFTEVKAMIRNQSAFPARSLMNGKLRYWFRTDGFAASDVTLAANYSECGPQSGKGASAGGDLAYVELSCVGQNIHPGGQSQHRREIQFRLTGPAGWDATDDPSFTGLTQTGLAKTKNITMYDGTTLIWGTEPTGTQVPDDTTAPTAPGLPVASAVTSTSATLTWPASSDDTGVVGYDVYRVQGTTSTLVASPTAATTSLTGPTAGTAHTYSVKARDAAGNVSASSPSVTFTTTTAPADTTAPTVPGTPAATAVTTTGALLSWTA

SEQ ID NO: 14235 - protein, 313 aa, Xanthomonas campestris
MELGMVGLGRMGANMAERLVNGGHRVHGYDPGANARTSAQAKGIVTADALAALVSALPSPRVVWLMVPAGKIVDDTLAQLLPLLQAGDIVIDGGNSYYKDSQRRAALLQDSGIAFVDCGTSGGIWGLQEGYSLMVGGDEAAVTALHPILATLAPAPDKGWGRVGPSGAGHFTKMVHNGIEYGMMQAYAEGFALMQHKADFALDLHQVAEIWRDGSVVRSWLLDLTADALTHNPTMAGIAPFVADSGEGRWTVAEAIDLEVSAPVITLSLMERLRSRDKDSFTDKLLAAMRNQFGGHAVMTTTPAAPTIGSKDA

SEQ ID NO: 14236 - protein, 533 aa, Oryza sativa
NGRGGSELASGELLQVQSRGPFSAALLTISSLVAMALLRCLFLLAVLLPHRNAAVVAAASPHHGPAPHDYRDALTKSILFFEGQRSGKLPPSQRVSWRGDSGLSDGSSIKVDLVGGYYDAGDNMKFGFPLAFSMTMLAWSVVEFGGLMKGELQHARDAVRWGSDYLLKATAHPDTVYVQVGDANRDHACWERPEDMDTPRTVYKVDPSTPGTDVAAETAAALAAASLVFRKSDPAYASRLVARAKRVFEFADKHRGTYSTRLSPYVCPYYCSYSGYQDELLWGAAWLHRATKNPTYLSYIQMNGQVLGADEQDNTFGWDNKHAGARILIAKAFLVQKVAALHEYKGHADSFICSMVPGTPTDQTQYTRGGLLFKLSDSNMQYVTSSSFLLLTYAKYLAFSKTTVSCGGAAVTPARLRAIARQQVDYLLGSNPMGMSYMVGYGAKYPRRIHHRASSLPSVAAHPARIGCSQGFTALYSGVANPNVLVGAVVGGPNLQDQFPDQRSDHEHSEPATYINAPLVGALAYLAHSYGQL

SEQ ID NO: 14237 - protein, 296 aa, Saccharomyces cerevisiae
MITTPLVHVASVEKGRSYEDFQKVYNAIALKLREDDEYDNYIGYGPVLVKLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 14238 - protein, 390 aa, Novosphingobium aromaticivorans
MAGIEGFAAIRGKLAQSEAAPGIVLIACAALALLIANSPLAAAWHALFHHPLPWTPVAKLDTLHLWINDGLMAVFFFVVGLEIKREVLAGELSDARRRRLPVLAAVAGMAVPALIYLAITAGQPALHRGWAIPSATDIAFAIGVLALVGRGLPPSLRLFLLTVAIVDDLGAVVVIALFYTSGLKLAWLGASALILAALVLVNRMGVRALLPYLAGAVALWYTVLHSGIHATVAGVLAAMTVPLALNRRHDSPLLRLEHALVAPNGFVIVPLFGLANAGVALGADFGESPALPLGIAMGLLLGKQFGILGSILVAERLGFAHRPEGASLRHLWGIALLCGIGFTMSLFIAGLAFPETPMLVEEAKLGILGGSLVSALAGLLVLRGSGRPVV

SEQ ID NO: 14239 - protein, 885 aa, Rhizobium leguminosarum
MAAEVKTTCPYCGVGCGVLATVDEAGAVSVKGDPEHPSNFGRLCSKGSALAETIDLDGRLLHPEIEGKQSGWDEALDLVARRFSETIAEHGPDAVAFYVSGQLLTEDYYVANKLMKGFIGSGNIDTNSRLCMSSSVAGHRRAFGADTVPGTYEDIELADLVILTGSNLAWCHPVIYQRLAAAKTARPNMRIVVIDPRRTMTCDIADLHLAIRPDGDVALFMGLLAHLATSPAIDQNYIGAHTEGFGDAFAAAAALDINDLLERTGLPAMQIREFFRLFETTPKVVTCYSQGVNQSSSGTDKVNAILNCHLATGRIGRPGMGPFSLTGQPNAMGGREVGGLANMLAAHMAIENSEDRDRVQRFWNSPVIAAKPGLKAVDMFQAVADGRIKALWIMATNPVVSMPDADSVESAIAACPFVVVSDILKETDTTRHANVLLPSLGWGEKDGTVTNSERRISRQRPFLDVPGDARADWWQLAEVGRRMGFAAAFDFDAPAAIFDEHAALSAFENNGSRDFDIGARAGLSGGAYDELSPFQWPQAAGTEPSITRFFAEGGFFHPDRKARFVAVKPPATDRTNAEYPFTLNTGRIRDQWHTMTRTGKSARLSAHIAEPFAEIHPRDAIETGIASAGLVEIDSPHGKAIVRALVTDRQARGGIFAPMHWNDQFAARARIDAVVAPITDPISGQPASKNVAVAVRPFRATHYGFAVSATKPATPDAAYWALAKAAGGWRLELAFGETVEDWTAWCRAVFAIPAEIEPLGYADRQSGDLRLAFFDGEVLLAALFLAREPVAVARNWAISQLSASHGDLRKRFALVAGRPGAGRPDPGATVCSCFSVGVNQIAAAVRGGCHSVEAVGKETSAGTNCGSCRSEIGSIIDRCLAAAAE

SEQ ID NO: 14240 - protein, 816 aa, Rhizobium leguminosarum
MTEKLVIIGNGMAPGRMLEHLFEQAPGRYEVTIFNAEPRVNYDRIMLSPVLSGEKDYEQIIIHGDGWYIKHGIMLYKGHKIVNIDRAAKTVTSDHGVTESYDKLVIATGSVPFIIPVPGKDLPGVITYRDLDDVQAMLLAAQSREKAVVIGGGLLGLEAAAGLAQRGMDVTVLHVMPTLMERQLDPAAGYLLQKAVEERGIKVICKANTKAIVGNGKVEGIELDDGRIIPATLVVMAVGIRPSVGLAKDAGIAVNRGIVVDAGMQTSDGDILALGECAEVGGMVYGLVAPLYEMARIAASHLSGDRSPAFVHADTPTKLKVTGIELYSLGDFADGDDREEIVLRDASAGVYKRLVLKDNKIIGTVLYGETADGAWFNDLKKKATDISEMRETLIFGQAYQGGSPLDPMAAVAALPDDAEICGCNGVCKGKITSTISGKGLTSLDDVRAHTKASASCGSCTGLVEQLMALTLGDSYNPTAVQPMCTCTELGHDDVRRLIKAKGLKSIPAVMQELEWKTSCGCAKCRPALNYYLVCDWPDEYADDYQSRFINERVHANIQKDGTYSVVPRMWGGVTNSNELRAIADVVDKFEIPMVKVTGGQRIDLLGIEKEDLPAVWADLGKAGFVSGQAYAKGLRTVKTCVGSDWCRFGTQDSTGLGIRIERFMWGSWTPAKLKMAVSGCPRNCAEATCKDIGVICVDSGFEIHFAGAAGLDIKGTEVLGLVRTEDEALEYIVALTQMYREQARYLERIYKWAKRIGLEEIRRQIMGDAEKRKAYYERFVFSQKFAQVDPWSERVSGKDKHEFKPMATIGYPQAAE

SEQ ID NO: 14241 - protein, 132 aa, Methylobacillus flagellatus
MRILHTMLRVGDLEKSLAFYTQVLGMKLLRRHEYPDGKFTLAFVGYGSERDQAVIELTYNWYTSSYDKGNAYGHIAIEVDDAYAACEAVRQAGGKVVREAGPMMHGTTVIAFIEDPDGYKVEFIQKGTWTPA

SEQ ID NO: 14242 - protein, 112 aa, Burkholderia xenovorans
MKLITAIIKPFKLDEAREALSAIGVSGITVTEVKGFGRQKGHTELYRGAEYVVDFLPKVKIEAAVSDDIVDQAIEALERAARTGKIGDGKIFVTPIEQVIRIRTGETGADAL

SEQ ID NO: 14243 - protein, 418 aa, Myxococcus xanthus
MENIRTLAEVDPEIARVLREETQRQEEGLELIASENFVSPAVMEAVGSVLTNKYAEGYPGKRYYGGCEVVDVAENLAIARAKDLFGADAVNVQAHSGSQANMGAFMALMKPGDTMLSLDLNSGGHLTHGATFNFSGKLYKVVHYGLTRDTETIDFAQVESLAKEHKPKVIVVGASAYPRTLDFAKFREIADAVGAAMLVDMAHIAGLVAAGVHPSPVPVADIVTSTTHKTLRGPRGGLVLSREPYAKAINSQIFPGIQGGPLMHVIAGKAVAFKEALSPEFKAYQRQIVANAKALAEALQRAGLRLTSGGTDNHLMLVDLRPKKLTGKVAEEVLDKAGITVNKNMIPFDPEKPMTTSGVRVGTPAITTRGMREAEMAVVGRLIGEALDAAQDDAALARIKGQVKELSQGFPLYASRLK

SEQ ID NO: 14244 - protein, 273 aa, Oryza sativa
MARLLLPLPIAAAAASRLRLPVLSSSVARLKALLFGGRVAAARAPVRLARKGVTPGAKAGGSSSAAAEAQVIGQDKALNGFYTECLGMKLLRKRDIPEERYTNAFLGYGPEDSHFVVELTYNYGVESYDIGTAFGHFGIAVEDVAKTVDLIKAKGGTVTREPGPVKGGKSVIAFIEDPDGYKFELIERGPTPEPLCQYLVFIIIIHSATNLYYIFIIRHLAWNFSGNETIPNTRISCVMFVLFFVFTHESGNKIYFSGTVAIQAMDKGHCQKD

SEQ ID NO: 14245 - protein, 770 aa, Unknown
  Silicibacter sp. TM1040
MKAPLRKLLQSKGILSQIVVSMSLAALLVVVAVGGVARRYEVERVSEQLSEQANLTVSLLSGLMLEAIIVEDVPVLETGLVEAITRYPKILSINIENSEGEVIAEASNSAADEAEGYVMYRRPVEFEGFVFGTMVVQWSTAEGREIVLDKVRQTITWTVLAVIAMSLLMLYLVYRLALNPLQIVHARMSNAVAGAKTGHFSLPWYSSREFQALNVSVGVLEDSFAERDEREKALEHAREQAEIASRAKSEFLANMSHEIRTPMNGVIGMAEVLRETELTPDQELYTETIVKSGNALLSIINDILSFSKIEAGKLELTQATFNLRTVIEDVIMLLAPKAAEKWVQLTLRYDPDLAEFYDGDAGRIRQIVTNVVGNAVKFTSRGSVHIDVTGVARGQLMDLRISVVDTGIGIPAEKLDRIFHAFEQVDGAATRNFEGTGLGLAISTRLLQMMKGRIHVTSSEGKGSVFTIDISLPTSDRAPVAFLPEQPVSGLHALIVDDLELNRRILGERLRSWGLRVTEAASAMEAMLHLDEMRDATDTCDLIFLDYNMPDCDGYELALRIRGLPNTASVPIIVISSVDPALSQSMLADIEVCHQVLKPVRADDLRGVISQALGAGSAVEERAPSGSEDAKIMQRIKVLMAEDNRTNQVVVTRMLKSESVDIIIASNGQEAIEMYLRERPDVILMDMMMPVMDGLDATKAIRKIENETGVRQVPIIALTANALQSHEEACLEVGMDDFLSKPIRKQALLDALHQWTEDRDSAEPQNKLEA

SEQ ID NO: 14246 - protein, 413 aa, Caulobacter crescentus
MLQRVRKLSLLRELLESGAAGGLLLMACAVLALFVANSPLAEGYFHALHVPFAGLDLLHWINDGLMAIFFLFVGLEIKREFLDGQLSTWANRALPCIAAAGGVVVPGLIYASLNAGSPETLRGWAIPTATDIAFALGVLSLLGSRVPTSLKIFLATLAIVDDLVAVLIIAVFYTAELNTAALMGAALVTLVLLGFNRLKVKRLAPYLVMGVALWWLVLLSGVHATIAGVVLAMTIPLHASKAAPDDATSPLHRLEHALSPWVAFLVVPIFGFANAGLSFAGMTPSVLAEPVTLGVALGLFFGKQIGVFGAAWLAIRLGVARLPVAASWAQLYGVSLLCGIGFTMSLFIGLLAFRDAALQNEVKVGVLVGSLSSALIGATLLSLTKRRLPAVDPSRDHQADATALDDLGREDAR

SEQ ID NO: 14247 - protein, 320 aa, Haemophilus somnus
FFVLVGLEVKREMLIGAISSYQKAIFPAIAACGGMIVPALVYWLVNQGVPDYHGGWAIPMATDIAFAIGVLVLLGTRVPLALKVFLLALAIIDDLGAIIVIALFFSHDLSTKALILASIAIVGLILLNRFKVSNLIAYVVVGIILWVSVLKSGVHATLAGVIIGFCVPLKGKNNSEPLVEMEHAIAPWSSFLILPLFAFCNAGISLSGLGMEALTSPLTLGVTLGLLLGKPIGVFLFSYLSVKLHIAKLPEGINFKQIFAVSVLCGIGFTMSMFLASLAFGGGDGHLTAYARLGILFGSSVSAVVGYWLLFVTTKENANQ

SEQ ID NO: 14248 - protein, 635 aa, Coffea canephora
MPMTMILPPSSREMMGLGLGCSPSSKTLAFRHPNTLPNYINCSLQTPSILHFPKQSSATTSSPPSSSSAKTAYPALFLPGSSAAIATPSKTPTGTATVPTPSPSISASPSPSRSPSTTPQWNVLQRAAAMALDAVETALTARELEQPLPKTADPRIQISGNFAPVPEQPVRHALPVTGKIPNSIQGVYVRNGANPLFEPAAGHHFFDGDGMIHALQFQNGSASYACRFTETQRLAQERSLGRPVFPKAIGELHGHSGIARLMLFYARGVFGLLDHSQGTGVANAGLVYFNNRLLAMSEDDLPYHVRITPSGDLKTVERYSFNGQLKSTMIAHPKLDPVTGELFALSYDVIQKPYLKYFRFSKAGEKSKDIEIPVPEPTMMHDFAITDNFVVIPDQQVVFKMSEMIRGGSPVVYDKEKVSRFGVLDKYAEDSSAIKWVEVPDCFCFHLWNAWEEPETDEIVVIGSCMTPPDSIFNECDEGLKSVLSEIRLNLKTGKSTRRAIISNPEDQVNLEAGMVNRNKLGRKTRYAYLAIAEPWPKVSGFAKVDLFTGEVRKFIYGDEKYGGEPLFLPRDPNCEAEDDGYILAFVHDEKEWKSELRIVNAMTLELEASVQLPSRVPYGFHGTFISAKDLASQA

SEQ ID NO: 14249 - protein, 400 aa, Kluyveromyces lactis
MGQLLSHPLTEKTIIYNDYQTSGHKLSLRHDTHQEVEIPRFYNCVGSMQGYRLTQEDAHLVKTGSESLIVSFHDPFIGKVVKYQISIFAVFDGHGDNNCSNYLAGSLYEHTHPQAHSTTDRILTEHDGLIYFIKLAFESHKYTSFSRPDGNKRQFRTLEGLICQVIKDSFKACDAAFHKHFANEASGSTAIVALLINGSMLYVANTGDSRCILSKKNKAIKPMSYDHKPQHIGELIRINDDGGTVSLGRVGGVLALSRAFGDFQFKRNVKYQNLNTLAVSSKRKYIPAEEAQVTVEPDVLPHAIDLSQDEFLVLACDGIWDVYSNKALVNFIKYHLTLGLKLDNILAKILDHGISCADSNTGVGFDNFTLIVVVLQQPGETLDEWYARIKSRLEREKGLL

SEQ ID NO: 14250 - protein, 257 aa, Archaeoglobus fulgidus
MTTSEKIRIALAQQRILPDREVNIMKGMSLIKRAIQVRADMVILPEVFNTGFYKHNYETVEPLEEELSLLLKISEQKDIMIITGVAEREGDDLYNSAVIIHKGKIIGKYRKTHLFPLTNEKKYFKAGDKLEVFETHLGKIGLLICYEVRFPELSRKLVKMGAEIIVIPAEFPKERIDHWRVLLQARAIENQVFVAGVNCVEGDLDYGGHSMLIDPMGTVLIEASEYQEVMMSDIRLGDVYEVRKKFPFLNDLREELL

SEQ ID NO: 14251 - protein, 65 aa, Protea restionifolia
  misc_feature (47)..(47): Xaa can be any naturally occurring amino acid
MPGQWEYQVGPSVGIEAGDHIWCSRYLLERITEQAGVVLTLDPKPIXGDWNGAGCHTNYSTKSMR

SEQ ID NO: 14252 - protein, 153 aa, Pinus taeda
AVTALPGFLSVASETVGDLESSGKSALHLFGVYDGHGGSEVANFCKERLHGALIEELEAEMREGDRGEDECSWQRQWERAFVACFNKVDAEIGGVEPRNLRCENAAVEVGGRGNDESSARAAPEAAPADAVGSTAVVAVVGSSQIIVSNCGDS

SEQ ID NO: 14253 - protein, 65 aa, Protea curvata
  misc_feature (44)..(44): Xaa can be any naturally occurring amino acid
MPGQWEYQVGPSVGIEAGDHIWCSRYLLERITEQAGVVLTLDPXPIEGDWNGAGCHTNYSTKSMR

SEQ ID NO: 14254 - protein, 1095 aa, Physcomitrella patens
MDEFGRVSSGSSGVDRKQQEFSEHFRMPSLEPSTSFPTFGSYAGNNKKPMDRGNRGSLEVFGGAPRLMQAGVYGGPAVAENIEPQEGSPNLLQSVSGSLSSWSGVDVESPQHSLGPKVTSTVPALAQSSRKLAEIEKSLSERAMVVEGLTSKMNSARNSRSNSQSSRGNDHASDRDVMKPVKENSLSQELMAERVAEWGLVLRSSVDGQSQGVTTRKSEEMRMRRSSENYQRPSGSYRRFSEEYQKSEYIPRTRPGSRAHSEVSEEVPVRVSEDLLDALSSFKQTFVVSDATKPDYPIMYASAGFFSMTGYSPKEVIGYNCRFLQGPDTDPMEVEKIRQAVRTGKPFCGRLLNYRKDGTQFWNLLTITPIKDENDKVIKFIGMQVEVSKYTEGAKAVARRPNGLPESLIRYDARQKDKATESVTELVGAFKKPPPVTPPTQAIAADSFVSPLPGIHSISSPKFSNVKEHSHRGSSEPHPSLRHQKLSGVSEHDLMSTTRSKRTSGFLSLLGIGKSQRLMHEDIPESEFDPEVVMLGYERPESQDDFDRTLGIRRGIDLATTLERIDKNFVITDPRLPDNPIIFASDEFLELTEYTREEVLGRNCRFLQGQDTDQNTVQQIRDAIKENRDITVQLLNYTKSGKPFWNLFHLQAMRDQRGELQYFIGVQLDGSQYVEPVRHRLSDNTEKASAKLVRETARNIDVAVRELPDANTSPEDLWANHSEFVKPKPHMGGTAAWKALIKVRSSGQKLGLKHFKPIKPLGCGDTGSVHLVSLRGTGHVFAMKAMDKTVMLDRNKVHRACAERLILDLVDHPFLPTLYASFQTMTHVCLITDFCPGGELFLVLERQPKKHFQEDSARFYAAEVVLALEYLHCIGVVYRDLKPENILVTASGHVQLTDFDLSFVSSPRVEMVTPPKPKKKSRKKSKNVPRPVIFAEPVTSSNSFVGTEEYIAPEIISGLGHSSAVDWWALGILLYEMLFGRTPFRGKNRQNTFSNILEKELYFPSSIPVSLEAKLLIRDLLNKDPLKRLGSYRGANDIKNHPFFKDINWPLIRIMTPPPLEVPLNLTSSLPDFEDKDAELEWDDLEADSTFNDTF

SEQ ID NO: 14255 - protein, 244 aa, Guillardia theta
AAAASAAAFAPAPAGRLSAPAASRAAISRGPRMAVFEGSFSESVPFLKQPTNLDGSLPGDVGFDPLGFSEVFDVKVLREAELKHGRIAMLAVLGWLVQESYTFPFFDKVSPIEAHDLLVKSGGMSQILLWTSFLEIFGGIALFQTIQGTRYPGDFSFDPLGLSAGKNEANLEKYQLAEIKHGRLAMIAFGGFAHQYFITKQGVFEQLGTSSPSPASLRLTSAHKRDIYLQRQCAMWSCEISMKI

SEQ ID NO: 14256 - protein, 217 aa, Oryza sativa
MKGGESVPSWVELLLSTQFFTTCSSHLISPRNECNFFCIDCQTPQASFCYYCRLSHHSSHHVIQIRRSSYHDVVKVSELEDILDISDVQTYVINSSRVVYLTERPQLRSCGVSNTKLSSSQTYKCEICSRTLLDDFRFCSLGCNFAAIKRDNEKNVAQNGIASNANEVKIGTNNGSTNAGSANEISSDANNYRNEIPSSTRVIRHRRKGIPRRAPFF

SEQ ID NO: 14257 - protein, 1133 aa, Physcomitrella patens
MEEQDPASSIDRSKVTAAASGASRGRSKYIAAPRSERKSLEVFGGAPASARYLPGAGNAFGGNSVAEEEEETAAVPSPRIDPPWVVPKIGPKPSQNVQPASTLPMSSSASKPAPLPQIPPAVPQSYMSETTKAKAPLPWDINLEIPDYKPKPVIGAEETKTKPVIRHHRSSSDTMTNTLPDLKEERKSAIEKLKQQAEVDAKRDIAKKAKDDGARSPDRKEMSDDVMKGRAAEWGLVLKSDAETGKTQGVTIRKSGDRRSGGSESAGRVSMTLPTVTASIRTSEASDAGSDASHPSNLPKVSREVKEALSTFQQTFVVSDATQPDFPILYASAGFFNMTGYTPKEVIGRNCRFLQGAGTDNADVARIREALKEGKSFCGRLLNYKKDGSAFWNLLTITPIKDDDGKVLKFIGMQVEVSKHTEGKKEKSLRPNGLPESLIRYDARLQDKATAAVGDLVGAFKNPVAPSTPPDTLNTGPKSPPSLPPDLQLVDSATESKLASKSSLHDSTRRRSTGTNIMTRSDSRLSNLPENGQPAYPRRNRRSSGFLSIFGLGKPEPKSPDPEMDPQLRMLEDEDRPESFEVDLERSKEIRRGIDLATTLERIAKNFVITDPRLPDNPIIFASDEFLELTEYTREEILGRNCRFLQGPDTDLAVVDQIRDAIAARRDITVQLLNYTKSGKPFWNLFHLQAMRDHDGELQYFIGVQLDGSEYLEPERRRLSEKTEKEGAKVVQETANNIDDAVRELPDANLKPEDLWSKHSLPVHPKPHNKVSRAWDAIHKMKINGQGLGLKDFRPIKPLGSGDTGSVHLVELRETGLVFAMKAMDKSVMMQRNKVHRARAERDILALMDHPFLPTLYSTFQTQTHICLVTDFCPGGELFLLLERQPRKVFTEDVVRFFAAEVVIALEYLHCLGVVYRDLKPENVLLRADGHIQLTDFDLSFLTSAKPRLVEQDLPPGRRRKPKRPPSPIFVAEPVTPSNSFVGTEEYIAPEIITGQGHSSAVDWWALGILIYEMLYGRTPFRGKNRQRTFTNVLQRDIIFPASIPVSISARQLMRDLLQRNPLKRLGSHRGASDVKNHPFFRGINWPLLRHTTPPPLETPALLITPDVEPTKADEDLEWDEEEAAPISTFQEF

SEQ ID NO: 14258 - protein, 354 aa, Brassica napus
  misc_feature (144)..(144): Xaa can be any naturally occurring amino acid
MASITSTLSLSSTKPQRLFDSSFHGSSISSAAPVSVGLKPRSVSAVSVRASTAGYDLNAFTFDPIKESIVSREMTRRYMTDMITYAETDVVVVGAGSAGLSCAYEISKNPNVQVAIIEQSVSPGGGAWLGGQLFSAMIVRKPAXHLFLDEIGVAYDEQDNYVVIKHAALFTSTIMSKLLARPNVKLFNAVAAEDLIVKGNRVGGVVTNWALVSMNHDTQSCMDPNVMEAKIVVSSCGHDGPFGATGVKRLKSIGLIDHVPGMKALDMNTAEDAIVRLTREVVPGMIVTGMEVAEIDGAPRMGPTFGAMMISGQKAAHLALKALGQPNVIDGSYVGDLSPELVLAAADSAETVDA

SEQ ID NO: 14259 - protein, 491 aa, Erwinia carotovora
MAQHDIQQTTQGAPTLRRELKARHLTMIAIGGSIGTGLFVASGATVSQAGPGGALLSYALIGLMVYFLMTSLGELAAFMPVSGSFSTYGSRYVEEGFGFALGWNYWYNWAVTIAVDLVAAQLVMGYWFPEVSGWIWSALFLALMFLLNYISVKGFGEAEYWFSLIKVTTVIIFIAVGVMMITGIMSGAENAGFHNWEIGDAPFAGGFSAMIGVAMIVGFSFQGTELIGVAAGESQEPSKNIPRAIRQVFWRILLFYIFAILIISLIIPYTDPNLLRNDVKDITVSPFTLVFENAGLLSAAAVMNAVILTAVLSAGNSGMYASTRMLFTLASEGKAPRIFAKLSKGGVPRNALYATTVVAALCFLSSLYGNQTVYLWLLNTSGMTGFIAWLGIAISHYRFRRGYVMQGHDLNRLPYQSRFFPLGPIFAFVLCLIITLGQNYQAFLQDNIDWYAVTATYIGIPLFLLIWFGYKLYRGTGFIKYQDMTFPDHKD

SEQ ID NO: 14260 - protein, 1171 aa, Physcomitrella patens
MEGLNPISSDLKPQEPPKSQEPPRTQEPLNPVGAPRGRGKFYAIPRSERKSIEVFGGAPTTTRYLPGVAANFGVSSAVAPKESKGKATPSSRIDPPWANPKFAPAELPPAWLAPKPAPNSPPLRPTPSSLPESWNKPPHMLDSLEKSPPWSKPDATKPSASKALLSGEMSLDIPAYKPKRVVGGEEAAPKPVVRHQRSSSDTMTNTLPDLQEERQSAINKLKQQAEEDSKRELAKKARNDGVKSPERKEMTTTVMADRAAEWGLVLKSDAETGKTQGVTIRRSGDNRRSGDRRSSDGENAPGRVSMTLPTVPASRTSETSDAGSDTSHPSNLPKVSREIKDALSTFQQTFVVSDATQPDFPILYASAGFFNMTGYTPKEVIGRNCRFLQGPGTDPEDVTRIRDALKEGRSFCGRLLNYKKDGSAFWNLLTITPIKDDDGKVLKFIGMQVEVSKHTEGKKEKALRPNGLPESLIRYDARLQVKATEAVGDLVGVFKKPTIPTSPRDSQLRKPLLEEEKKLAQQDFAHGSKGAHKRDAARRKSTGTDFVKRNETGQSNVPEGIANEHLAPGNPPRRNRRSSGFLSLLGWTKPEPKLDPELDPELRMLDYEERPESFEVDVERSKEIRRGIDLATTLERIAKNFVITDPRLPDNPIIFASDEFLELTEYTREEILGRNCRFLQGPDTDRAVVDQIRDAIAARRDITVQLLNYTKSGKPFWNLFHLQAMRDHNGELQYFIGVQLDGSEYLEPERRRLSEKTEKEGAKVVQETANNIDGAVRELPDANMKPEDLWSKHSLPVHPKPHSINSPSWEAIRKFRKSGVTLGLKDFRPIKPLGSGDTGSVHLVELRGTGLVFAMKAMDKSVMMQRNKVHRARAERDILALMDHPFLPTLYATFQTQTHICLISDFCLGGELFLLLERQPRKVFTEDVVRFYAAEIVIALEYLHCVGVVYRDLKPENVLLKEDGHIQLTDFDLSFLTSAKPLLVEPDVPPSRRKKPKRPPPPIFFAEPVTPSNSFVGTEEYIAPEIITGQGHSSAVDWWTLGILIYEMLYSRTPFRGKNRQKTFTNVLQKDVIFPASIPVSLQVRQLMRGLLQRNPMKRLGSNRGASDVKTHPFFRGISWPLLRNMKPPPLESPLELISEEVESIKSTPAEDLEWNEHEAAAATTFTSDVF

SEQ ID NO: 14261 - protein, 622 aa, Prochlorococcus marinus
MCGITGIISFQSSIDPQNIHNMNETLMHRGPDHRDIWINEYSTVFLGHTRLSILDLSDNGNQPFHSKDGRFHLTFNGEIYNYKNLKDYLKTNGISNFKSNSDTEVLIELIALRGITNASKMLNGMFAFAVWDSLEKKIHLVRDRFGEKPLFYTLQKDTLYFGSEIKSILKIPTISKIINKEALSHYLRFNYIKNPLTIYKDIYKLEPGHILSIDQNITYKKYSYKNKNKKTIKLANQKEAEDLLQNQIIKSCLSRTISDVPIACFLSGGIDSSLVTSIIQRNSKQRIKTFTIGFDDQSIDESNYAEKIANFLGTDHTTINIEEKELLNNIDLQSEIYGEPFADQSSIATNILCKYASRDVKVCLSGDGGDEMFIGYDRYYKVNQLRLFLKAIKFYKKFKTIDRILEVLIHKIESNKNFSIKIDKIIKLISLLSDANDDNIYEKFNSLYRDQYFPLTPQNNQKHYIYKDLKNIQEMCEYDFETYLPDCILTKVDRASMHNSLEVRAPFLDHEIPEIIDSINPTYKKKLLNRKFILKKLLNKYLPKNIYERPKKGFSAPLNNWIKGPLKELTLDYLSIESLKKHNLLDIDIIERIKYEHYSGIRSWHNQIWNLLIFQQWYNKNF

SEQ ID NO: 14262 - protein, 287 aa, Mycobacterium tuberculosis
MAVVTMKQLLDSGTHFGHQTRRWNPKMKRFIFTDRNGIYIIDLQQTLTFIDKAYEFVKETVAHGGSVLFVGTKKQAQESVAAEATRVGMPYVNQRWLGGMLTNFSTVHKRLQRLKELEAMEQTGGFEGRTKKEILGLTREKNKLERSLGGIRDMAKVPSAIWVVDTNKEHIAVGEARKLGIPVIAILDTNCDPDEVDYPIPGNDDAIRSAALLTRVIASAVAEGLQARAGLGRADGKPEAEAAEPLAEWEQELLASATASATPSATASTTALTDAPAGATEPTTDAS

SEQ ID NO: 14263 - protein, 339 aa, Streptococcus mutans
MIRQKIAVLGPGSWGTALSQVLNDNGHEVRIWGNIPEQLDEINEHHTNKRYFKDVVLDEKIKAYHDLEDALKDIDAVLFVVPTKVTRLVAKQVSQILDHKAVVMHASKGLEPGTHERLSVILEEEIPNHLRSDIVVVSGPSHAEETIVRDITLITAASKDLEAAKYVQKLFSNNYFRLYTNPDVIGVETAGALKNIIAVGAGALHGMGYGDNAKAAVITRGLAEITRLGVKLGADPLTYSGLSGVGDLIVTGTSIYSRNWRAGDALGRGEKLEDIERNMGMVIEGISTTKVAYELSRELNVYMPITCAIYQSIYEGKNIKEAITSMMSNEFRAENEWSK

SEQ ID NO: 14264 - protein, 213 aa, Unknown
  uncultured bacterium 311
MSLIDLVNKKSILPSSSEALPGRTEEIEVPSEHFIKGTPLKGPFPQTYEMAIFGMGCFWGVERKFWETDGVYTTAVGYSGGLTPNPTYREVCTGFTGQNETVLVVYDPSKITFEELLIIFWEQHDPTQGMQQGNDVGTQYRSGVYCLSENQKNSALETKDRYQQLLSDKGYGPITTEIVQAGEFYYAEHYHQQYLAKNPDGYCGVDGTGIKLS

SEQ ID NO: 14265 - protein, 838 aa, Photobacterium profundum
MGNAREVIMKVSRRKFIKAQAVASAAAAAGISIPISASNVVTDSSLTKITWEKAPCRFCGTGCSVNVGTKEGKVVATHGDIKSPVNRGLNCVKGYFLSKIMYGKDRLTQPLLRMTDGKFDKNGEFSPISWDQAFDIMAEKWKKTLKEKGPEAIGMFGSGQWTIYDGYAASKLMKAGFRSNNLEPNARHCMASAVVGFIRTFGIDEPMGCYDDIEAADAFVLWGSNMVEMHPILWTRVTDRRLSVPGVKVSVLSTFEHRSFELADIPIIFTPQSDLAILNFIANYIITNDKVNKDFTSKHVNFRRGTTDIGYGLRPEHPLQQAAKNPDSGDSTPMTFEEFKAFVSEYTVEKASEISGVKPDKLIELAELYANPETKVVSFWTMGFNQHTRGVWCNNLVYNIHLLTGKISTPGNSPFSLTGQPSACGTAREVGTFAHRLPADLVVTNPEHRKIAEKIWKLPDGTIPGKVGAHAVLQSRMLKDGKINAYWIQVNNNLQAGANINEETLPGYRNPDNFIVVSEAYPTVTSQAADLVLPTAMWVEKEGGFGNAERRTQLWHQMVEAPGESKPDLWQLMEFSKRFKTDEVWPKELLDSNPDYKGKTLFDVLFINGNVNKYPLDDLAEGTLNDESNYYGFYVHKGLFEEYAEFGRGHGHDLAPFDMYHETRGLRWPVVDGKETLWRYREGSDPYVKEGAGFEFYGKPDGKAIIFALPYEPAAESPDEEYDMWLSTGRVIEHWHSGSMTQRVPELYKAYPDAQVFMHPDDAKSRGLRRGDAVKVMSRRGEIITRVETRGRNKPPIGLVFVPWFDASQLINKVTLDATDPLSKQTDFKKCAVKIVKA

SEQ ID NO: 14266 - protein, 340 aa, Ostreococcus tauri
MTVPSIACEARERLPRELSWIPDLVQGSFFAPCDVHSTGSKGEQRNMFSIGMRRSLCPACALDARATDTIQVRGSDEETLRPIVFEHVRDGAHVVAARPNPSRRSTQQTTIRRSSYHNVVRVQDVCRLIDVQEIQTYIINSARVVFLNERPHPRSTKGKEDKGTTSGRGDQRSRAGSTSQTIAHSECCHCARILQSDNSRYCSISCKVNAGEDMTAKDGIDMAFAAETIKPTPRKSVQAKNTSKSDKLSGDRRSPVRNKSPVSEGSGPRGKSPVKSEVKSEDDSPSSEGVTPTKVVSSAKRKYSSKDRPPGDAPLTPTLLSIVPHRRKSRPKKSPVGDDH

SEQ ID NO: 14267 - protein, 181 aa, Oceanicola granulosus
MVNRDYVIDEMISAKSIAARIEALAHEIKREFRGTEQLVVVGLLRGSFVFIADLVRELDLPVEVDFLEASSYGDSMESSREVRILKDLRGEIGGRDVLVVEDIVDTGHTLSKVTQYLATRTPARLRTIALLDKPARREVDFKADWTGFEIPDEFVVGYGIDYAQRNRNLPFIGKVRFPDAE

SEQ ID NO: 14268 - protein, 296 aa, Saccharomyces cerevisiae
MITTPLVHVASVEKGRSYEDFQKVYNAIALKLREDDEYDNYIGYGPVLVLLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 14269 - protein, 382 aa, Arabidopsis thaliana
MSHSAVSQAGAVSVSIENQRSLRRSVFKQNNSISFNSKSWSSSLALNQKTTSIRDGKRYPSTTICMSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKIEEYSDEIFKLLDNGAHIYFCGLKGMMPGIQDTLKRVAEERGESWDLKLSQLRKNKQWHVEVY

SEQ ID NO: 14270 - protein, 257 aa, Coelorachis selloana
CELDNIMRLTGITGIVNGMDVSEWDPSKDKYIAVKYDVSTAVEAKALNKEGLQAEVGLPVDRKVPLVAFIGRLEEQKGPDVMAAAIPQLMEEDVQIVLLGTGKKKFECMLMAAEEKDPDKVRAVVKFNAALAHHIMAGADLLAVTSRFEPCGLIQLQGMRYGTPCACASTGGLVDTIIEGKTGFHMGRLSVDCNVVEPADVKKVATTSKRAIKVVGTPAYEEMVKNCMIQDLSWKGPAKNWENVLLSLGVAGGEPGI

SEQ ID NO: 14271 - protein, 953 aa, Unknown
  Candidatus Protochlamydia amoebophila UWE25
MNKVNHNLNPTTLIAFSDNHDYQQSNKALKFSSRINLLCKTIFQTLLHLIFDCFDKNQLRSQWKKIVWDQKKSVISKNVIIRPRSDVSLPSTNLIPPLSSSSLMKTNAYLTTLDSELAQFCKIFEIYNTRIISLAEKNLHILPSSFGNLNQLNHLDLTNNQLQTLPNSFENLTNLRSLNLCNNQFSEIPDCLFRLPSACDINLKENPLSQEILDQLNQRVNQTNYQGPKFQVSSPTPSFCSELMDQIIPRSEPILLDDALAQFCRFFEIHDTSMISLTEKNIQLLPSSFGNLINLFFLNLINNQLQTLPDSFGNLTNLQFLYLYNNKLELLPTSFGNLNQLNKLNLANNQLQILPQFFGNLTNLTKLYLNNNKLELLPTSFGKLTQLKKLQIAYNQLQSLPELFTNLINLQTLDLNNNNLRTLPDSFGNLNRLHVLNLSNNQLQVLPHSFGNLTQLRDLHIAYNQLQSLPGSLTNLVNLQTLDLNNNNLQTLPNSFGNLNQINYLNLANNQFHSLPESFGNLTKLQCLYLYNNQIQILPETFSNLINLTELHLNYNQLQTLPETFTNLTNLRNLNLTGNNFETIPECLFHLSSECEIYLEANPLSREILDQLNRRTSQSNYQGPRFHVSIYTPSFHNNQTNQIFLNFESILKEWCNKNCQTKLLSNLPQTAKNNLLNWFSRVKSTPFYTSNPQAAKEKISSFLDWMANENNLDYLQVAYQILADATSTCGDRMATSVNELMLHMRLCQSQNLSPEELKTLIIGSARLNKLFKIAQKTSASQRMTDPIEVHLCYQIHLKEALELPIETNSMLYERMACLSEQNIQIAKERILRKTSTFEQQTNILMASSFWMNAVKSQLSTSHIEKLRAFYNLNLNSNDSQFITIDSLLNKIEFESRQSIYEQLAELCEQVKANKMNEIDIEDGEAVSAYFSQFHINEKTIWNPAYIATLAFLS

SEQ ID NO: 14272 - protein, 373 aa, Starkeya novella
ADTVTLPFANGERPLVMYPGKRPLIGLTARPPQLETPFSVFDEGLITPNDAFFVRYHLAGIPLEIDPDAFRLEIKGKVGTPLSLSLQDLKNDFPASEVVAVNQCSGNSRGFVEPRVGGGQLANGAMGNARWRGVPLKAVLEKAGVQAGAKQVTFGGLDGPVIPETPDFVKALSIDHATDGEVMLAYSMNGADLPWLNGYPLRLVVPGYYGTYWVKHLNEITVIDKEFDGFWMKTAYRIPDNACACTEPGKAPTATIPINRFDVRSFITNVENGASVKAGEVPLRGIAFDGGYGITQVSVSADAGKSWTNATLDPGLGKYSFRGWKAVLPLTKGDHVLMCRATNARGETQPMQATWNPAGYMRNVVEATRVIAA

SEQ ID NO: 14273 - protein, 335 aa, Burkholderia xenovorans
MPAMKVAVLGAGAWGTALAGHLAVRHDTVLWARQPALIADLRASHENARYLAGVALPPALRYETDLNAALDHALADNALCVVATPVAGLRGLFRAMRDAGKVPAHVVWLCKGFEADSQLMPHQVVAAELPEHGSNGVLSGPSFAREVGQGLPVALTIASASAACRERTVAAFHHGAMRIYTGDDVVGVEVGGAVKNVLAIATGIADGLGLGLNARAALITRGLAEMSRLGVTLGGRAETFTGLTGLGDLILTATGDLSRNRTVGLQLAAGRTLDDILGGLGHVAEGVRCAQAVLAIARAHAIEMPITQAVCAVLFDGVAPRDAVSALLRRDSKAE

SEQ ID NO: 14274 - protein, 321 aa, Bacillus cereus
MAVNEKVELATFAGGCFWCMVSPFEEMEGIIKVVSGYTGGHKENPTYKEVCSETTGHYEAVQITFDANKMPYEELLNIYWRQIDPTDIGGQFHDRGQSYETVIFYHNEEQHKKAEASKEELEQSGRFSKPIATKILPAATFYPAEEYHQGYHKKNTFRYELYRKGSGRDAFIKQHWPKDNAHLKEKLNEMQYYVTQENGTEPPFRNEYWNHKEEGLYVDIVSGEPLFTSLDKFDSGCGWPSFTKPVMSASVKEKMDVSHNMTRTEVRSKEGDSHLGHVFPDGPGPNGLRYCINSAALRFIPKEELEKEGYSDFLILFGNKK

SEQ ID NO: 14275 - protein, 307 aa, Caulobacter crescentus
MARQPVRNRPPGLVVVGGKRAGRALGVVWLVGAGPGDPDLLTFRAFNALRAADVVVHDGLVSEEILDLAPSRARRINVAKRKSRHTLPQDDINQLLVALAQEGLTVVRLKGGDPFLFGRGGEELAACREAGVECHVVPGVTAALAASAGAGAPLTHRGAAQAVTFVTGHAAHGEPDLDWVALARPNQTVVVYMGVSTAALIAERLVAAGRAASTRALIVENASRADERRILTTLSGLAEAAASVRGPALLMVGEAMAMAEIQSPPPLTGEGHREAVEGALAAKRAPSVISPLGELTPPPLRWGGEFK

SEQ ID NO: 14276 - protein, 813 aa, Myxococcus xanthus
MRTHRMSRLVGAALSTALFITGCSESDYVRLYHSAARAPSYSVDDIESLRQIGPTYVDKGVNFALYSENATRLELLLFEDPESNRPARAYEMTRYGDVWSVYVEGVGVGQHYGFRAWGPNWEFDPRWFPGSIHGFKADADVYGNRFNPNKLLTDPYSKALHRDHDWSKGSTASGPARTQVTYAASAKSVLVKSGDYQWGEVEQQWRANRQDENWQGHGWQDLIVYEVHAKGFTADPASGVRFPGTYRGFGEKAAYLAELGITAVELLPIHEKPLDGGYWGYQTINFFAPELSYAAFKEPHQVINEFKWMVEQLHKHGIEVIIDVVYNHTGEGGLWREKLETDDVMPGEPLESLDPAETAGLYSFRGIDNQAYYALNPDRRTYWNNTGVGNQTRPNHRPTRKLIIDSLRFYVEELHVDGFRFDLAPILGERDGDYNRWDDPRNTVLQDVIDDPVLQKYNTRIMAEPWSAGGWYCMPLGEFPNAKTQPGNGWYEWNGRFRDWWRAFMNQDGWKLNSNEGSLCGRPGTVDGGFLMYGSQEWFERNGRRPYHSMNFITVHDGFTMYDLFAYDEKQNRCGPLNPVCCDTPNSPFCDKVSGEEHNRSRNWGPIGDERAESMRRQMIRNAFMSMMISHGTPMILGGDEWMRTQLGNNNAYSTLSDNPFNWYQWGTYLARDERHRMFEFVKAAIRLRKEHAYAFAPKDYGKGAPLAWKSAQNTEAAWDSKQLMIHYHDASYGPELLVLINMEPRAVTFTLPEGRKWTRLIDTQAYFDSSAYLTTAGLDSRSTGNSWLDAPSPVNGPTYGMPERTIVVLRAE

SEQ ID NO: 14277 - protein, 495 aa, Kineococcus radiotolerans
MSVEKDTGPGVGVQRDFSHEDGGLHKGLKNRQLQMIAIGGAIGTGLFLGAGGRLVTAGPGLFIVYGVCGFFVFLILRALGELVLHRPSSGSFVSYAREFYGEKAAFVAGWMYWFNWAMTAIVDITAIATYMHFWDTFSAAPQWLLALIALVVVLGLNLVSVKIFGEMEFWFALIKVIALTAFLLIGIVFLAGRFPVEGQPTGLSVISGNGGWFPTGAVPLVVVVSGVVFAYAAVELVGTAAGETENPEKIMPRAINTVILRIVVFYCGSLVLLALLLPHTAYSADESPFVTFFSKIGVPGAGDVMNFVVLTSALSSLNAGLYSTGRIVRSMAQNGSAPKFTAKLNKGGVPFGGIAITGVVAVLGVGLNYVAPGRAFEIVLNASALGIIASWGTIVLCQLRLHAWSKKGIVTRPDYRLFGAPYTGYLVLAFLVAVLGIMAYDEDSRPTVYALGVIVPLLVLGWFAVRKRVLAAAEERMGYTGEFPVKANRPADGGK

SEQ ID NO: 14278 - protein, 65 aa, Protea pityphylla
MPGQWEYQVGSSVGIEAGDHIWCSRYLLERITEQAGVVLTLDPKPIEGDWNGAGCHTNYSTKSMR

SEQ ID NO: 14279 - protein, 426 aa, Zea mays
MPAPDGWTKKFTPQRGGRSEIVFVSPTGEEIKNKRQLSQYLKAHPGGPAASDFDWGTGDTPRRSARISEKVKVFDSPEGEKIPKRSRNSSGRKGRQGKKEAPETEEAKDAETGQDAPSEDGTKETDVEMKPAEEAKETPTETDDAEKASDKVDDTPAPAPMEEEKETEKPAEAVVAPPAQSEEKKEDVKPDEPEAVAPAPVSNPTENSARAPAEPAAVPAPAPETEPVAEPAAVLAPAPETKPDAKPAAVPAPAPETKPDAEPAAAAAPVPDTKSVAEPAAAAAPAPDTKSVAEPAAAAPVPGTKLVAESAADAVAAPAPETKSDAEPAAAPVPETKPVAESAADAVAAPAPETKSDAEPAAAADPAPEIKSDAAAADPAPGTKADAAAADAAPGAEPDAAPLENTAADKGGSEESSQPVNNGHST

SEQ ID NO: 14280 - protein, 626 aa, Magnaporthe grisea
MSAVSVPSGPQAFTSSYAPRLRTYNNSLLIPVINQPQAGPISRTTKRGTTVINYAEDGYDDYDDDDDDSRRRPTGLRSLRREDSVNKADAAERVNKETTTPVTVPGIWREWMGKTRINRPEAHNFAQAQLPLTLIPIRLDVEIPAFIPGPNISKVDDPNQPKEMTTPYRLKDTFMWNLHETLITTDHFATQLAQDLDLPNKAHVIGEISKQIRTQLEEYAGVALHPLFHSAQKQGAPTQAATDRDASSTPIIGRSDTPLRNAALGRSTPSRPAAPATPGPTTSALQGEVTATAEHITADSEDFNLDDTYRCVVELNIHLGSQLYTDKFEWSLLHPPGTAEAFAKVTCEDLGLSGEWVPAMTHAIYEAVLRLKKEACESGGLVSGLAGDVGSLDPSLGVYSSATVHGGAGAGWRHDPDHLADDWEPRLEMLSKEEMEKREGDRERQIRRLRRETARFSSLAGMAGGVPVGFGFGGLIEQEEERMGRGERSKKKRRFRSLSPVGRSATPGGRGTPDVGGSGGYGGGGSLTDAERYQWRCTHCKVGGTCVWAVRDGPHGPRYTPATQIGVRSSLPVNKSSNGSLGTPVAKTIADKNPFKKNHCYSIPSIMVPRSTGRAQGLAVSLSRAA

SEQ ID NO: 14281 - protein, 291 aa, Ehrlichia canis
MVNLPKFTMRDLVESGVHFGHKASRWNPKMAPYIYGVYNDIHIINLQNTVVLLKNALKALYDVVLKRGRVLFIGTKVQASAIIADEAIRCGQYYVNNRWLGGMLTNWETISLSIKKLKEYEKLIENVDNQFTKKELLLFEKKRAKLDRSIGGICNMGGLPHVLFVIDTNKEHIAIKEANKLNIPVIAVLDTNSDPTGIDYPIPGNDDAVRSIDFFCKIVSDTILEAIRSDLAKSGINVDGIKDFSVEKRDDLLRTSNRDNKNNKNNNNTDNTDNAASIKEEDLIGGSNNEN

SEQ ID NO: 14282 - protein, 65 aa, Protea canaliculata
  misc_feature (5)..(5): Xaa can be any naturally occurring amino acid
  misc_feature (24)..(24): Xaa can be any naturally occurring amino acid
MPGQXEYQVGPIVGIEAGDHIWGXRYLLERITEQAGVVLTLDPKPIEGDWNGAGCHTNYSTKSMR

SEQ ID NO: 14283 - protein, 312 aa, Rubrobacter xylanophilus
MISMPDGGGAQIRKAAVVVNALSRSGEEAYARAVRLLRELGVPVEHTYALRKPERLPEVVEEVLGEGCDLLVLGGGDGSVSTAVDFLAGGETVLGLIPLGTANDFARTLEIPVDLEEACRTIACGKVVDVDLGLAGDNYFVNVATVGIGAEVTRALSPRLKKRFGTLAYPLAAVKAFFRHEPFSARLTFPEGDHEPVELERLLQVAVGNGRFYGGGLAVSPEAGMDDKRLDVYAIRLGRHRDLLGVLRYLRSGDFINQENVCQYRTRRVCVRTEPELPVNIDGEVVARTPQEFRVVPDALRVMVPRSSTAAR

SEQ ID NO: 14284 - protein, 202 aa, Magnaporthe grisea
MVMRKPAHLFLDRLGVAYEDEGSFVVVKHAALFTSTLLSKVLALDNVKLFNATAVEDLITRREGGDNAGVRVAGVVTNWTLVSMHHDDQSCMDPNTINAPVVISTTGHDGPFGAFSAKRLVSMKQIEQLGGMRGLDMQSAEDAIVKRTREIVPGLIIGGMELSEIDGANRMGPTFGAMVLSGVKAAEEAMAVYDTRKKQNAY

SEQ ID NO: 14285 - protein, 175 aa, Flavobacteria bacterium
MEIAILAGGCFWCTEAVFQRVKGVVEVKSGFCGGHIKNPAYREVVTERTGHAEAVKITYDPEIISYKELLMVFMATHDPTTLNRQGHDVGTHYRSAIFYIDQKQYMIANSYIDELQDQNVYSNDIVTEVAPATDFYDADDIHDDYYNNNRLQGYCQYVIDPKVRKLMTEYADLAK

SEQ ID NO: 14286 - protein, 139 aa, Cryptococcus neoformans
MAPKSVASKAPASQASKAPAAASKAPAKAAKTSAAPKDGAKKRSKKRVESYSSYIYKVLKQVHPDTGISNKAMAILNSFVSDIFERIATEASKLASYNHRSTISSREIQTSVRLILPGELSKHAISEGTKAVTKYSSSK

SEQ ID NO: 14287 - protein, 540 aa, Festuca arundinacea
MGLGLGDPPADYGPIAAVGLFVALMCVCIVVGHLLEENRWMNESTTALLIGLGTGTVILLASSGKHSHILVFSEDLFFIYLLPPIIFNAGFQVKKKQFFRNFMTITLFAVVGTLISFSIISLGALGLISRLNIGALELGDYLALGAIFSATDSVCTLQVLSQDETPFLYSLVFGEGVVNDATSVVLFNAIQNFDLGDLSTLKFFQFIGNFLYLFGASTLLGVATGLLSAYVIKKLYFGRHSTDREVAIMMLMAYLSYMLAELLDLSGILTVFFCGILMSHYTWHNVTESSRVTTKHAFATLSFISETFLFLYVGMDALDIEKWKIVSETYSPMKSIALSSVILALVLVARAAFVFPLSYLSNLTKKTPGEKISIRQQAIIWWSGLMRGAVSIALTYNKFAKSGHTQLPSNAIMITSTIIIVLFSTIVFGLLTKPLIRLLIPTRHLTREVSALSEPSSPKSSLEQVSADGPEADLENAVTIRRPPSLRMLLASPTRSVHHYWRKFDNAFMRPVFGGRGFVPFVPGSPTESSVPLLAPVSEN

SEQ ID NO: 14288 - protein, 138 aa, Cryptococcus neoformans
MARTKQTARKSTGGKAPRKQLATKAARKQTTTSAAGGVKKPHRYRPGTVALREIRRYQKSTELLIRKLPFQRLVREIAQDFKTDLRFQSSAVMALQEASEAYLVSLFEDTNLAAIHAKRVTIQPKDLQLARRLRGERS

SEQ ID NO: 14289 - protein, 517 aa, Ipomoea batatas
MEFCATLKSSAHLPRETEFFGGRIRGSLNNNVLLSQSRKSLRLDGNKRKIKPGVAFSVLTRENGTETLTVEAPILERRRANPKNVAAIILGGGAGTHLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 14290 - protein, 145 aa, Arabidopsis thaliana
  misc_feature (104)..(104): Xaa can be any naturally occurring amino acid
  misc_feature (114)..(114): Xaa can be any naturally occurring amino acid
  misc_feature (136)..(136): Xaa can be any naturally occurring amino acid
MASSMLSSATMAASPAQATMVAPFHGLKPSAAFPATRKVNNDITSITRNGGSVHWMHVWPPIAKKKSGTLSYLHDLTDSELPKEDDYLIRNPRIPCAEFELGYXLVSREHGTSXPGHYDVRYWTKGKLPLFGCTDXSAQVLKRAE

SEQ ID NO: 14291 - protein, 346 aa, Zea mays
  misc_feature (139)..(139): Xaa can be any naturally occurring amino acid
  misc_feature (150)..(150): Xaa can be any naturally occurring amino acid
MAAPATPRPSLILPRASSHSHSQPSAGGLTSYRGDFVFVVNPLGANGRTGKQWKQLLPLLRTRLADQCNICECITSGPSHAIDVTREAIKDGVDAVIAVGGDGTLHEVVNGFFWEGSPVCALDRGPDHSTALGLIPLGXGSDFARTFGWXNDPHDAIDRIVRGVKSKLDIGVMEGPNREPHFFVNVADIHLSAKAGYFASMYKSFGNLCYVFGALRAFWGHNNQDMRIKVNGGEWRTVHNVTALCIGNAKYFGGGMKITPTADPFSGNLEVVILQDFKWYDFILKLHRLYGGTHLSVNGVSSMRVQSIEVAEVVASGGVFVQSDGEHFGFLPTKFSVLPRAVDFFC

SEQ ID NO: 14292 - protein, 271 aa, Unknown
  Mycobacterium sp. JLS
MRIIVTGGNSGVGRATASAMAAEGHEVVIACRTMSKGYDAAASMSGRVDVRELDLADLTSVRKFADTVDYVDVLVNNAGVLGLPLTRTADGFEAHMGTNHLGHFALTCLLGDRIRDRVVSVASTNYTTARMHFDDLNWQQRKYNPWSAYGESKLANLLFVHELVARGKTAYASDPGMTNTAITRDGSGVLQWAGRVISPHIAQSPDDGARSTIQAITTTLPNGTYLAPRGLMHQWGKPKPTKLKAKARDADSARRLWDLSAELTGCAWQEA

SEQ ID NO: 14293 - protein, 369 aa, Oryza sativa
MVERRGTQLWASGRPFIIHGFNTYWLMSFAADQATRLRVTAAIAEAGLNVCCTWAFSDGGYRALQTAPFHYDEDVFRALDFVVSEARRHNMRLILSLCNNWEDYGGKAQYVRWGKEAGLDLTSEDDFFSDPTIKSYYKAFVEAVVTRINTVTNETYKDDPTILAWELINEPRCPSDPSGDTLQAWMEEMASYVKSIDPVHLLEIGIEGFYGPSIPELLPVNPDEYSGHAGIDFIRNHQAPGIDLASIHVYSDIWLPQSIKENHLQFVDKWMQQHIDDAANLLGMPIVVGEFGVSVKDGKFGNEFREDFMKTIYRIFLSSWKEGVIGGGCLLWQLFPEGAEHMDDGYAVIFAKSPSTLSLLANHLRCLEC

SEQ ID NO: 14294 - protein, 302 aa, Neurospora crassa
IRSFATHAQLPISIVNREDDAFLNPNFRFIDHSIIGKNVPVADQSFRVGCSCASDEECMYSTCQCLDEMAPDSDEEADPYTRKKRFAYYSQGAKKGLLRDRVLQSQEPIYECHQGCACSKDCPNRVVERGRTVPLQIFRTKDRGWGVKCPVNIKRGQFVDRYLGEIITSEEADRRRAESTIARRKDVYLFALDKFSDPDSLDPLLAGQPLEVDGEYMSGPTRFINHSCDPNMAIFARVGDHADKHIHDLALFAIKDIPKGTELTFDYVNGLTGLESDAHDPSKISEMTKCLCGTAKCRGYLW

SEQ ID NO: 14295 - protein, 98 aa, Oryza sativa
  misc_feature (66)..(66): Xaa can be any naturally occurring amino acid
  misc_feature (84)..(84): Xaa can be any naturally occurring amino acid
QSMSSCACACLGGHMCSAMGVRKPAHMFMNKLGLTSHEHEDYVVINHSWLFTSTGMSRLLARPNLXLINAVSVEDLITKDGRVXTTTTNWALASTNHD

SEQ ID NO: 14296 - protein, 113 aa, Streptococcus mutans
MKKIEAIIRSDKLEDLKAALVQSGFIKGMTISQVLGFGNQRGYTEYVRGQKITPTLLAKVKVEIVAHDAAVEEMITTISQAVKTGEVGDGKIFVSPVDEIVRIRTGERDGDAI

SEQ ID NO: 14297 - protein, 286 aa, Ustilago maydis
MSDSRISTVQARIVNTSESILSHTHRHNHAHQPPLLARTVSSCSSSSGATLHLHIFTSMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGAKKRCQNGAGTDGQCKDAAINLVGECPHCSLKFCGKHRLPEQHKCAQVEQVRNAAFAANKAKLESERTQATRGLAH

SEQ ID NO: 14298 - protein, 657 aa, Erwinia chrysanthemi
MGELLAGRPRPLGSHFDGEGVNFALFSSGASRVELCIFDGLREQRLPLTARTGDIWHGYLPDAQPGLCYGYRVDGAFDPSRGQRFNANKLLLDPCARQMDGWVVDDQRLHGGYHQPDPSDSAEVMPPSVVVDEHYDWQGDRLPRTPWSQTVLYEAHVRGLTRRHPGIPAAIRGTYAALAHPVMLDYLTQLGVTALELMPVQQHADEPRLQSMGLRNYWGYNTLLPFAVDNSLAASDDPLNEFRDTVRALHQAGIEVILDVVFNHSAELDVDGPTLTLRGIDNASYYWLTENGDYHNWAGCGNVLRLEHPAVLHWVIECLTFWHEVCHVDGFRFDLATILGRLPDFSSSAPFFTALRNHRSLRDCKLIAEPWDISPGGYQLGQFPAPFAEWNDRFRDDMRRFWLHGDLPIGVLARRFAASSEVFERGSRQPWASVNMLTSHDGFTLRDLVCFNHKHNDANGEQNRDGTNSNFSFNHGTEGLEADETTQARRRVSQQALLTTLLLSQGTPMLLAGDEFGNSQQGNNNAYCQDNALAWLHWDQADDALLAFTSGLIRLRRSIPALQRGRWWRDDDEDDVRWLNAQGEALTPYEWEQGTHQLQIQLSERWLLLVNATPQVSDFSLPEGEWRVAPPFSATDHLLDGQTWRGQANAVCVLVKQ

SEQ ID NO: 14299 - protein, 613 aa, Xanthomonas axonopodis
MCGIVALRSFVAEAPLQALAERALDALSRRGPDAQGLLCLEQPVPTALGHRRLAILDLSAAATQPMRCAETGNVLVFNGEIYNFLELRRELEGLGHQFRTDSDTEVILHGWRAWGEGLFPRCNGMWALVLLEQASGDLIYCRDRLGVKPLYLHHDGRQLVLASEIRAIAASLGGYPPPNPAAVFDFLVTGLSDHTSDTFYAGIRAVPPGWLYRVSPAGHSRRTPYHQWPLPGAVAPLDAQATMELLEDSTRLRLRSDAPTVSLLSGGLDSSILTTLSVQAGALPRTCFAGAFTYGYDDTEQAGFDETEAAASLMQTLGQSERHFVHRARAIPDEEELLALVAAQEEPFCTPSILASFRMYRAIRAAGYKVVLNGEGADELFGGYVRLYLALSARSALHQARLPTAIRLLSTGAVDPRLLLNRLAWDLPAGALGALLRRQRPSVACMSSALWHDQAARLQSLQVDRRVDIEARLRRDVLSTNLPMVLRMTDRNSMSAGIEVRAPFLDYRVVERALSTPALQRMGDYHGKAMLRHAFAERLPARVTTQRKSTGFGHAEQFLVDRMPLQQALATLPEGVNELLNVARLRREFASGRSHSTLWFAVSVALWYRSVYA

SEQ ID NO: 14300 - protein, 329 aa, Glycine max
MAAEPVSDGGAAAEKLISGREEFGDSSNLFSAILAMVLWLGAIHFNIALILLAVFFLPLSKSLLVFGFLFGFMVLPINEKSRFGRRLSRFICKHACNYFPITLHVEDMKAFDPNRAYVFGYEPHSVLPIGIVALADHTGFMPLPKVKVLASSTVFYTPFLRHLWTWLGLTPATKKNFISLLASGHSCILIPGGVQEAFHMQHGTEIAFLKARRGFVRVAMVKGKPLVPVFCFGQSNVYKWWKPGGKLFLKFARAIKFTPICFWGIFGSPLPFRHPMHVVVGRPIEVDKNREPTTEEVAKIHGLFVEALQDLFERHKARAGYPNLELRIV

SEQ ID NO: 14301 - protein, 434 aa, Pyrococcus furiosus
MIEKVYCSEVKPELEGKKVKLAGWVYSNMKVGKKIFLWIRDSTGIVQTVIAKNVVGEEVFEKAKKLGRESSVIVEGIVKADERAPGGAEVRVEKLEVIQAVSEFPIPENPEQASPELLLDYRHLHIRTPKASAIMKVKETLIMAAREWLLKDGWHEVFPPILVTGAVEGGATLFKLKYFDKYAYLSQSAQLYLEAAIFGLEKVWSLTPSFRAEKSRTRRHLTEFWHLELEAAWMDLWDIMKVEEELVSYMVQRTLELRKKEIEMFRDDLTTLKNTEPPFPRISYDEAIDILQSKGINVQWGDDLGADEERVLTEEFDRPFFVYGYPKQIKAFYMKEDPNDPRKVLAADMLAPEGYGEIIGGSQREDDYEKLLNRILEEGMDPKDYEWYLDLRKYGSVPHSGFGLGVERLVAWVLKLDHIRWASLFPRTPARLYP

SEQ ID NO: 14302 - protein, 504 aa, Xanthomonas campestris
MHRRRFLQSLLAAGGSAALGSWMLRSLPAHAAEAAAFHTQLQRTPWLLGWRSVTSPTFGPTTTAVQGKLPEGLAGSLYRNGPAWTERAGFRYEHWFDGDGMVHRWQLGGTQVQHVGRMVATHKFTQEQQAGRFLYRAAGTSVPDMQPVRNNDDVNTANTSVAMLNGRLFALWEAGSAIELDPDALRTLGPVTWRDDLAAMPFSAHPLIDRDGSAWNFGSINAAGASGVVLWHLGADATLRHVQLLHTDAPGYMHSFAMTDRHLILVMAPYRRLDGEGAFFERLRFTPEAPSRIAVVPKDALDQPRWFEADFAVAYHFADAYAHRDRIVVRAIVYDDPEQARSPMRAAMHGDPAAAPSQVQLRSLHLDLSNGRAHWQPHPVDNLELPLYDRRTPTTTGARLYAPCIDGPDNSPFLNAVAGYDLERDRRQVHRYGPDVLAEEHVFVPRPGSDRPDDGWLVGTVLDTRRGRTGLMVLDARHIDAGPVAQAWLPYALPLGFHGHFAPA

SEQ ID NO: 14303 - protein, 515 aa, Ipomoea batatas
MDAYCATLKSTTHLPRESELWGKRMLKNRVLVKQFGKSLKLERNGRKIKPGVAFSVLTRETGKETLTVEAPRLERVRANPKNVAAIILGGGAGTQLFPLTNRAATPAVPVGGCYRMIDIPMSNCINSGINKIFVLTQFNSASLNRHIARTYFGNGVSFGDGFVEVLAATQTSGETGMKWFQGPADAVRKFTWVFEDAKNKDIENILILSGDQLYRMDYMDLVQNHLDRNSDITLSCAPVGDSRAVDFGLVKIDHRGKVVQFQEKPKGADLEAMQVDTTRLGLSPEDAKRNPYIASMGLYVFRRDLLLNLLRWIYPTANDFGSEIIPAVITEHNVQAYFFKDYWEDIGTIKTFYNANLALAEEFPKFEFYDPKTPFYTSPRFLPPTKIDNCKIKDAIISHGCFLRECIVEHSIVGERSRLDFGVELKDTLMMGADYYETESEIASLLADGKVPIGIGHNTKISNCIIDKNVRIGKDVIIANKDGVEEADRPEEGFYIRSGIPVIMEKAVIKDGTVI

SEQ ID NO: 14304 - protein, 202 aa, Fulvimarina pelagi
MAGNAGRRDATVSRATKETEIEVRVDLDGTGKADVATGVGFFDHMLDQLARHSLIDMTIKAKGDLHIDDHHCVEDVGIALGQAIRQALGERKGIRRYASVDLAMDECLTRAAIDVSGRPFLVFSAEFTRAKIGTFDTELVREFFQAFAQNAGLTLHVTNLYGENSHHIAETCFKAVARVLGEAISIDARQADLVPSTKGMLA

SEQ ID NO: 14305 - protein, 563 aa, Sorghum bicolor
MESSIRLADTLRPSSLPAPASAHLRRRHLYLHRLPRTSSSSSLFFSPSHHHRLCPTPRHDLLQPLAAAASGAAKLVPASPAPADSSPEPKPSGAKLVPLVISLAVGLAVRFLAPRPAEVSPRAWQLLSIFLSTIAGLVLGPLPVGAWAFLGLTAAVATHTLPFAAAFAAFTNEIIWLIVISFFFARGFVKTGLGDRVATYFVKWLGKSTLGLSYGLALGEACIAPAMPSTAARAGGIFLPIIKSLSLSAGSKPNHPSSRKLGTYLVMSQFQAASSSSALFLTAGAQNLLCLNLAEKFGVIIANPWVTWFKAASLPAIVSLLATPYLLYKIFPPEIKDTPEAPALAAEKQKQMGPVTKNEWAMIGTMILAVALWIFGDAIGVSSVVAAMLGLSILLLLGVLDWADILNEKSAWDTLAWFSVLVGMAAQLTSLGIVSWMSSCIANLLQSFSLSWPAAFCVLQASYLVIHYLFASQTGHVGALYSAFLAMHVAAGVPSVLSALALAFNTDLFGGITHYSSGQAAVYFGAGYLDLPDVFRIGFISTLINTLIWGGIGTFWWKFLGLY

SEQ ID NO: 14306 - protein, 388 aa, Shigella flexneri
MIQFRVVWVDDRNQIQVNRAWRVQFSSAIGPYKGGMRFHPSVNLSILKFLGFEQTFKNALTTLPMGGGKGGSDFDPKGKSEGKVMRFCQTLMTELYRHLGADTDVPAGDIGVGGREVGFMAGMMKKLSNNTACVFTGKGLSFGGSLIRPEATGYGLVYFTEAMLKRHGMGFEGMSVSVSGSGNVAQYAIEKAMEFGARVITASDSSGTVVDESGFTKEKLARLIEIKASRDGRAADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 14307 - protein, 563 aa, Flaveria bidentis
MEASALFSTALCLPSLHLRSRLLHNKSPPHIARTNKPHLPPLLRSPPPLLTTTTTTTFRPSIFTHLSRHIKPISASSASATSITEPKKAQLQGAKIVPLTLSIAIGLLVRFVVPKPVEVTPQAWQLLSIFISTIAGLVLSPLPVGAWALLGLTTTIITKTLPFTTAFSAFTNEVIWLIVISFFFARGFVKTGLGDRIATYFVKWLGKSTLGLSYGLTLSEALIAPAMPSTTARAGGVFLPIIKSLSLSAGSKPNDPSSRKLGSYLIQTQFQCAGNSSALFLTAAAQNLLCLKLAEELGLVIASPWVSWFKAASLPAFISLLLTPYILYKIYPPETKDTPDAPAIAAKRLQAMGPVTTNEWVMIATMVLAVSLWVFGDAIGIPSVVTAMLGLSILLLLGVLEWDDCLSEKSAWDTLAWFAVLVGMAGQLTNLGIVTWMSNCVAKFLQSFSLSWPAAFGVLQGAYFLIHYMFASQTGHVGALYSAFLAMNLAAGVPGVLAALALAYNTNLFGALTHYSSGQAAVYFGAGYVELPDVFRIGFIMACINAVIWAVVGGAWWKFLGLY

SEQ ID NO: 14308 - protein, 249 aa, Triticum aestivum
MRYKEALSSASCPNCGGPAALGEMSFDEHHLRVENARLRDEIDRISAIAAKYVGKPMVPFPVLSSPLAAAPGASAYDVFDFLRDETSRSEWDILSNGGIVQEMAHIANGRDHGNCVSLLRVNSTNSNQSNMLILQESCTDASGSYVIYAPVDVVAMNVVLNGGDPDYVALLPSGFAILPDGPAGTMHAAAGATGTGGSLLTVAFQILVDSVPTAKLSLGSVATVNSLIACTVERIKTAVISNGGASPPQ

SEQ ID NO: 14309 - protein, 548 aa, Landoltia punctata
MGVCFSKASKPSGNGYQPPPPQPYKPPPPPAARPAQPSVQIPQTHHTQQRQQSDHQSASQAAPSPAKQHLPSPRNSPAAAVSAATPATVLGKPFEDVKAKYTIGKVLGRGQFGVTYLCTCNSTGAKYACKSISKRKLVNRNDREDVKREIQIMQHLSGQENIVEFKGAYEDRHSVHVVMELCAGGELFDRIIAKGHYSERAAAAMCRSIVNVVNICHFMGVMHRDLKPENFLLSTKDPGAALKATDFGLSVFIEEGKVYRSIVGSAYYVAPEVLMRSYGKEIDVWSAGIIVYILLSGVPPFWGETEKKIFDSIMKDDIDFQSDPWPSISASAKDLVSKMLTRDPKKRITAAQVLDHPWIRVDGEASDKPIDSAVLSRMKQFRAMNKLKKMALKVIAESLSEEEIKGLRQMFQNMDTDQSGTITYEELKTGLARLGSRLSEAEVKQLMDAADVDGNGSIDYIEFITATMHRHKLEREEHLYSAFSYFDKDNSGYITRDELKQALEEHGMGDADSIREIISEVDTDNDGRINYDEFCAMMRSGTHPPGRP

SEQ ID NO: 14310 - protein, 261 aa, Novosphingobium aromaticivorans
MQSLPLFHRIAGQPVVLLGEGDAAEAKQRLIERAGGSIIRDIAEGIDKGARLAFIAHDNPDLAQGDAIRLRCAGLLVNVVDRPELCDFTTPSILDRDPVLIAVGTGGASAGLAKILRLRLERLLPQGLGALARALEDAREGMRARWASVADRRRALDAALDEGGELDLFRAGSEAKVGTWLASGAEGQAGRFEIVLTSNDPEDLTLRTARLLGQADVVVHDAGVAPEILARARADAVRVLAGSEMPDGGPEFGVTVVLRLG

SEQ ID NO: 14311 - protein, 424 aa, Unknown
  Azoarcus sp. EbN1
MKHVILGNGPAGVIAAETLRRAAPTDDILLFGSEDAPPYSRMAIPYLLEGNIDESGTWLRKSPGHFDRLRIHEMRGRAVSLDSERRRILFDDGHFESWDRLLIATGSHPVRPPIPGIDLPEVQTCWTLEDARAIARFATPGARVLQLGAGFIGCIIMEALAARGVELTVVEMGDRMVPRMMTPTAGGMIRKWVEDQGVRVVTNAGVSRIDCRASNDAPLDVTLSTGEVVVADLVIVAAGVAPNIAFLEATPVHVAKGVLVDDRLQTSVPGIFAAGDVAEAPDLFTGAHLVAAIQPNAADQARVAALNMAGHEARLKGVLAINVLDTLGLISSSFGQWWGEERERGGAGVEHVDEAAYRYLSLQFKDDVLIGATSIGLTEHVGALRGLIHGRVRLGEWKERLLHSPLQFVDAYIARSQQPMALVR

SEQ ID NO: 14312 - protein, 291 aa, Treponema pallidum
MAVVTIKNLLESGVHFGHQVRRWDPRMKKYIFAERNGIHIIDLQKTITAIREAYDMVRRTVSSGKSVLFVGTKKQSQQTIAKEAQRCGMFYVTNRWLGGMLTNFSTIRKSLSRLKKIERMEIDGTFEHLSKKEVASLRKEHAKLEKNLGGIKEMKELPGVVFIIDTRKETIAIREARRVGIPIVAVVDTNCNPEGIDYPIPGNDDAIRAISLFTQLIANAVMEAGNEHGLKIIENLQDEESGDELDESVSLHEEGREITDYENYTPPEEREYSVNDEGDVFDEDESLYEGR

SEQ ID NO: 14313 - protein, 372 aa, Oryza sativa
MSMVVQQEQEVVFDAAVLSGQTEIPSQFIWPAEESPGSVAVEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTLQAFSDWLNHHRHLQPTIYS

SEQ ID NO: 14314 - protein, 539 aa, Arabidopsis thaliana
MGSGCSSLSYSSSSTCNATVFSISSSPSSSSSLKLNPSSFLFQNPKTLRNQSPLRCGRSFKMESQKPIFDLEKLDDEFVQKLVYDALVWSSLHGLVVGDKSYQKSGNVPGVGLMHAPIALLPTAFPEAYWKQACNVTPLFNELIDRVSLDGKFLQDSLSRTKKVDVFTSRLLDIHSKMLERNKKEDIRLGLHRFDYMLDEETNSLLQIEMNTISCSFPGLSRLVSQLHQSLLRSYGDQIGIDSERVPINTSTIQFADALAKAWLEYSNPRAVVMVIVQPEERNMYDQHLLSSILREKHNIVVIRKTLAEVEKEGSVQEDETLIVGGQAVAVVYFRSGYTPNDHPSESEWNARLLIEESSAVKCPSIAYHLTGSKKIQQELAKPGVLERFLDNKEDIAKLRKCFAGLWSLDDSEIVKQAIEKPGLFVMKPQREGGGNNIYGDDVRENLLRLQKEGEEGNAAYILMQRIFPKVSNMFLVREGVYHKHQAISELGVYGAYLRSKDEVIVNEQSGYLMRTKIASSDEGGVAAGFGVLDSIYLI

SEQ ID NO: 14315 - protein, 523 aa, Treponema pallidum
MRAMHPLLKEILTHPPSGQHECVHGWVRSKRETKRAVFISLSDGSCPDTLQVTVPLPECSASLSSGAQAEQIPNVRDAVLQGETLAQTLKRVTTGACIRAEGALVPSPGAGQALELRACNLTVLGEAPAETYPLQKKSHSFEFLRAHAHLRARTSTFAACARVRSALAGAVHRFFSERHFQYVHTPIITASDCEGAGELFRVTTFDPVRIAREAHAAGAAGNPYALTYADDFFGKAARLTVSGQLQGEAYALALTRIYTFGPTFRAENSNTSRHLSEFWMVEPEIAFARITDCMDVAEEFLAYLLRAALKDCAQDIAFLDERAAQHARSARGDTPLAARSTARTPPVRTPGQLTRMLEDVARAPATRLTYTEAIKLLENSGRSFEFPVRWGCDLQSEHECFLTEEVFHGPVIVYDYPKEIKAFYMKLNADGTTVRSMDLLVPGLGEIMGGSEREEQFEVLCARIRASGFDPHDYRWYTDLRRFGTAPHAGFGLGFERLLQYVTGLGNIRDVIPFPRTPRTADF

SEQ ID NO: 14316 - protein, 364 aa, Candida glabrata
MVKAVERRLVPQGVVTNFYNRVKEDGTIVQSLQRGGGSRRSRAVNYSEVDAFEDFEESDDERQGSNNRSASTEAVVDDKLPENVVLPDLEDIITGESDPSLNVLKFRKVRDTFFGGRIAIRYKLELDQNEVRSSSLAVPIIVPITLKLEDTADGISITDSLLWNINDTSVTPEQFSLVYCRDLGILGNNYIQQQIATLIRDQIENYRTLSGHLLQANENMRSYPDFHVHLNIACNLNSRYYEDNFQWNINDESLTPEKFATIVVKDLGLTRDFLPSISQVLHEQLLQIKKEWIKGEFNHELIHPDENNRMVRIEANQGELDRAWSPRVEVLSMDEIQKREVERERQLRRMKRDSDRLGRRGRRK

SEQ ID NO: 14317 - protein, 261 aa, Unknown
  Populus trichocarpa x Populus deltoides
MLQTLSTHLSSTSTSTTTPLLLLSKPFLSPSAKSQLSHSKPFNFPRTLKPISYYKPPMANILSKLGFGTRSPDPSTMDPTIPQGPDDDLPAPGQQFAQFGAGCFWGVELAFQRVPGVTKTEVGYTQGLLHNPTYEDVCTGTTNHNEVVRVQYDPKECSFDTLIDVLWARHDPTTLNRQGNDVGTQYRSGIYYYTPEQEKAAKESLERQQKLLNRKIVTEILPAKKFYRAEEYHQQYLAKGGRFGFMQSAEKGCNDPIRCYG

SEQ ID NO: 14318 - protein, 647 aa, Zea mays; identical to SEQ ID NO: 420

SEQ ID NO: 14319 - protein, 87 aa, Oryza sativa
  misc_feature (48)..(48): Xaa can be any naturally occurring amino acid
  misc_feature (65)..(65): Xaa can be any naturally occurring amino acid
MAAMATTASSLLKTSFAGARLPAVVRNPTVCVAPRTGGAICNSISSSXPTSPYDLNALRVRLIRXAIVSREMTRRSMTRMITYADTD

SEQ ID NO: 14320 - protein, 615 aa, Phaseolus vulgaris
MPSPASNTWINTTLPSSCSSPFKDLASTSSSPTTLLPFKKRSSSNTNTITCSLQTLHYPKQYQPTSTSTTTTPTPIKPTTTTTTTTPHRETKPLSDTKQPFPQKWNFLQKAAATGLDMVETALVSHESKHPLPKTADPKVQIAGNFAPVPEHAADQALPVVGKIPKCIDGVYVRNGANPLYEPVAGHHFFDGDGMVHAVKFTNGAASYACRFTETQRLAQEKSLGRPVFPKAIGELHGHSGIARLLLFYARSLFQLVDGSHGMGVANAGLVYFNNHLLAMSEDDLPYHVRITSNGDLTTVGRYDFNGQLNSTMIAHPKLDPVNGDLHALSYDVVQKPYLKYFRFSADGVKSPDVEIPLKEPTMMHDFAITENFVVVPDQQVVFKLTEMITGGSPVVYDKNKTSRFGILDKNAKDANAMRWIDAPECFCFHLWNAWEEPETDEIVVIGSCMTPADSIFNECDESLKSVLSEIRLNLRTGKSTRRPIISDAEQVNLEAGMVNRNKLGRKTQFAYLALAEPWPKVSGFAKVDLFSGEVQKYMYGEEKFGGEPLFLPNGEEEGDGYILAFVHDEKEWKSELQIVNAQNLKLEASIKLPSRVPYGFHGTFIHSKDLRKQA

SEQ ID NO: 14321 - protein, 63 aa, Protea mucronifolia
MPGQWEYQVGPIVGIEAGDHIWCSRYLLERITEQAGVVLTLDPKPIEGDWNGAGCHTNYSTKS

SEQ ID NO: 14322 - protein, 309 aa, Gibberella zeae
MAFTMHSHSGEFCPGHAKDQLEEIVKQAVSIGYKTIGFTEHMPRYDLRDLYPEELENPQAALEALPPRHESYLVEAQRLRHKYASQIHILIGFEAEFIRSSCATHVRRLAEHPIVDYFIGSVHYVHNMPIDYSKEIFLTAQGKSSQGTEESLYEDYYDLQYEMLTELKPRVVGHFDLIRLMSEDPERDLRQWKGAWDRVLRNLTLAKEQDGWLEVNSAALRKGLAEPYPGRQIAEEWIKMGGKFTFSDDSHGIAQVATNYARTITYLESLGVKEVWTLKRSSHTCIKGSEKAVVEEVSVPLSEFRKNFP

SEQ ID NO: 14323 - protein, 459 aa, Emericella nidulans
MSNLPVEPEFEQAYKELASTLENSTLFEQHPEYRRALQVVSVPERVIQFRVVWENDKGEVQINRGYRVQFNSALGPYKGGLRFHPSVNLSILKFLGFEQIFKNALTGLNMGGGKGGSDFDPKGKSDSEIRRFCTAFMTELCKHIGADTDLPAGDIGVTGREVGFLFGQYRRIRNQWEGVLTGKGGSWGGSLIRPEATGYGVVYYVQHMIKHVTGGKESFAGKRVAISGSGNVAQYAALKVIELGGSVVSLSDSKGSLIVKDESASFTPEEIALIADLKVARKQLSELATSSAFAGKFTYIPDARPWTNIPGKFEVALPSATQNEVSGEEAEHLIKSGVRYIAEGSNMGCTQAAIDIFEAHRNANPGDAIWYAPGKAANAGGVAVSGLEMAQNSARLSWTSEEVDARLKGIMEDCFKNGLETAQKFATPAKGVLPSLVTGSNIAGFTKVAEAMKDQGDWW

SEQ ID NO: 14324 - protein, 661 aa, Desulfovibrio vulgaris
MLVYAPRGPAPRPAPLHRKGRMFMAYAPQTGRGTVAALPPLCRHRRRKASTKRIRPFTRCARCLLHAMGMAMSSHRSTGVFTMSGLFKKKETAAQAADTQTQTPTPEAHEWLIPEEGRDQLQKVFAGLPGDVTIEVYTGGDPKNLFDDYARRFVADLALLAPRIKPAFHGLDSDMARKRGVTLSPTLLFNPEEYRIRFTGAPLGEEARAFIEAIFLVSARTSGLSQAAKTILAQLDGARSPRVFSSPGCPYCPAQCANAIKCAIERPDLVSAECVNADEFPDLSARYGVGSVPHTQFDESYKGIGLMPEERFVVELVALKDAERWLNEHAAKGGAHGAGTGQGAGSDAGVEVTETDLLVLGAGPAGLSAAIYAERSGLATVVLDKGIVGGQVTVTPVVENYPGFADIAGIKLVEVLSSHARQYATIRENEGVDDIKLGRRIEVHTPRNVFLARAVLFATGAQWRKLDVPGEDRFYGKGVSYCASCDGFVYRGRKVAVVGGGNTALTDALHLRNLGVEVTVIHRRDTFRAEKALQDSLTREGIPVIWNAVVEEVMGDTEVRGVRLRDTKTGETRDVPFDGVFVAIGHVPNSEQAADLGVDLEPDGSIKVDRHMRTNIPRVYAAGDVIGGVRQIVTAVGSGATAALSAFEDLQQPRWKKDKSA

SEQ ID NO: 14325 - protein, 801 aa, Bacillus cereus
MKKRLVMIGNGMAGIRCMEEILKHDCDSYEITIFGDEPHPNYNRIMLSHVLQGKTNIQNIIMNEYSWYEENEITLYTNERVQSIDREEKVIITEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIQEYTPASILHKAGEEIELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYDVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLGFDHIKEILQDANMVTKLNERFQTARGTYKEAWGQALETKSLKAMYEVETVK

SEQ ID NO: 14326 - protein, 65 aa, Protea intonsa
  misc_feature (12)..(12): Xaa can be any naturally occurring amino acid
MPGQWEYQVGPXVGIEAGDHIWCSRYLLERITEQAGVVLTLDPKPIEGDWNGAGCHTNYSTKSMR

SEQ ID NO: 14327 - protein, 610 aa, Vitis vinifera
MASPAAAAASTPNISACVKPKLCYSSSSSSSSSSSALDLGSFSFHRPTIRPNINCSLHSPSVLHFPKHTSSSTGVATVKTTLPKEKDDFSSSVSQQWNFLQSAAAMALDAVETALVARETQHPLPKTADPRVQIAGNFAPVPEQPVQHSLPVDGRIPDCIQGVYTRNGANPLHKPVAGHHLFDGDGMVHAVQFKDGDASYACRFTETQRLIQERDFGRPVFPKAIGELHGHSGIARLLLFYARGLFGLVDHSHGTGVANAGLVYFNRRLLAMSEDDLPYQIRVTPSGDLETVGRYDFEGQLRSTMIAHPKVDPVSGEMFALSYDVVQKPYLKYFRFSPKGDKSPDVEIPLAEPTMMHDFAITERFVVVPNQQVVFKLQEMISGGSPVVYDKNKMSRFGVLDKNATDASGMLWIEAPDCFCFHLWNAWEEPETDEVVVIGSCMTPPDSIFNECDEGLKSVLSEIRLNLKTGKSTRRPILPESEQVNLEAGMVNRNRLGRKTQFAYLAVAEPWPKVSGFAKVDLSTGQVSKYIYGEQRYGGEPLFLPRDPNSGREDDGYILAFVHDEKTWKSELQIVNATNLQLEASVKLPSRVPYGFHGTFISSKELEKQA

SEQ ID NO: 14328 - protein, 181 aa, Glycine max
MSSTGASGPDADAAAGEGLELAQFGAGCFWSVELAYQRLPGVARTEVGYSQGHLDGPTYRDVCGGGTGHAEVVRVHYDPKECPYAVLLDVFWAKHNPTTLNKQGNDVGTQYRSGIYYYTAEQERQARESLAEKQREWKEKIVTEVLPARRFYAAEDYHQQYLEKGGQSAKKRCSDPIRCYG

SEQ ID NO: 14329 - protein, 132 aa, Oryza sativa
  misc_feature (103)..(103): Xaa can be any naturally occurring amino acid
MAPKAEKKPVEKKPKAEKRLSESKASSKEGGAGDKKGRKKAKKSVEIYIFKVLKQVHPDIGISSRAMSIMNSFINDIFEKLAQEGAHLARYNKKPIATSREIXTSVRLVLPGELAKHAVSEGTKGVTKFTSN

SEQ ID NO: 14330 - protein, 112 aa, Mycobacterium tuberculosis
MKLITAIVKPFTLDDVKTSLEDAGVLGMTVSEIQGYGRQKGHTEVYRGAEYSVDFVPKVRIEVVVDDSIVDKVVDSIVRAARTGKIGDGKVWVSPVDTIVRVRTGERGHDAL

SEQ ID NO: 14331 - protein, 454 aa, Arabidopsis thaliana
MEVSNQTRKRKAIDAGHGSQPTAYRGSDGVDLSLLEALEKSSHNGVEALDLKTLKKLVLSFERRLRDNIAARLKYVENPEKFADSEVDLHDDLQKLKVLAGAPELYPDLVASNTVPSIVNLLSHENSDIANDVVQLLQDLTDEDALEDNDEPARVLVDALVENNVLELLVQNMNRLSEADPDEATAIYATLTVIENLVEVKPAVAQLVCERTKLLRWLLTKIKVREFEGIKQYASEILAILLQNSTANQKRLGQMNGVDAVLEGVAMYKSKDPKTPDEEEMLENLFDCLCCLLMPLENKERFVNAEGVELMIIIMKQKKYAYGSAIRALDFAMTNYPPACERFVDVMGLKTAFAAFMGKIPLNKRIKRERYKEELEERVISLIASLFDRLLSKFVENEFEKIDRLMELYLRYSDRVRSEAERLDQLELDDLEVISLLSFSYFDVFILSLNLFMN

SEQ ID NO: 14332 - protein, 243 aa, Staphylococcus aureus
MFTSVTKHVVWNPKMKKYIFTERNGIYIIDLQKTVKKVDEAYNFLKQVSEDGGQVLFVGTKKQAQESVKSEAERAGQFYINQRWLGGLLTNYKTISKRIKRISEIEKMEEDGLFEVLPKKEVVELKKEYDRLIKFLGGIRDMKSMPQALFVVDPRKERNAIAEARKLNIPIVGIVDTNCDPDEIDYVIPANDDAIRAVKLLTAKMADAILEGQQGVSNEEVAAEQNIDLDEKEKSEETEATEE

SEQ ID NO: 14333 - protein, 532 aa, Anaerobranca gottschalkii
MTSKILRVLLVFLLIFAIVGCTSDKQGPQETYKNIDDTVTHGQNYDGSFSREGIQEVTFENGVFYQIFVYNFRDSTGDGVGDLGGIIESLDYIESLGVNGIWLTPITHGASYHKYDVVDYYAVDPEFGTMEDFETLISEAHKRGIKVIIDLVINHTSDRHPWFKAAASDPNSKFRDYYIWAAHDEPRPGSGWRHLSGTTWFYLAHFWERMPDLNFDNPAVREEVKRIAKFWLDKGVDGFRLDAAKHLYSDPAKNHQFWNEFYQYLRTLKEDVYLVGEIWDSPEVIAPYFANGLNANFNFQIGGRVASSINSGVDNLGKELDRIYKLYREHNPDFIDAPFLSNHDTRRIMSEFDYDFEKMKMAANVLLSLPGDPYIFAGEEIGMISNDNHMDIREPFKWYKDTGPGQTTWRPNAFNSTEKWSPSVEEQDKDPNSLLNHFRKMVNLRNSHYPLRYGNDFQLVENNNLTVLSFIREYQGERVLVVHNFYSQPQTITVTVEGTFTNFKGTKSGANFTQRGNEITITIPPLSSMFIY

SEQ ID NO: 14334 - protein, 568 aa, Solibacter usitatus
MTHPKRSHAKILLTSVFGPYAQDDEYGSRAINPMELYHNQVTRGQGSFSLRRFHRSWGILMIQANISAPCAVLDFPTRETFAQELKAHQYDIVGISAIIVNTGKVQEMCRMVRELSPRSTIVVGGHVAAIPGVEKMLDADHIVKGDGIAWMRGFLGEEVEAPIQHPDLSSGFDLRVMGVKLPETEDTAATIISSVGCPMGCNFCTTSAFFGGKGKILNFYATGEELFKLMEKAEETRGTHNFFIMDENFLLQKKRVMELVTLMKRAGKSWGFNIFSSANAIAKYTYEELVEIGIASIWLGLESPKSNYSKLDGTDTMKLSRELRAHGIVLLGSTIVGLEHHTPANIDEEIEHAVAHETDLHQFMLYTPVPGTPLYFEMAEQGRLLDVNLADIHGQHAFNFEHAAISREQSTRSLARAFERDFERNGPSLFRICRTMFRGWMRYKNHPDRRVRERFGRDAKVLRHAWVGMLQGMEYRLRGSNPAIAMQIGELRKEMQREFGLIAVAAAKVLGPVLWWTSLREEKRLARGKSYEPATMIDRRNWEAVGEAAPMPGMAEVECPAESGSYGD

SEQ ID NO: 14335 - protein, 235 aa, Guillardia theta
MTITLAELLESGVHFGHQARRWNPKMFPYIYAERNGIHIIDLVQTAQLLTEACEFVKKSAEEGKKFLFVGTKRQAASIIAQEAERCGAFYINQRWLGGILTNWFTIRTRVERLKDLELKEETGYLDKLPKKEAAGLRRELEKLKRNLNGIKNMKRLPDLVVIVDQKRETTAVQECRTLGIPIISILDTNCNPDLTDIAIPGNDDAIRSIKLIITKLTDSICEGSLGYDENNSDHE

SEQ ID NO: 14336 - protein, 325 aa, Glycine max
MAVEKLSIAKDVTELIGKTPLVYLNRIVDGCVAKVAAKLEMMEPCSSVKDRIGYSMIVDAEEKGFITPGESVLIEPTSGNTGIGLAFMAAAKGYKLIITMPSSMSLERRTILRAFGAELVLTDPAKGMKGAVQKAEEIRDKTPNSYILQQFENPANPKIHYETTGPEIWKGSSGKVDALVSGIGTGGTITGAGKYLKDQNPDIKLYGIEPVESPILSGGKPGPHKIQGIGAGFIPGVLDVDLLDEVVQISSEEAIETAKLLALKEGLLVGISSGAAAAAAIKIAKRPENAGKLIIAVFPSFGERYLSSVLFESVRREAESMVFEP

SEQ ID NO: 14337 - protein, 857 aa, Brassica oleracea
MKDVRIYHHSFLLVFVVVILFHPALSIYFNILSSTATLTISSNRTLVSPGDVFELGFFKTTSSSRWYLGIWYKKLYFGSIKNYVWVANRDSPLFNAIGTLKISNMNLVLLDQSNKSVWSTNLTRGNERSPVVAELLANGNFVMRDSNNKDASGFLWQSFDYPTDTLLPEMKLGYDHKTGLNRFLTSWRSSDDPSSGEISYKLDTQSGMPEFYLLINGSPDHRSGPWNGVQFSGIPEDQKLSYMVYNFIENTEEVAYTFRMTNNSIYSRLTISSKGILERWTWTPTSFSWNLFWSLPVDLKCDLYMACGAYSYCDVNTSPECNCMQGFMPFNMQQWALRDGSGGCIRRTRLSCSSDGFTRMKKMKLPETRMAIVDPSIGLKECRKRCLSDCNCTAFANADIRNGGTGCVIWTGELEDIMTYFAADLGQDIYVRLAAADIVKKRNADGKIITLIVGVSVLLLMIMFCLWKRKQKRAKAMATTIVNRQRNQNLLMKLMTQSNKRQLSRENKTEEFELPFIELEAVVKATENFSNCNELGQGGFGIVYKGMLDGQEVAVKRLSKTSLQGIDEFMNEVRLIARLQHINLVRILGCCIEADEKILIYEYLENSSLDYFLFGKKRSSNLNWKDRFAIINGVARGLLYLHQDSRFRIIHRDMKPSNILLDKYMIPKISDFGMARIFARDETEANTENAVGTYGYMSPEYAMDGVISEKTDVFSFGVIVLEIVSGKRNRGFYQLNPENNLLSYAWSHWAEGRALEIVDPVIVDSFSSLPSTFQPKEVLKCIQIGLLCIQERAEDRPTMSSVVWMLGSEATDIPQPKPPIYCLITSYYANNPSSSRQFEDDESWTVNKYTCSVIDAR

SEQ ID NO: 14338 - protein, 308 aa, Datura stramonium
MEEANNKESPYISSILPGWFSEISPLWPGEAHSLKVEKILFQGKSDYQNVMVFQSSTYGKVLILDGVIQLTERDECAYQEMITHLPLCSIPNPKKVLVIGGGDGGVLREVSRHSSVEQIDICEIDKMVIDVSKQFFPNVAIGYEDPRVKLHVGDGVAFLKFVAEGTYDAVIVDSSDPIGPAQELFEKPFFESVARALRPGGVVCTQAESIWLHMHIIEDIVANCRQIFKGSVNYAWTTVPTYPSGVIGFMLCSTEGPAVDFKNPINPVDADDSHTKTRGPLKFYNSEIHSASFCLPSFAKRVIESKGK

SEQ ID NO: 14339 - protein, 103 aa, Mortierella alpina
MSGRGKGGKGLGKGGAKRHRKILRDNIQGITKPAIRRLARRGGVKRISGLIYEETRSVLKVFLENVIRDAVTYTEHAKRKTVTSLDVVYALKRQGRTLYGFGG

SEQ ID NO: 14340 - protein, 327 aa, Spiroplasma citri
MLKKIGILTSGGDSQGMNAAIAGVIKTAHAKGLETYIIRDGYLGLINNWIEVVDNNFADSIMLLGGTVIGSARLPEFKDPEVQKKAVDILKKQEIAALVVIGGDGSYQGAQRLTELGINCIALPGTIDNDITSSDYTIGFDTAINIVVEAIDRLRDTMQSHNRCSIVEVMGHACGDIALYAGIAGGADIISINEAALSETEIADRVAMLHQAQKRSVIVVVSEMIYPDVHKLAKLVESKSGYITRATVLGHTQRGGNPTAMDRYRAFQMAQFAVEQIIAGVGGLAIGNQGDQIIARPIMEALSIPRSSRKEIWAKFDQLNQNIYQKS

SEQ ID NO: 14341 - protein, 315 aa, Hyoscyamus niger
MEVTNQSNGCSNNEKESPYISSVLPGWFSEISPLWPGEAHSLKVEKILFQGKSDYQNVMVFQSSTYGKVLVLDGVIQLTERDECAYQEMITHLPLCSIPNPKKVLVIGGGDGGVLREVSRHSSVEQIDICEIDKMVVEVAKEFFPDVAVGYEDPRVNLHIGDGVAFLKNVPAGTYDAVIVDSSDPIGPAQELFEKPFFESIARALRPGGVVSTQAESIWLHMHIIEEIVANCRQIFKGSVNYAWTTVPTYPSGMIGFMLCSTEGPAVDFKNPINPIDDESGPKTIAPLKFYNSEIHQASFCLPSFAKRVIESKGK

SEQ ID NO: 14342 - protein, 317 aa, Datura stramonium
MEVANHNNNNNGCTNDKESPCISSVLPGWFSEISPLWPGEAHSLKVEKILFQGKSDYQDVMVFQSTTYGKVLVLDGVIQLTERDECAYQEMITHLPLCSIPNPKKVLVIGGGDGGVLREVSRHSSVEQIDICEIDKMVVEVAKQFFPDVAVGYEDPRVNLHIGDGVAFLKNVPAGTYDAVIVDSSDPIGPAQELFEKPFFETIARALRPGGVVSTQAESIWLHMHIIEEIVANCREIFKGSVNYAWTTVPTYPSGMIGFMLCSTEGPAVDFKNPINPIDDESHGQTIGPLKFYNSEIHQASFCLPSFAKRVIETKGK

SEQ ID NO: 14343 - protein, 141 aa, Oryza sativa
MYVARPAAATAATIKLVARLLTGPWMVRETADRQCTRNMRRRRGGSTTARAKRLEENDGDEIQRIKAGNPDISHREAFSAAAKNWAHFPHIHFGLMPDHRGLKKTSLLPQDHQRKDGLLKEGLYAAAAAAAAAANMGVAPY

SEQ ID NO: 14344 - protein, 941 aa, Kluyveromyces lactis
MLNAISGPAMAVSLQQQQQQQQQQQQQQQQHGLLGHQHQQGMLQGLPHTMNGAVAASQLAMQQPGQASEYGNEQVPGQSQLPIEVRPQDLLPVKQPLKPLDPLSQSTAETWLSIASLAETLGDADLAAMAYDATLQHNPSSTNALTSLAHLYRSRDMFQRAAELYQRALSANPELGDIWATLGHCYLMLDELQNAYAAYQQALYHLSNPNIPKLWHGIGILYDRYGSLDYAEEAFAKVLELDPQFEKANEIYFRLGIIYKHQGKWNQALECFRYILPQPPAPLQEWDVWFQLGSVLESMGEWQGARDAYEHIISQNDRHAKVLQQLGCLYGMNNVSFYDPQKALNLLLKSLEIDSTDATSWYHLGRIHMIRNDYTSAYDAFQQAVNRDSRNPTFWCSIGVLYYQIAQYRDALDAYTRAIRLNPYISEVWYDLGTLYETCNNQVNDALDAYKQAARLDPNNVHIRERLDALTAQIMNQHQSGEQQQQQQQQQQQQQQQQQQQQQQQQQQQQQQKIEYNQQPALPLPSQLQQPQQPNQQPQQPVMLQPMLQNNTQMFNPLNDKQQNGQEQQYAVQQFQQQQPIQHTNMPPVLQRVDQQHPQVVQLLHQQQQQDHEHPQQYQQSLQTQQQLPPPQTQQVQQGQQGQQGQQGQQGYQNGQEQSLQNTTQASQVTQAQQIPPPPQVQQTIPQKRPLEGGMDTLFNAISQQEQEQQKQKEAEQQQTTAPQVTTPQVTNTVHSTPSEPKVEPNDNNLGIVNDTNSTIAPATQNADTTTIVPAEGKQESVQVTEAEGQQPQESQAPAGEPEAPTSEANVVENTSATENHNGAEPAVAKPEITEQHAIDTPAANNLLKDGFSDSQQKINGAQNKDASSETVVEPVTKKQKLDTEETVIKPSADAIESIKEQEKIRQEEENETLEKVEKSAESIPKEKVVRQVEEDDDYDD

SEQ ID NO: 14345 - protein, 1001 aa, Glycine max
ERGSSTTAKQNQRDMRSCVCYTLLLFIFFIWLRVATCSSFTDMESLLKLKDSMKGDKAKDDALHDWKFFPSLSAHCFFSGVKCDRELRVVAINVSFVPLFGHLPPEIGQLDKLENLTVSQNNLTGVLPKELAALTSLKHLNISHNVFSGHFPGQIILPMTKLEVLDVYDNNFTGPLPVELVKLEKLKYLKLDGNYFSGSIPESYSEFKSLEFLSLSTNSLSGKIPKSLSKLKTLRYLKLGYNNAYEGGIPPEFGSMKSLRYLDLSSCNLSGEIPPSLANLTNLDTLFLQINNLTGTIPSELSAMVSLMSLDLSINDLTGEIPMSFSQLRNLTLMNFFQNNLRGSVPSFVGELPNLETLQLWDNNFSFVLPPNLGQNGKLKFFDVIKNHFTGLIPRDLCKSGRLQTIMITDNFFRGPIPNEIGNCKSLTKIRASNNYLNGVVPSGIFKLPSVTIIELANNRFNGELPPEISGESLGILTLSNNLFSGKIPPALKNLRALQTLSLDANEFVGEIPGEVFDLPMLTVVNISGNNLTGPIPTTLTRCVSLTAVDLSRNMLEGKIPKGIKNLTDLSIFNVSINQISGPVPEEIRFMLSLTTLDLSNNNFIGKVPTGGQFAVFSEKSFAGNPNLCTSHSCPNSSLYPDDALKKRRGPWSLKSTRVIVIVIALGTAALLVAVTVYMMRRRKMNLAKTWKLTAFQRLNFKAEDVVECLKEENIIGKGGAGIVYRGSMPNGTDVAIKRLVGAGSGRNDYGFKAEIETVGKIRHRNIMRLLGYVSNKETNLLLYEYMPNGSLGEWLHGAKGGHLKWEMRYKIAVEAAKGLCYLHHDCSPLIIHRDVKSNNILLDAHLEAHVADFGLAKFLYDPGASQSMSSIAGSYGYIAPEYAYTLKVDEKSDVYSFGVVLLELIIGRKPVGEFGDGVDIVGWVNKTRLELAQPSDAALVLAVVDPRLSGYPLTSVIYMFNIAMMCVKEMGPARPTMREVVHMLSEPPHSATHTHNLINL

SEQ ID NO: 14346 - protein, 115 aa, Methanosarcina mazei
MTRMCKIEAIIKPLKLHQVKDALEEAGFASLTVTDVKGRGQQKGIVQQWRGKKYCVDLLPKTKIEIVVPEEKIEEIIQVIQSTAYTGEIGDGKIFVIPIETVVRIRTGERNGDAL

SEQ ID NO: 14347 - protein, 72 aa, Solanum tuberosum [sequence omitted]

SEQ ID NO: 14348 - protein, 474 aa, Bacillus cereus
MNGYVYLVGAGPGDEGLITKKAIECLKRADIVLYDRLLNPFFLSYTKQTCELMYCGKMPKNHIMRQEMINAHLLQFAKEGKIVVRLKGGDPSIFGRVGEEAETLAAANIPYEIVPGITSSIAASSYAGIPLTHRNYSNSVTLLTGHAKGPLTDHGKYNSSHNSDTIAYYMGIKNLPTICENLRQAGKKEDTPVAVIEWGTTGKQRVVTGTLSTIVSIVKNENISNPSMTIVGDVVSLRDQIAWKERKPLHGKKVLFTSATNKTSVMKQRLQEAGAEIYQIPTFKKEEYTLTLEQINEIFNVDRLVFCSAESVEILMQSCSKYQKDIRSLQAELQHMNVATQEKLMQYGLLSKEAKFSSDTTVYLGRNINRIAFIQEKIGAGSYMMTHKYTIDHRFDEVHSRMLSEFLWDSIVFEGRASIDTFLAEVKRLGFIDIVTLPFSYTDVPTLHYANKVGFHNVDHQLQETLMKKDMVRQ

SEQ ID NO: 14349 - protein, 326 aa, Colwellia psychrerythraea
MSKIFEDNTTAIGNTPLVKLNRVIDSENGANVYAKIEARNPSFSVKCRIGASMVWDAEEKGLLTPGKEIVEPTSGNTGIALAFVAAARGYGITLTMPSTMSLERRKLLSALGAKVELTDGAKGMGGAIAKAQELKDSDPEKYVLLGQFDNPANPKIHEETTGPEIWNDTDGNVDIFVAGVGTGGTLTGTSRYLKLTKGKAITTVAVEPTDSPVITQALAGEELTPGPHKIQGIGAGFIPGNLDLDMVDAVELVSNEDAFAMAHRLMKEEGILAGISSGAAVIAAKRLAERPENKGKNIVVILPSSAERYLSSALFTETFSDKELVQ

SEQ ID NO: 14350 - protein, 343 aa, Arabidopsis thaliana
MGRRPARCYRQIKGKPYPKSRYCRGVPDPKIRIYDVGMKRKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDNHGVHAQEALRRAKFKFPGRQKIIVSRKWGFTKFNRAEYTKLRAMKRIVPDGVNAKFLSNHGPLANRQPGTSSLTVQEFYYRTPILTPIKRQISQLFQLPRLDMSTGGAFGGNRGLRPIPPEKGIFPLDHLHECDAEKKEYLGCLKSSAHKSEQCRHLSKKYLQCRMAKNLMAKQDMAELGFSGVKELDSTEDKNTESIEH

SEQ ID NO: 14351 - protein, 288 aa, Solanum tuberosum
  misc_feature (1)..(1): Xaa can be any naturally occurring amino acid
XSLFVYSYKIIIKTCGTTKLLLAIPPILRLAETLSLKVQDVRYTRGSFIFPGAQSFPHRHFSEEVAVLDGYFGKLAAGSKAVIMGSPDKTQKWHVYSASAGSVQSNDPVYTLEMCMTGLDREKASVFYKTEESSAAHMTVRSGIRKILPKSEICDFEFEPCGYSMNSIEGAAVSTIHITPEDGFTYASFESVGYNPKTMELGPLVERVLACFEPAEFSVALHADVATKLLERICSVDVKGYSLAEWSPEEFGEGGSIVYQKFTRTPYCESPKSVLKGCWKEEEKEGKE

SEQ ID NO: 14352 - protein, 435 aa, Unknown [sequence omitted]

SEQ ID NO: 14353 - protein, 511 aa, Arabidopsis thaliana
MEEISPAVALTLGLANTMCDSGISSTFDISELENVTDAADMLCNQKRQRYSNGVVDCIMGSVSEEKTLSEVRSLSSDFSVTVQESEEDEPLVSDATIISEGLIVVDARSEISLPDTVETDNGRVLATAIILNETTIEQVPTAEVLIASLNHDVNMEVATSEVVIRLPEENPNVARGSRSVYELECIPLWGTISICGGRSEMEDAVRALPHFLKIPIKMLMGDHEGMSPSLPYLTSHFFGVYDGHGGAQVADYCHDRIHSALAEEIERIKEELCRRNTGEGRQVQWEKVFVDCYLKVDDEVKGKINRPVVGSSDRMVLEAVSPETVGSTAVVALVCSSHIIVSNCGDSRAVLLRGKDSMPLSVDHKPDREDEYARIEKAGGKVIQWQGARVSGVLAMSRSIGDQYLEPFVIPDPEVTFMPRAREDECLILASDGLWDVMSNQEACDFARRRILAWHKKNGALPLAERGVGEDQACQAAAEYLSKLAIQMGSKDNISIIVIDLKAQRKFKTRS

SEQ ID NO: 14354 - protein, 255 aa, Methanosarcina mazei
MSGNYGKVYLVGSGPGDPELLTLKARRLIDSAEVIIYDQLPGKTILSSMPETAEKIDVGKYAGNHTMTQSEINDVLVRKAKEGKMVVRLKGGDPYVFGRGGEEAEVLVAEGIEFEVVPGITSAIAVPAYAGIPVTHRESTSMVTFITGHEDPTKEESGLDWKTLAKFNGTIVIFMGVKMLRRNAEELIKHGKDPETPVAVIERGTRPDQRVTVGTLENIADLAEERKVKAPAITVVGEVVNLHEILGEQLTGAEF

SEQ ID NO: 14355 - protein, 983 aa, Unknown
  Synechocystis sp. PCC 6803
MPNLEPAVVVPTSEAIAVDLTKLEEKLAPADSFLDRHLGPGETEQRQMLQTLGFDTLGDLIDQAVPPAIRFPRSLQLPASQSEYGAIAQLKSIASKNQVFRSYIGMGYYDTITPPVIQRNILENPGWYTAYTPYQAEIAQGRLEALLNFQTMVMDLTGLEIANASLLDEGTAAAEAMALSYGVSKSKANAFFVAQDCHPQTIEVIKTRANPLGIEVIVGDHHTFSFSTSIFGALLQYPATDGAVYDYRSFIDKAHQHQALVTLAADPLSLTLLTPPGELGADIAVGSTQRFGIPLGYGGPHAAYFATKAEYQRKMPGRIVGVSKDAHGNPALRLALQTREQHIRRDKATSNICTAQVLLAVMASMYGVYHGSTGLKNIALRIHQLTVLLAIGLKRLNYSLNNDYFFDTLRVGVGEQSAPAILKAAEGRGINLRPLVPGEVGISLDETVTVQDLLDLWQVFAGKDNLPFTPEELWSEVKTSFPADLTRQSLYLQDAVFNQYHSETELLRYLHQLESKDLALNTSMIPLGSCTMKLNATAEMMPVTWPEFGKIHPFAPAGQTEGYQILFAQLEAWLGEITGFDAISLQPNAGSQGEYAGLQVIRQYHLSRGEEQRNICLIPESAHGTNPASAVMCGMQVVPVKCDGEGNIDVEDLTSKAEKYGDRLAALMVTYPSTHGVFEATIGTICDIVHRFGGEVYMDGANMNAQVGLCRPADFGADVCHLNLHKTFCIPHGGGGPGMGPIGVKSHLQAFLPRTSLNSTAELQAEDQSIGMISAAPYGSASILVISWMYIAMMGPQGLTKATEVAILSANYMAKRLENYYPILFRGNNELVAHECILDLRPLKKQAAIEVEDVAKRLMDFGFHAPTVSWPVLGTMMVEPTESESLGELDRFCDAMIAIYQEAQAITHGEIDPADNPLKNAPHTAQSLICGEWNHPYSQEEAAYPAPWTKQFKFWPAVGRINNTYGDRHLVCSCEGMEAYKEG

SEQ ID NO: 14356 - protein, 401 aa, Oryza sativa
MSSGGGRPPAAQHIVRSVRQRFVPLPPPLARAPFAAAPGDYHRFAAASRGGEIDEGIVIRRTPSCGIDAKVEGFVKCLSSGSPGNPSTPASSRYDNSLGLLTRKFINLLKQAQDGILDLNDAAKILDVWVRKRRIYDITNVLEGTGLIEKKLKNRIRWRGSDDSGTNLDSDISCLKTEVENLYIQEQALDRSISEIREKMEELTEDESNHRWLFVTEDDINGLPCFQNEALIAIKGPRGTTVEVPDPDELLPQKKLSDEHPYYIISQYKKMEELGETATPPRHASVVEPPSIATEAGHSSKQTMPLNVQQDIQETPELNASRAFGRMKKITPSDVDTDADYWLLTDDDISITHMWTTASEMQWDQIDTNDFLAEEISDTPCALNQPSAAASEPTGVGFNHG

SEQ ID NO: 14357 - protein, 264 aa, Ashbya gossypii
MCLTEPGDDKRKAASVFRQLRTRLAAGATVISRDFLFRLVISNRKTVAHRLALTQIYIQLHDTLIRTHTGEHVDTMTFDTPPPAAPVSPSLKFSPQKHKLLTLAAGCFWEQEHMLRKHLGHKIVDLVAGYANGNVPTDTKGVTYERVCVGNTNFAEVVQVAFDPEVLGLSELCDFFFRMHDPTTLNAQGPDVGTQYRSALYAHSDEDLSQVRQILERWQPRWANCIKTEVALAESFYDAEEYHQRYLTNNPTGYQCPTHYLRNV

SEQ ID NO: 14358 - protein, 419 aa, Gloeobacter violaceus [sequence omitted]

SEQ ID NO: 14359 - protein, 554 aa, Arabidopsis thaliana
MSLCCDLQINLNNQFTFFVNQDLISEYSGFLRKMIKQSNKKKKNHKNSRIIIEVEDFPGGSDGFDLVLRFCYGGGISIDVSNVSILHCSSVFLEMTEKLCSSNLLLRTEKFLEGMFYWSWNDIVLCLKSCEQVFLHADSYGLVDKLVFGVLAKIPQNSDVSHVFSSSSPSSSASASASSQSPETAMIRSYSDKRSTSRSFSCRTSNEWWFDDMSILGPKIIEKLINTLGAHDKNNDSLVLTKFLLHYLKTKVPNKSTNKLEYSGLADTAVQGVVFAAKTAFSCRKMFWVLRVLSGFSISKESRIGLERVIGEMLDQATLDDLLIPAGGKGEKGVYDVDLVIRLLKVFVRIGNTEEGDQNLRMRRIGKLIDKYLREISPDQNLKVSKFLEVAESLPDSARDWFDGLYRAINIYLESHPKLSSEDRTKLCRCLNYKKLTLDTCKQLAKNPKIPPNIAVQALKSQQLSNETRPHSREDKNKVNKIWNSRKYLEEKPILVCLKGFDMSEKFEDDLMMNLERKQWNNSEKVSKEKKSEVMSRSVRHGHTHSSSSFPRLC

SEQ ID NO: 14360 - protein, 325 aa, Glycine max
MAVEKSGIAKDVFLLIGKTPIVYLNKIADGSVARVAAKLELMEPCSSVKDRIAYSMIADAEKKGLITPGQSILIEPTSGNTGIGLAFLAAAKGYKLIITMPASMSLERRTILLSFGAELVLTDPAKGMKGAVPKAEEILDKTPNAYILQQFENPANPKVHYETTGPEIWEGTRGKVDALVSGIGTGGTITGAGKFLKEKNPNIKLYGVEPVESPVLSGGKPGPHKIQGIGAGFVPGVLEVSLVDEVVQISSDEAIETAKLLALQEGLFVGISSGAAAAAAIKIAKRPENAGKLIVVIFPSFGERYLSSVLFESVRREAESLTFES

SEQ ID NO: 14361 - protein, 232 aa, Oryza sativa
MTVVDAESRFHVLAVDDSLIDRKLIEMLLKNSSYQVTTVDSGSKALELLGLRDEGDDSSSSPSSSSPDHQEIDVNLIITDYCMPGMTGYDLLKRVKGSSSLKDIPVVIMSSENVPARINRCLEDGAEEFFLKPVKLADMKKLKSHLLKRKQQLPMAAAAPDKPPHKPDEAAASAAAIAEAATAQTDGIISDCSCSGSSKRKAAAMEQEVISSPDQRTKPRLSSTSSGLAVET

SEQ ID NO: 14362 - protein, 243 aa, Oryza sativa
MAEELKLLGSLSGVSPYVIRAQMALAVKGLAHDYLPEDLTRKSKLLLDSNPVHKSVPVLIHNGKPVCDSLVIVEYVDEAFPGGAAALLPADPYHRAVARFWAAFIDSKVFPPCLAILKTAAAEAEEEKAAKVKETVEALQLVEGAFGECSKRKPFFGGDAVGYLDVVLGCYLCWFEGVSEIAGGVSPPLLDASRTPQLAAWAARFRSAADAVGCSVPRVDKVEAYLNNVLKPKWSAAAAASSH

SEQ ID NO: 14363 - protein, 308 aa, Hyoscyamus niger
MEEQGNNESAYISSILPGWFSEISPLWPGEAHSLKVEKILFQGKSDYQNVVVFQSSTYGKVLVLDGVIQLTERDECAYQEMITHLPLCSIPNPKKVLVIGGGDGGVLREVSRHSSVEQIDICEIDKMVIDVSKQFFPNVAIGYEDPRVKLHVGDGVAFLKNVPEGTYDAVIVDSSDPIGPAQELFEKPFFESVARALCPGGVVCTQAESIWLHMHIIEDIVSNCRQIFKGSVNYAWTTVPTYPSGVIGFMLCSTEGPAVDFKNPINPIDADDSHTKTRGPLKFYNSEIHSASFCLPSFAKRVIESNAK

SEQ ID NO: 14364 - protein, 182 aa, Brassica napus
  misc_feature (57)..(57): Xaa can be any naturally occurring amino acid
MAYSMLSSAAVVTSPAQATMVAPFTGLKSSSAFPVTRKANNDITSIVSNGGRVSCMXKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 14365 - protein, 576 aa, Vibrio angustum
MIDPEKHIALLKQKLEREHASRLAAEKLLEAKSHELYNANQMLNDSYEKLQMQAKFDSELLTYQNKMENLLLRYARLFLKHSATRESIQQLLDSLVDGHYISGCHITIYPADNINISGSYSSGRLQQWEPPEELESTNSLWDKSGHTLWINIINNRGKIGVLAVRIICTDDRLPAIQKHMALFGELFRSAIGRQITFNQAIDAKKRAEDSEQSTRDFLAMINHELRTPLNGLLGAAELLQDTPLDNDQQKLLTTLNHSGELLRAIINDLLDYSKINAGMLELIEKPFDCHLLAVKLEDIFTHRSHEKRLDFNIYYSNDLPKIFIGDEDRIKQIFVNLISNAIKFTPAGFVHAKLWWQNKHLQFTVKDSGCGIDHSDQHKLFKPFSQVDNTSKRSHEGTGLGLVICKQLCEQMGGSIRVESSLGRGACFNVSLPLAISDHAHFNAKVRKPNKTPIKHLKVLVVEDLKTNQMIIKLMLNKVQIEPTIVDNGQKALDILNIESFDVVFMDCRMPIMDGYTATKELRKQDYSKPIIALTAGTTSAEREACIQAGMNDILCKPYLASELHDILTIWGCEIK

SEQ ID NO: 14366 - protein, 855 aa, Mycobacterium avium
MSADGISRDGCAPRHIIVVGHGMVGHRFVEALRARDTEGRWRITVFAEEADAAYDRVGLTSYTESWDRALLALPGNDYQGDPQVRLVLNQRVTEIDRATKSVVTADGQRHHYDTLVLATGSYAFVPPVPGHELPTCHVYRTLDDLDAIRADAQRAAQTDHARAGVVIGGGLLGLEAANALRQFGLATHVVEMMPRLMAQQIDEAGGALLARMIGDLGISVHVGTGTEAIEPVEGPDGSTTVRVRLSDGQVIDAGLVIFAAGIRPRDELAVAAGLARAERGGVLTDLSCRTSDPDIYAIGEVAAIDGRCYGLVGPGYTSAEVVADRLLDGSAEFGEADLSTKLKLLGVDVASFGDAMGTTENCLEVAINDAVNRTYAKLVLSDDAKTLLGGVLVGDASSYGVLRPMVGSELPGDPLALIAPASSGGGTALGVGALPDSAQICSCNNVTKGDLKCAIADGCADVAALKSCTSAGTSCGSCVPLLKQLLEAEGVEQSKALCEHFSQSRAELFEIISATEIRTFSGLLERFGRGKGCDICKPVVASILASTGSEHILEGEQASLQDSNDHFLANIQKNGSYSVVPRVPGGDIKPEHLILIGQIAQDFGLYTKITGGQRIDMFGARVDQLPAIWKRLVDGGMESGHAYGKALRTVKSCVGTDWCRYGQQDSVQLAIDLELRYRGLRAPHKIKMGVSGCARECAEARSKDVGVIATEKGWNLYVGGNGGMTPKHAQLLASDLDTETLVRYIDRFVMYYIRTADRLQRTAPWVESLDGGLDHVREVVCEDSLGLAEEFEAAMERHVRNYKCEWKGVLDDPDKLSRFVSFVNAPDAVDSTVAFTEHAGRKIPVSIGMPKIRQG

SEQ ID NO: 14367 - protein, 161 aa, Ustilago maydis
MVSFYDLKAKKPSQEDYTFDQLKGKVVLVVNTASKCGYTPQFAELEELNKKYADQGLQIIGFPCNQFAGQDPGSDESIGEFCQRNYGVTFPMMAKSDVNGSNTNEVFQFLKKEKAGILGTEMIKWNFTKFLIDKEGNVIERYGSNTKPSAIAPAIEKLLSQ

SEQ ID NO: 14368 - protein, 508 aa, Thermobifida fusca
MGSTATPAAPHVRIAIIGSGFGGIGLGVRLRQAGQTDFVILERAGDVGGTWRDNTYPGCACDVPSHLYSFSFAPNPHWPRSFSGQPHIRAYLEDVTDRFGLRPHIRTGHEVVEARWDPAQLRWTVRTTATTYTCDILVSAAGALADPVIPDIPGLDGFPGQVFHSSRWNHDHDLAGERVAVIGTGASAIQIIPAIQPLVQRLVVFQRTPAWVMPRADRPITRLEQWLFRTIPATQKLARAGVYLTRESMVGAFVRYPALLQAATVVARAHLRRAVRDPELRAKLTPDYVMGCKRILLSNDYYPALSRPNVDVVASGLQEVRGSTLVAADGTTHDVDTVVFATGFHVTDMPIANRIYDGAGRSLADHWRDGMSALRGTTVTGFPNFFLIVGPNTGLGHSSMIYMIESQLNYILSALRHLDSTGSAALEPRRSAQDAWNARLQQRMRRTVWARGGCASWYLDARGCNTTLWPGSTLSFRAATRRIDPAEYHLFPARTPTAPSAPTAPEVV

SEQ ID NO: 14369 - protein, 316 aa, Coffea arabica
MADAVNSNSKEEAAQLPDGVSSVIPGWFSEISPMWPGEAHSLKVEKILFQGKSDYQNVMVFQSSTYGKVLVLDGVIQLTERDECAYQEMIAHLPLCSIPSPKKVLVIGGGDGGVLREVARHLSVEQIDICEIDKMVVDVSKQFFPDVAVGFEDPRVVLHIGDGVAFLKAVPEGTYDAIIVDSSDPIGPAQELFEKPFFESVAKALRPGGVVCTQAESIWLHMHIIEDIVANCRQIFKGSVNYAWTTVPTYPSGVIGFMLCSTEGPPVDFKHPINPIDANDGRSKTMKPLKFYNSEIHSAAFCLPSFAKKVIDSKAN

SEQ ID NO: 14370 - protein, 332 aa, Trichodesmium erythraeum
MVGKISQADKRKEVIRTLESAYPISTEKANLAILGVGAWGSALAGLVSHNQHKISLWSRNLNISLEQVIKDVDMIVSAISMKGVNETIEKIQKIGLPKKVIIITATKGLDPETTCTPSQIWEANFPNNPVVVLSGPNLSKEIDDKLPAATVVASKNIEAVTAVQNIFASGLFRVYSSSDPIGTELGGTLKNVIAIASGVCDGLELGTNAKSALLTRALTEIIRIGTHLGGKTETFFGLSGLGDMLATCSSSLSRNYRVGYGLAQGKNLEEILEELPGTAEGVNTTNVLINIANREEISLPISSQVFLLLNGKITLEEAVEALMGRDLKSEFY

SEQ ID NO: 14371 - protein, 268 aa, Unknown
  uncultured marine bacterium
QPNAMGRREVGGLANQLAAHMDFATRMQSNWSSAFGQAPNMAQENGLKAIDMFQAVEQGKIKVLWIMSTNPMVSLPDTEQVRRALEKCELVIVSDCKQSTDTTAYADVLLPALPWSEKDGTVTNSERRISRQRGLLPARGEAKADWWAICQVAGAMGYQSAFSYRSVHDIFREHAALSGFENHGKRDLDISLFSNISEQAYQDLLPIQWPVTKESPNGTARMFTDGRFFTADRKANFIPIDVKEPQIAPDEDWPFVLNTGRVRDQWHT

SEQ ID NO: 14372 - protein, 314 aa, Nicotiana sylvestris
MEAANHNNNGCTNESPYISSVLPGWFSEISPLWPGEAHSLKVEKILFQGKSDYQNVMVFQSSTYGKVLVLDGVIQLTERDECAYQEMIAHLPLCSIPNPKKVLVIGGGDGGVLREVSRHSSVEQIDICEIDKMVVEVSKQFFPDVAVGYEDPRVNLHIGDGVAFLKNVAAGTYDAVIVDSSDPIGPAQELFEKPFFESIARALRPGGVVSTQAESIWLHMHIIEEIVANCRQIFKGSVNYAWTTVPTYPSGMIGFMLCSTEGPAVDFKNPINPIDDDASHNKTLGPMKFYNSELHKASFCLPSFAKRVIESKGK

SEQ ID NO: 14373 - protein, 455 aa, Spiroplasma kunkelii
MTTVLELYQDQVKDQSEVTILGWVRSNRSSGKLGFLVMNDGTFFNNVQIVYKAEKLANFLAISSLRISSAIKVVGKFCVTPSAKQTFEIQASVIEILDDASEDYPLQKKEHSYEYLREIPHLRAKTNTFNAVFRIRSSSSFAIHEFFNKNNFIYVHTPIITGNDAEGAGESFIVTTRTDNNYNEDFFGKKASLTVSGQLHAEGFAQAFRNVYTFGPTFRAENSNTTRHAAEFWMIEPEISFIDLEENMTLIEKMIKHIIIYLFINNHYELDFLNNNVDDKLLERLKSVLNDEFAHLSYTKAIEILQKAVTKGQKFENPDIFWGMDLQTEHERYLCEIETKKPTFLFNYPKEIKAFYMKINDDNKTVAACDLLVPGIGELVGGSVRENDYDKIFSRCNELKIPTTDLQWYIDLRKYGYYKSAGFGLGFERFIMYVTGMTNIRDVIPFPRTPRNLLF

SEQ ID NO: 14374 - protein, 271 aa, Unknown
  uncultured marine bacterium
QPNAMGGREVGGLANTLAAHFEFGDPQSHQTVSEFWQADNLATHAGLKAIDLFDAMNEGKIKAVWIMATNPVVSLPDSEKIKTALEKCPFVVVSDCIVDTETTRLADVVLPAQGWSEKSGTVTNSERRISRQRRVLPSPGEAKPDWWILKEVAQKMGFKDQFDYRHEGQIFKEYCEMTALGNETGKARDLCLIGLTKLDEQGYGELTPHEWPVMEYQPEIIEQRMFTNGEFFTEPGKAQFIAVEHDKPIADTSVEFPLIMNTGRIRDQWHT

SEQ ID NO: 14375 - protein, 367 aa, Bdellovibrio bacteriovorus
MRRFVSSETSVTEYFGYFISIYALMQFLASPLLGALSDRFGRRSVLLISLLVAGFDYILMAYAPTLEILFAGRIIAGLTGANITVAMAYIADVSNDENRSANFGMVGAAFGLGFIIGPAIGGLLGHLGPEYPFLVAAALNLLNFFFGLFILPESLPKNLRRKIDLRRTNPLYSLLGVLRSKHLLALLLVYFFFQLAGQTHPSIWTLYTETRYGWTTAQVGLSLAVVGLLSALAQGWLTRLVIPKFGEHRTVVIGAFGYAVSFIFYGMATEGWMMYAILILSAVFWTSPPALQSLISHKTPPQEQGELQGSLVSLSSLAAIITPLVTTKLFAHFSSGNPGTLYLPGAPYYFGALICFVSWAIMYRRKA

SEQ ID NO: 14376 - protein, 374 aa, Pseudomonas fluorescens
MAKRDYYEVLGVERGSSDAELKKAYRRLAMKHHPDRNPGDKASEDMFKEANEAYEVLSDSSKRAAYDQYGHAGVDPSMGGGGGGFGGQNFSDIFGDVFSDFFGGGRGGSRGGAQRGSDLRYTLELNLEEAVRGTTVNIRVPTLVNCKPCDGSGAKKGSSPVTCPTCGGIGQVRMQQGFFSVQQTCPRCHGQGKIISDPCDSCHGEGRVEEYKTLSVKVPAGVDTGDRIRLSGEGEAGTQGGPTGDLYVVINVREHAIFQRDGKHLFCEVPISFVDAALGGELEIPTLDGRVKLKIPEGTQTGKQFRIRGKGVAPVRGGGAGDLMCRVAVETPVNLSRRQRELLEELRGSLDDDNSHSPKTTGWFEGVKRFFGDL

SEQ ID NO: 14377 - protein, 481 aa, Triticum aestivum
ERLRKQQKSVVVPIGRLSIGFCRHRAILFKALADFIGLPCRIAQGCKYCSAPHRSSCLVKIENDRRYSREYVVDLVVAPGSICSPDSSINGQLLSSVSSPFKTSCTASLENYAAPVAAWNRAIADDRCNSVFSDSQYSVAGDKNPVQADTKCGQVMQNDNCNNMSVFQVSRQFKAMEVGTEGVNKENIPGLTLPKHLLAESSFAMDWLEISWDELELKERIGAGSFGTVYRADWHGSDVAVKVLTDQGVGEAQLKEFLREISIMKRVRHPNVVLFMGAVTKCPHLSIVTEYLPRGSLFRLISKASSGEILDLRRRLRMALDVAKGINYLHCLNPPIVHWDLKTPNMLVDKNWSVKVGDFGLSRFKATTFISSKSVAGTPEWMAPEFLRGEPSNEKCDVYSFGVILWELLTMQQPWGGLGPAQVVGAVAFQNRRLPIPKDTIPELAALVESCWSDDPRQRPSFSSIVDTLKKLLKSMQGSGS

SEQ ID NO: 14378 - protein, 268 aa, Unknown
  uncultured marine bacterium
QPNAMGGREVGGLANMLAAHMDIENPEHRQWVQEFWDSPTICTEPGLKAIDLFDSMEQGKVKAVWIMATNPLVSMPNRGKITRALENCDFVVVSDCVEQNDTLALADVKLPATAWSEKEGTVTNSERSISRQRAFKAATGGAKNDWQIICDVAQKMGYSEGFDFQTPHQIFVEHARLSGVNNFGDRDFDISALADLSLKDYQQLKPVQWPVNQRYPDGCKRLFTDGRFFTPSGKARFIPLHPELPQQQTCKDYPLILNSGRIRDQWHT

SEQ ID NO: 14379 - protein, 67 aa, Unknown
  Synechocystis sp. PCC 6803
MEGTVMESLPNAMFRVDLDNGFNVLAHISGKIRRNYIKILPGDRVKVELTPYDLTKGRITYRLKNKK

SEQ ID NO: 14380 - protein, 138 aa, Vibrio vulnificus
MSNGRILHTMLRVGNLDKSIQFYTEVMGMQLLRTNENKEYEYTLAFLGYGDESQGAVIELTYNWGKTEYDLGSAFGHIAIGVDDIYVTCDAIKAAGGNVTREPGPVKGGTTHIAFVKDPDGYMIELIQNKQASAGLEG

SEQ ID NO: 14381 - protein, 545 aa, Zymomonas mobilis
MLCFQCEQTHSGTGCVIRGVCTKTPEVAAIQDLMIFASAGLSYVAKKLPDSCEAERKEAASLVIQALFSTVTNVNFDADVLTKALYHLVDFRDALKAKLPEDVELPLAATLDFSRDRETLVKQGESYGIASRQKTLGIDVTGLQELLTYGMKGMAAYAHHAAVLDYRDPDVDNFLLEGMAALTDHSLDIQALLAVVMRCGEASYKTLALLDKANTSSFGHPVPTNVKMGPSKGKAILVSGHDLLDMKELLEQTKDTGIKVYTHGEMLPAHGYPELNKYPHLAGHYGGAWMLQRQEFINFPGPIVMTTNCLMEPRKEYAGRVFTRDLVGWPGLTHLPDRDFSKVIEAALESEGFTEDQESRSHIAGFGHHTVLDSADAVVSAIKKGDIKHFMLVGGCDGIKSGRHYFTDIAEKAPKDWVILTLGCGKFRVTDLDLGKIGDLPRLLDMGQCNDSYSAIRVALALAEAFDTDVNSLPLSLVLSWYEQKAVCVLLALLHLGVKGIRLGPTLPAFITPNMLKILVDNFDIKPIGNSAEEDLQEILAAKAA

SEQ ID NO: 14382 - protein, 359 aa, Oryza sativa
MASCGFEGFEKRLELVFELPASGGEVARHGLRLLPAEALREVLDAAQCAVVSAAGNAAADAYVLSESSMFVYPGRVVLKTCGTTPLLRAVPVLLRAAAALRLRLRSCRYSRGEYLFPEAQPFPHAHFADEVAYLDAAIPRELLRFRRSAVMPSSSSSSPGASHRWHVYSASSSASSSDADGAARLTAEVCMTELDRGMAARFYQRPGDGRTSHAIGDEMTAASGIGGVVDENDPRSLVCAYAFAPCGYSMNALDGARYATVHVTPEDGHCYASFECATDDAAAALAAIRRAVAAFRPATVSVSISHTSSAASSLCTPVAEALEPLGLACHCRAAEVFPGAGTVTYQTFTAPATKHEHDN

SEQ ID NO: 14383 - protein, 293 aa, Kluyveromyces lactis
MSELTHPTIVDGWFREISDTMWPGQAMTLRVEKILHHEKSKYQDVLVFKSTDYGNVLVLDNAIQVTERDEFSYQEMIAHLALNSHPNPKKVLVIGGGDGGVLREIVKHDSVQEAWLCDIDEAVIRVSKEYLPEMAKSYSHPKVKTHIGDGFQFLRDYQNTFDVIITDSSDPEGPAASLFQQSYFELLNGALTEKGVISTQAESMWIHLPIIKELKKACKEVFPTVGYAYTTIPTYPTGQIGFMVCSKDANVDVTKPLRSISEEEEEAKYRYYNKKVHEASFVLPTWVAKELDL

SEQ ID NO: 14384 - protein, 259 aa, Unknown
  uncultured marine bacterium
QPNAMGGREVGGLANQLAIHRGFDPDSIKLISEFWQTDNLATRPGLKAIELFEAVERGDIEVIWIMATNPVVSMPDNVFIQRALQKCPLVIVSDVTHDSDITQYADLLLPAAGWGEKQGMVTNSERMLTRQRKFLTSKGEAKPDWKIIAEVGKKLCERLDKPNAFDFKSESSVVREYAAMTGLNKDTPLLLDLSKYAEISDEEYESWNPVQWGSSRPFADGKFSTENRKARFVVTTAPLIKGESRLWLNTGRQRDQWHT

SEQ ID NO: 14385 - protein, 355 aa, Zymomonas mobilis
MSESYFKVLHLKMPFSALDDAPNLAEFISIAPMSLFFFVVIAEIKEEIISGHLASFRRVILPLISALGGMMIPACLYGLITSGHLEVSRGWAIPIATDAAFTLPIILALGRHVSEGARVWLMALAIFDDLLGIVVIALFYASHLNGYALFAAGLITAVMIGLNKKSVQNLWVYASAGVVLWWALLVSGLHPTIAGVITGLALPSVADQPEKASPLERGKQIIAPWVTWLILPLFGFVSMGMSLSAMSFHVLLAPVPLGVALGLFLGKPIGVFGATIMATRLKIATLPKGTSLRMLFGLSLLCGIGFTISLFIAELAFSGSDFLVPAKYGILMGSLLSALAGWLWLRFLKFPAKGV

SEQ ID NO: 14386 - protein, 245 aa, Pseudomonas aeruginosa
MSGKVWLVGAGPGDPELLTLKAVRALQDADVVMVDDLVNPSILEHCPSARVVRVGKRGGCRSTPQDFIQRLMLRHARQGRSVVRLKGGDPCIFGRAGEEAEWLARHGIDSEIVNGITAGLAGATACGIPLTYRGISRGVTLVTAHTQDDSPLAWEALARSGTTLVVYMGVARLAEIQAGLLAGGMAEDTPLAMIENATLGNQRECRSNLGELLRDAGRFALKSPAILVIGEVTRDIVSQPISLSA

SEQ ID NO: 14387 - protein, 354 aa, Oryza sativa
  misc_feature (267)..(267): Xaa can be any naturally occurring amino acid
MRSCGSPLFCFRFVPFFFLSPPLLSFSFVLVSFVGCYCVSPLLLLSCVLVGSSFFSSFLPSLPLPRSCSRVSVSYFSASVLRVVVGSLSSSASRFIRGLFQSGVLWSFCARRVSAVLVWVRLVLCALLIDLDEHYGVALFCVGGVSSYFAAVCVGVCPSYLLVIDCVLWASFRGPCPCLPVSYCVRCVVWGAPLCLTRISAFWSGPTAVYTQLPCSLIRPGSSRGRATAMATVSAAAATSVVARAVLAGPLGLPQMRARRSERVRCXNYSKEAATPAAAVKGAGASLLAMAATAAPAMALVDERMSTEGTGLSLGLSNNLLGWILLGVFGLIWSLYTIYTSDLEEDEESGGLSL

SEQ ID NO: 14388 - protein, 541 aa, Oryza sativa
MASPPTASASASEAAESGRRSAPGPIDVPSPRDHLHHLLDRRDTPRVVHVEGTTMQRQRGEAAGDAGAAAAAKPEVKLVTGDGGYVLEDVPHVCDYLPDLPTYSNPLQDNPAYSVVKQYFVNPDDTVCQKAIVHKDGPRGNHFRRAGPRQRVFFESDEVHACIVTCGGLCPGLNTVIREIGGYRGFYACNTIDLSPKSVNDIHKRGGTVLGTSRGGHDTMKIVDSIQDRGINQVYVIGGDGTQRGAGVIFEEIRRRGLKVAVAGIPKTIDNDIPVIDRSFGFDTAVEEAQRAINAAHVEAGSAENGIGLVKLMGRHSGFIAHYATLASRDVDCCLIPESPFYLEGEGGLFRYLEKRLKENGHMVIVVAEGAGQKLINETKESMGKDASGNSILLDVGLWLSQKIKEHFKKIKTTINLKYIDPTYMIRAIPSNASDNVYCTLLAHSVVHGAMAGYTGFTVGQVNGRHCYIPFYRITEKQNKVSITDRMWARLLSSTNQPSFLSKKDVEDAKMEEERASKFFDGPPPNPKVEDKVASNGKAVK

SEQ ID NO: 14389 - protein, 259 aa, Unknown
  uncultured marine bacterium
QPNAMGGREVGGLANQLPIHRGFDPDSIKLISEFWQTDNLATRPGLKAIELFEAVERGDIEVIWIMATNPVVSMPDNVFIQRALQKCPLVIVSDVTHDSDITQYADLLLPAAGWGEKQGMVTNSERMLTRQRKFLPSKGEAKPDWQIIAEVGKKLCERLDKPNAFEFKSESSVFREYAAMTGLNKDTPFLLDLSKYAEISDEEYESWNPVQWGSSRPFADGKVSTENRKARFVVTTAPLIKGESRLWLNTGRQRDQWHT

SEQ ID NO: 14390 - protein, 181 aa, Xanthomonas campestris
MSQSIHDIPVTDINGGATSLAAHRGKVLLVVNVASKCGLTPQYEGLEALYRDKQAQGLEVLGFPANDFNGQEPGSEAEIAQFCQLTYDVTFPLFSKIAVTGAEIHPLYQALTSAQPQATGDGPMREKLAGYGIAANPAPGVLWNFEKFLIGRDGQVIERFAPDVAADDVRLRQAVDAALAH

SEQ ID NO: 14391 - protein, 336 aa, Archaeoglobus fulgidus
MNPGFEDVLRRNVERYADRIDYVVMNHAEPDHAGAIPFIMESSDALLVTTKKGAEMAKFYYDVPESRVRVVEDGEEISLGEKTLRFIHAPWLHWPETMFTYLVEDGILFPCDFFGCHTAYGFYDDEVPEILYYAQRYFGEIMMPFRSMGKKALEKIKGLKINMIAPSHGPIYRNLEKILSAYEKWTAGETEEKVLVVYATMWGSTERMVNLLTELLMKEGLKVAVHNLASADIGEIAKDLVDSRAIVLGTPTVLGGMHPLALFAANLVKALRPPARYAAVLSSFGWGGGAVKQIEEIVSSLNLEVLGVVEVRAKPSDSDLEKVRKLAEKIAGVVKV

SEQ ID NO: 14392 - protein, 219 aa, Brassica napus
MGKRDKKPNRRRHKGEFSNDGEDFYDQHPPAAPSVVDEDEQNSEEEESDELQPSSDLPSKFLLYQQSVQSPKGDISYLQKFFLMYVGGRQPLHFQEDFCGTALLSAEWLKADTRRTAVGLDFDLEALEWCMDNNISKLGADVCSRMSLLHGNVLTPLDAKQVTSRSHELMQNISLDDEVEEDPGVESLEKDGLPKRDIVCAFNFSCCCLHKRSELVTYF

SEQ ID NO: 14393 - protein, 166 aa, Brassica napus
  misc_feature (12)..(12): Xaa can be any naturally occurring amino acid
  misc_feature (16)..(16): Xaa can be any naturally occurring amino acid
  misc_feature (27)..(28): Xaa can be any naturally occurring amino acid
  misc_feature (36)..(36): Xaa can be any naturally occurring amino acid
  misc_feature (40)..(40): Xaa can be any naturally occurring amino acid
  misc_feature (48)..(48): Xaa can be any naturally occurring amino acid
  misc_feature (50)..(50): Xaa can be any naturally occurring amino acid
  misc_feature (53)..(54): Xaa can be any naturally occurring amino acid
  misc_feature (60)..(61): Xaa can be any naturally occurring amino acid
  misc_feature (64)..(64): Xaa can be any naturally occurring amino acid
  misc_feature (66)..(66): Xaa can be any naturally occurring amino acid
  misc_feature (80)..(80): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (92)..(92): Xaa can be any naturally occurring amino acid
  misc_feature (94)..(95): Xaa can be any naturally occurring amino acid
  misc_feature (98)..(98): Xaa can be any naturally occurring amino acid
  misc_feature (103)..(103): Xaa can be any naturally occurring amino acid
  misc_feature (106)..(106): Xaa can be any naturally occurring amino acid
  misc_feature (111)..(111): Xaa can be any naturally occurring amino acid
  misc_feature (113)..(114): Xaa can be any naturally occurring amino acid
  misc_feature (117)..(117): Xaa can be any naturally occurring amino acid
  misc_feature (121)..(122): Xaa can be any naturally occurring amino acid
  misc_feature (127)..(128): Xaa can be any naturally occurring amino acid
  misc_feature (135)..(136): Xaa can be any naturally occurring amino acid
  misc_feature (145)..(146): Xaa can be any naturally occurring amino acid
  misc_feature (156)..(156): Xaa can be any naturally occurring amino acid
  misc_feature (159)..(159): Xaa can be any naturally occurring amino acid
  misc_feature (163)..(163): Xaa can be any naturally occurring amino acid
MSSSMLSSAAVXTSPXAHATMVAPFTXXKSSAAFPXTRTXDNDVTSIXSXGGXXSCMKVXXPVXKXKFETLSYLPDLTEXELGXEXDXLLRXKXXPCXEFEVXHGXFVYRXEXXSTXGHYXXRYWDXXEASPCSXXTDSAQVLKXXPRVAKREYPXAFXRTIXFRQ

SEQ ID NO: 14394 - protein, 498 aa, Magnetospirillum magnetotacticum
MCGIAATIGLSDATAFTSLFGAIGHRGPDESGIRESGDIRIGMHRLAIVGRMGDSVPLIGADGLVLAFNGEIYNHQALRADFPDYPFAGQSDAEVLFPLLKRHGLGGLDRLRGMFAFVLTDMESGEFLAVRDPFGIKPLYYAETGGGFAFASEMKAFAAMGITPRFLPPGHLLTRHGLRRWYRVPGRFRLSRRPNLRALLERAVASHLPPEGPCGVFLSGGLDSSLVAALAARSRPDMVAYSVVLPGSPDEEPAALMAAHLGIRHKVLRATADDIRAALPEVIGALESFNPIMVRNAVPLYLLSKMAAKDCKVVLGGDGADELFAGYDYLSRVPRRFWPQAMDYGFSNLHRTELQRVDRMTMAHGLELRVPFLDREVAEAAVNLPLSAKFGIKDGTPMPKLALREAAEGLLPPSIQWRRKLPLADGSGFGGLDLGAGRDKADPVPGWDVGDEDAVAFFPLWRVRFPLARPDSAIWRDCGRYHDFEECHGRPLLELFRR

SEQ ID NO: 14395 - protein, 479 aa, Arabidopsis thaliana
  misc_feature (29)..(29): Xaa can be any naturally occurring amino acid
MSGVVRSSPGSSQPPPPPPHHPPSSPVPXFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAVRSFYEISFMSRVTSSPITLTPSGSCRYDSSLGLLTKKFVNLIKQAKDGMLDLNKAAETLEVQKRRIYDITNVLEGIDLIEKPFKNRILWKGVDACPGDEDADVSVLQLQAEIENLALEEQALDNQIRWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDYINTQSLTLAKAGIDWDYGIADVSTPPPGMGEIAPTAVDSTPR

SEQ ID NO: 14396 - protein, 516 aa, Arabidopsis thaliana; identical to SEQ ID NO: 587

SEQ ID NO: 14397 - protein, 272 aa, Thermobifida fusca
MFYWVLKATLGPVLAVLWQPRAYGVENVPRHGPAILVGNHLSFSDHFFGPLPLPRKITFLAKAEYFTGKGIKGFLSRLFFTGVGQIPIDRSGGKASEAALRTGLRVLEQGKLLGIYPEGTRSPDGRLYRGRTGVARLALEAKVPVIPMAMINADKIMPPGKIIPRLGIRPIVKFGKPMDFSRYYGLEKDPRVLRAITDEIMYALMELSGQEYVDRYAQTVKAELAAAAQQEKKEEQQSRKEQRRARREAKRRERARRKAERKRKKKTESAQP

SEQ ID NO: 14398 - protein, 1116 aa, Xanthomonas campestris
MNAVASLQADAEQSAVVADQRWYKDAIIYQVHVKSFFDSNDDGIGDFPGLISKLDYIAELGVDTIWLLPFYPSPRRDDGYDIAEYMAVHPDYGSIEDFEQLVAQAHARGIRIVTELVINHTSDQHPWFQRARNAPAGSPERDFYVWSDTDQEYEGTRIIFCDTEKSNWTWDPVAGQYFWHRFYSHQPDLNFDNPAVLEAVLEVMRFWLDRGVDGLRLDAVPYLIERPGTSNENLPETHAILRKIRATLDAEYPDRMLLAEANMWPEDTQQYFGQNADECHMAFHFPLMPRMYMAIAREDRFPITDIMRQTPEIPESCQWAIFLRNHDELTLEMVTDSERDYLWQTYAADRRARINLGIRRRLAPLLERDRRRIELMTSLLLTMPGTPVLYYGDEIGMGDNIHLGDRDGVRTPMQWSIDRNGGFSRADPAQLVLPPVMDPLYGFQAVNVEAQMRDQHSLLTWTRRVLSVRKRYQAFGRGSLRFLYPGNRRMLAYLRCYQDETVLCVANLSHTLQAVELDLSEFEGRVPVDIIGGGSFPPIGRLTYLLTVPPFGFYAFQLVSEGTLPDWHVPSPVPLPDYRTLVLRSDADESAALLPHLPTLEGEILPAWLSARRWFSAKDQALRSVRIARRTPLPGDEPMTLLELEVELEDGRHERYMLPVGIVWEREQPSTLAEQLALARVRQGREVGYLTDAFALKPMVRGVIDALRSNAALDFCDGDDASQQGQVCFEATPALATLDIPQDPEIRWLSAEQSNSSLVVADKAVFKLLRHVAVGANPEIEIGRRLTEMGYANAAPLLGSVSRIDAQGTVTTIALLQGFIRNQGDAWRWTLDHLARSFDEYATAQTDEARAEAVAGYDAFAAVVGKRLAELHEALSRATDDADFAPQRIDLPTANDVVAGVGRQVEEMWDTVNARLAGSEDSAEREALEAVLAERPQLDALLAQAPSVLADSLLTRVHGDFHLGQILVAFDDVVLIDFEGEPAKPLAERRAKASPLRDVAGFLRSLDYASEVSARGEEGTAARAGVGVDTHLDEFLVQFRRRSTQAFLDAYHAVLDASAHPWIAPAAFNAATLLFLVEKACYEVRYEAANRPGWLMVPIEGLRRILQRARAGAGDT

SEQ ID NO: 14399 - protein, 341 aa, Thermobifida fusca
MRVGVLTGGGDCPGLNAVIRAVVRKGIKEYGYEFVGFRDGWRGPLEGDTMPLDIEAVRGILPRGGTILGSSRTNLMKIEGGVERVKDNMAALGVDALVAIGGEDTLGVARQLHDHGVNVVGVPKTIDNDLNATDYTFGFDTAVNIATEAIDRLHTTAESHHRALVVEVMGRHAGWIALHAGMAAGANVILIPERPFDIDEVVAYIESRFKTNYAPIIVVAEGAHPKEGQLTLASAERDSFGHVRLGGIGQRLAEEIEARTGKEARSVVLGHVQRGGTPSAFDRVLATRLGLHAITAVHDKDFGKMVALRGTEIVRVDLSEATDQLKTVPVERYEEAEVFFG

SEQ ID NO: 14400 - protein, 85 aa, Unknown
  Synechocystis sp. PCC 6803
MTVSEVRGFGRQKGQTERYRGSEYTVEFLQKLKIEIVVDEGQVDMVVDKLVSAARTGEIGDGKIFISPVDSVVRIRTGEKDTEAI

SEQ ID NO: 14401 - protein, 132 aa, Oryza sativa
SSSKYVTVEDLGPPEKAAERVLQQYLTEFMSTRLGVRRTSNILSASSKVADDGKLYYEVEVNIKSFASNNELAVMPQDRVQRLEWDRRYLSVLGVENKRLYELRLQSPEQVFKEEEGDLRRVMDSFRVNKTV

SEQ ID NO: 14402 - protein, 326 aa, Triticum aestivum
  misc_feature (320)..(320): Xaa can be any naturally occurring amino acid
MGEASSPAIAKDVTELIGNTPLVYLNKVTDGCVGRVAAKLESMEPCSSVKDRIGYSMITDAEEKGFIVPGKSVLIEPTSGNTGIGLAFMAAAKGYRLVLTMPASMSMERRIILKAFGAELVLTDPLLGMKGAVQKAEELAAKTPNSYILQQFENAANPKIHYETTGPEIWKGTGGKIDGLVSGIGTGGTITGSGKYLKEQNPNIKLYGVEPTESAVLNGGKPGPHKIQGIGAGFIPGVLDVDIIDETIQVSSDESIEMAKSLALKEGLLVGISSGAAAAAAIKVAQRPENAGKLFVVVFPSFGERYLSSVLFHSIKKEAXESMVVE

SEQ ID NO: 14403 - protein, 401 aa, Zea mays
MASLAQHVAGLPCPPLSGASRRRPAAQRRPPSALVCGTYALTKDERERERMRQVFDDASERCRTAPMEGVAFSPDDLDTAVESTDIDTEIGSLIKGTVFMTTSNGAYIDIQSKSTAFLPLDEACLLDIDNVEEAGIRPGLVEEFMIIDENPGDETLILSLQAIQQELAWERCRQLQAEDVVVTGKVIGGNKGGVVALVDGLKGFVPFSQVSSKTTAEELLEKELPLKFVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLTLSSEGILGPLSSDAPSEDSEEPTDE

SEQ ID NO: 14404 - protein, 607 aa, Unknown
  Rhodococcus sp. RHA1
MTQTVQPAAVQTSLTPQERVDLWLASFESALAARDVDRAAGMFAVDSFWRDLVAFTWNLKTVEGRDAVAAMLHARLDDTDPVNFRTTETPDEADGVTSAWIEFETATGRGKGHLRLKGDEAWTFLTTMQELKGHEERRGRNRVKGAVHGSGGDTLSWAEKREIEERELGYTRQPYVLVIGGGQGGIALGARLRQLGVPAIVVDKNERPGDQWRNRYKSLCLHDPVWYDHLPYMPFPDNWPVFAPKDKIGDWLEMYTKVMEIPYWSSTTCTSATFDDETKEWTVVLDRDGEDVVLHPKQLVLATGMSGKPNVPSFPGQDVFRGEQHHSSRHPGPDAYVGKRVVVVGANNSAHDICKALFENGADVTMLQRSSTHIVKSDSLMDLGLGDLYSERAVAAGMTTEKADLTFASLPYKIMHEFQIPIYQKIAERDRDFYDRLEKAGFKLDFGDDGSGLFMKYLRRGSGYYIDVGASELVADGSIHLVSGQVDHLTEDAVVLTDGTELPADLVVYATGYGSMNGWAADLMGQEVADKVGKCWGLGSDTTKDPGPWEGEQRNMWKPTQQEALWFHGGNLHQSRHYSLYLALQLKARHEEIPTPVYGLQEVHHLS

SEQ ID NO: 14405 - protein, 209 aa, Pseudomonas fluorescens
MARSKTSHNWLKEHFNDPFVKMAQKDGYRSRASYKLLEIQEKDRLIRPGMSVIDLGAAPGGWSQVTSRLIGGQGRLIASDILEMDSIPDVTFIQGDFTEDAVLAQILEAVGNSEVDLVISDMAPNMSGLAAVDMPRAMFLCELALDLAGRVLRPGGDFLIKIFQGEGFDEYHKSVRQMFEKVQMRKPSSSRDRSREQYLLGRGFRGRSE

SEQ ID NO: 14406 - protein, 267 aa, Clostridium oceanicum
QPNAMGGREVGGLANQLAAHMGFSAEKTDRVQRFWQSPRIARQPGLNAVALFQAIAAGQVKAVWIMGTNPAVPLPDADAVRQALKQCPLVVVSDVMAMTDTAELAHIHLPALAWGEKEGSVTNSERCISRQRAFLSPPGQARADWWILSQVAQRMGYGEAFGYQHPSEIFSEHAALSAFENNGTRAFDIGLLAGWDKQQWLGMTPVQWPVNEQHPAGCLRLSGDKRFFHADGKARLLPVTPRLPQNAVSQRYPLVLNTGRIRDQWHT

SEQ ID NO: 14407 - protein, 537 aa, Pichia angusta
MSILALVATSIGSAQAAAIKKDTAGQHPLGMNSNFGDVFVEKGKSLLDRVSEVVSESSKNISPELRDIWNEMEAKFPDTLRNMKLKSEPAVKITKKPADFWDFNVLNEKFSNYKLRVKKTDPGALGLDHTRQYSGYLDVEDEDKHFFYWMFESRNDPVNDPVILWLNGGPGCSSLTGMLFELGSASIGPDLKPINNPYSWNSNATVIFLDQPVNVGFSYSSKSVSNTVAAGKDVYAFLELFYQQFPHLLKNDFHIAGESYGGHYIPVFASEILTHADRSFNLTSVLIGNGLTDPLNQYPFYERMACSTDGGYEPTLDESECEGMLETLPRCLSLIESCYSSQSVFSCVPASIYCNNAQLGPFQKTGRNVYDVRKMCEGTLCYKDMEYIDQYLNQDFVKEKVGAEVDTYESCNFDVNRNFLFAGDWMKPYHKNVINLLEQGLPVLIYAGDKDFICNWLGNQAWSNELPWSGHDEFESAELYNLTLKDGTKVGEVKNAGKFTFARMFDGGHMVPYDQPESSLAMVNRWIAGDYSLGTKK

SEQ ID NO: 14408 - protein, 221 aa, Arabidopsis thaliana
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 14409 - protein, 268 aa, Unknown
  Fischerella sp. AEA-2001/1
QPNAMGGREAGGLAHLLPGYRLVKNPQHRAEVEEIWGLKRGQISPNPGLTAWDMITGLEDGNVGLLWIAATNPAVSMPDLERTKAALMRSPFTIYQDAYYPTETATYAHVLLPAAQWSEKTGVMTNSERRVTLCPAFRRPPGQAEPDWEIFAEVGRRLGFVGEFAFANSAEVFAEFVKLTCDRPCEMTGLSHEQLQPQGPTQWPHPDKEIEKRGNGESKRLYTDLRFHTPDGRARFGAYHSRGLAEPPDPDYPFVLTNGRLYGHWHTL

SEQ ID NO: 14410 - protein, 997 aa, Photobacterium profundum
MLLSGQWTFNFFNNPMLVPDEFYNQEMSEWDSIQVPNMWQMEGHGKLQYTDEGFPFPIDVPFVPTNNPTGAYQRTFTLGDGWDKQQTIIKFDGVETYFEVYVNGQYVGFSKGSRLTAEFDISEQVKVGKNLLSVRVMQWADSTYIEDQDMWWTAGIFRDVYLVGKKPVHVYDYTIRTDFDAQYQSATLSGSVVIENLQTAQASGFQLEYALYDGNQLISDGSVDNLAIEECHTATFAIDVTNPVHWTAENPHLYHLFLTLKDHAGTIIEIIPQRVGFRDIKVKDGLFYINNQYTMLHGVNRHDNDHLNGRAAGIDRVEKDLILMKQHNINSVRTAHYPNDPRFYEMCDIYGLFVMAETDVETHGFANVGDLSRITDDAEWENVFVDRIERQIHAQKNHPSIIMWSLGNESGYGCNIRAMCKAAKAIDDTRLVHYEEDRNAEVVDIVSTMYSRVQLMNYFGEQPMDKPRIICEYAHAMGNGPGGLTEYQNVFYKHNHIQGHFLWEWCDHGILEQDEKGRDVYKYGGDYGDYPNNYNFCMDGLVYSDQTPGPGLREYKQVICPVKVSVKDAENGLITVENKYWFSTLDDITLLVDIRAEGETLAQYQLSATNVKVGESCDLQVALPELDEREVFINVSVRKNSSTRYSVANSELGIFQFQIKENTAQLPTFTHTNSTALNVQEQRLEWIVEGYNFELTFSKISGQLTSWLSNGIEIIASSPKMNFFKPMIDNHKQEYEGLWEPAHLQIIEEHFRTLEVEQQNGCVIVTVNSIVAPPVLDFGMRCTYIYEIHSEGQVNLSLTGKKYGEYPHVIPVLGLDMGINNQFEQVEYYGRGPEENYLDSKQCNIIDVYQSTVTKMFENYPFPQNNGNRQDVRWASLVNRQGNGLFVKPEQPINLSAWHYTSEHLHEAQHINELEKSGYITLNLDHKLMGLGSNSWGSEVLDSYRVYMNDFQYALTLVPFSQANCRANYLAGQDFSLKTQTDQNIQENTPSMIGGDK

SEQ ID NO: 14411 - protein, 273 aa, Klebsiella pneumoniae
QPNAMGGREVGGLANMLAAHLDLDNEDHVQAVQTYWNAPLMPAQQGLKAVDLFNAVEQGKVKFIWIMGTNPVVSMPNRLQVKRALRKCDMVVVSDIVASNDTLNFAHVALPATGWSEKNGTVTNSERRISRQRGILAAPGEAKHDWQIMCEVAKAMGFANAFSFSHPAQIFSEYAGLTAYQNNGKRLLNLSPLQGLSEAQYDELSPIQWPIRHAFEQGNELVSLRLSPINKFSTANGKAPVSTRKNLTHRCNLPNAAYPFIVNSGRVRDQWHT

SEQ ID NO: 14412 - protein, 174 aa, Spiroplasma kunkelii
MQIDKLELYLPEDKIQNKIKDYAEKLNKLYEGKTLYCIGLLNGALFFMSDLLKQLKIQIVIDTMSISSYIGTHSTNKLTIHKNISKDITGQDVLLIEDLIDTGKTLSAVIEQIQAKKPNSLQVVCLADKIAMHPNFNYPYDALFIVPNEFIVGYGFDYNDQFRQLPNVYIWRGE

SEQ ID NO: 14413 - protein, 172 aa, Glycine max
  misc_feature (81)..(81): Xaa can be any naturally occurring amino acid
  misc_feature (86)..(86): Xaa can be any naturally occurring amino acid
  misc_feature (111)..(111): Xaa can be any naturally occurring amino acid
  misc_feature (119)..(119): Xaa can be any naturally occurring amino acid
  misc_feature (130)..(130): Xaa can be any naturally occurring amino acid
  misc_feature (140)..(140): Xaa can be any naturally occurring amino acid
  misc_feature (155)..(155): Xaa can be any naturally occurring amino acid
MASSMISSPAVTTDNRAGAGMVAPFTGLKSMAGFPTRKTNNDITFLACNGGRVQCMHVWPPVGKKKFETLSYLPDLDDAQXAKEVXYLLKKGWIPRLEFEFGAPVFVYREXHNRSPRYXMDAYWNLWKAXPMLGATESSXGVKGTSEAKNAYPNXGFIRIIGFETVAQGEGI

SEQ ID NO: 14414 - protein, 861 aa, Nicotiana tabacum
MMMVGKLFSLLHFFTLFCLFTVTFASTKEATALLKWKATLQNQSNSLLVSWTPSSKACKSWYGVVCFNGRVSKLDIPYAGVIGTLNNFPFSSLPFLEYIDLSMNQLFGSIPPEIGKLTNLVYLDLSFNQISGTIPPQIGSLAKLQTLHILDNHLNGSIPGEIGHLRSLTELDLSINTLNGSIPPSLGNLHNLSLLCLYKNNISGFIPEEIGYLSSLIQLDLNTNFLNGSIPASLENLHNLSLLYLYENQLSGSIPDEIGQLRTLTDIRLNTNFLTGSIPASLGNLTSLSILQLEHNQLSGSIPEEIGYLRTLAVLSLYTNFLNGSIPISLGNLTSLSSLSLYENHLSGPIPSSLGNLDNLVYLYLYANQLSGPIPSELGNLKNLNYMKLHDNQLNGSIPASFGNLRNMQYLFLESNNLTGEIPLSICNLMSLKVLSLGRNSLKGDILQCLINISRLQVLKIPDNNLSEEIPSSICNLTSLRILDLSRNNLKGSIPQCFGDMGGHLEVLDIHKNGISGTLPTTFRIGSVLRSFTLHENELEGKIPRSLANCKELQVLDLGDNLLNDTFPMWLGTLPKLQVLRLKSNKLYGSIRTSKDENMFLELRIINLSYNAFTGNIPTSLFQQLKAMRKIDQTVKEPTYLGKFGADIREYNYSVTVTTKGLELKLVRILTVYIIIDLSSNRFEGHVPSIMGELIALRVLNLSRNGLQGHIPPSLGNLFVIESLDLSFNQLSGEIPQQIASQLTSLAVLNLSYNHLQGCIPQGPQFHTFENNSYEGNDGLRGFPISKGCGNDRVSETNNTVSTLDDQESTSEFLNDFWKAALMGYGSGLCIGLSILYFMISTGKLKWLSRITEWLQNRFII

SEQ ID NO: 14415 - protein, 267 aa, Unknown
  uncultured marine bacterium
QPNAMGGREVGGLANQLAAHMGFSAEETDRVQRFWQSPRIARQPGLNAVALFQAIAAGQVKAVWIMGTNPAVSLPDADAVRQALKQCPLVVVSDVMAMTDTAELAHIRLPALAWGEKEGSVTNSERCISRQRAFLSPPGQARADWWILSQVAQRMGYGEAFGYQHPSEISSEHAALSAFENNGTRAFDIGPLAGRDKQQWLGMTPVQWPVNEQHPAGCLRLFGDKRFFHADGKARLLPVTPRLPQNAVSQRYPLVLNTGRIRDQWHT

SEQ ID NO: 14416 - protein, 209 aa, Colwellia psychrerythraea
MANKKHKASSQRWLDEHFDDEYVKKAQRLGLRSRAVFKLEEINIKDRLIKPGMKVVDLGAAPGGWSEYAVKVVGDKGQVVACDILPMDAIVGVDFLEGDFREEEVLDALLTRINGKNIDVVMSDMAANMTGNESADSARSMYLVELALDMCSQVLKPNGAFVVKVFQGAGFEDYMKATRAVFKAVKTRKPESSRARSREVYLVATGYKG

SEQ ID NO: 14417 - protein, 559 aa, Candida albicans
MSSLQQPIPPNSTLATTASSNQSGSNDFVKKLFLMLQEDSYKEVVRWTVKGDSFVVINTNEFTKDILPKHFKHSNFASFVRQLNKYDFHKVKISNEAKASYPYGEDAWEFKHPEFRINDAEALENIKRKGPTAKKSASNVTIKTEANNNGTQPTCNHNYSQLVSATNHLKEQVESLKNDKHSLYQEISVLERKYKTVVENIVAINTFNERYYRSMNVLINSIVQNGMKLPPLDFPPPVQLGPDSGIGSNLGPISSDTALPSISHHLSSPLPHHQQLLNRTIRPISSPIDGIPLVKLQQQSLGQNLQAPIGTPSAVPFSEEASSSIQAATPAPLAQPVAQPINQPPPPPPPPATQQQPLPPPPPPATATSQIPSAPPPPTQQQVGTSSSSVPTISPKSQGIVVSNSASPTTSAQISTTSVPNPKFHVLLVEDDNVCIQLCRKFLVKYGCSVTVVTDGLNAISTVEHTKYDLVLMDIVMPNLDGATATSVIRSFDTKTPIIAMTGNIEDNDLVTYLQNGMSDILAKPFTKDDLYAILSKHLLDPKENKQDNEPTVKKQKLS

SEQ ID NO: 14418 - protein, 98 aa, Arabidopsis thaliana
  misc_feature (18)..(18): Xaa can be any naturally occurring amino acid
  misc_feature (29)..(29): Xaa can be any naturally occurring amino acid
  misc_feature (42)..(42): Xaa can be any naturally occurring amino acid
  misc_feature (82)..(83): Xaa can be any naturally occurring amino acid
  misc_feature (85)..(85): Xaa can be any naturally occurring amino acid
  misc_feature (87)..(88): Xaa can be any naturally occurring amino acid
  misc_feature (92)..(92): Xaa can be any naturally occurring amino acid
PLQSEQLASVSLPATMVXSPAQATMVAPXNGLKSSAAFPATXKANNDITSITSNGGRVNCMQVWPPIGKKKFETLSYLPDLXXSXFXXREVXYLIRNK

SEQ ID NO: 14419 - protein, 273 aa, Unknown
  uncultured marine bacterium
QPNAMGGREAGGLCNILPGYRLVNNPQHRAEVEQFWGVRPGTIQPQRGRTAWEMIQGLETGEVGFLWIAATNPAVSMPDLKRTQAALKRSPFTVYQDAYYPTETAAYAHILLPAAQWSEKTGVMTNSERVVNLCPQFRDPPGVARADWEIFAEVGQRLGFEKQFSFPNSAQVYAEFVKITEGRPCDSSGLSYEKLRRYGPLQWPYADTWPYLEGEELDRQNRTNMRLYTDFCFNTPDGRARFGAYHSRGLAEPSDQAYPFVLTTGRLYGHWHT

SEQ ID NO: 14420 - protein, 356 aa, Glycine max
MSLLSDLINLNLSDTTEKVIAEYIWIGGSGMDLRSKARTLPGPVSDPSELPKWNYDGSSTGQAPGEDSEVILYPQAIFRDPFRRGNNILVICDAYTPAGEPIPTNKRHAAAKVFSHPDVVAEVPWYGIEQEYTLLQKDIQWPLGWPVGGFPGPQGPYYCGVGADKAFGRDIVDAHYKACIYAGINISGINGEVMPGQWEFQVGPSVGISAGDEIWAARYILERITEIAGVVVSFDPKPIKGDWNGAGAHTNYSTKSMREDGGYEVIKAAIDKLGKKHKEHIAAYGEGNERRLTGRHETADINTFLWGVANRGASVRVGRDTEKAGKGYFEDRRPASNMDPYVVTSMIADTTILWKP

SEQ ID NO: 14421 - protein, 371 aa, Unknown
  Nocardioides sp. JS614
MSLRHEVTEAKRIVVKIGSSSLTTAAGGIDPGRVRDLVDVLAKLRAGGSEVVLVSSGAIAAGLAPLGLRRRPRSLPAQQAAASVGQGLLVHRYNEELARHGVVAGQVLLTVDDVTRRSHYRNAYQTFAKLLELGVLPIVNENDTVATSEIRFGDNDRLAALVAHLVHADLLVLLSDVEGLYDADPAAPGSSMLPDVVSVHDLADVRIGKAGAAGLGTGGMHTKIDAARIATGAGIPVVLTSAERAPAALLGEPVGTLFHATGRRRPTRLLWLAHATEPKGTLLLDAGAVRAVVERRASLLAAGITGVEGTFHAGDPVDIAAPDGTPVARGLVNFDAEELPNLLGRSSHELKRELGAGYEREVVHRDDLVLL

SEQ ID NO: 14422 - protein, 286 aa, Pseudomonas aeruginosa
MSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKEFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTHEGLRRLPLETLRQRFRDSGIATRYYNADIHLGAFALPQYVLQAIGKQDND

SEQ ID NO: 14423 - protein, 857 aa, Brassica oleracea
MKGVRNIYHHSYTSILLVFVVMILFHPAFSIYINTLSSADSLTISSNRTLVSPGNIFELGFFRTTSSSRWYLGMWYKKLSDRTYVWVANRDNPLSNSIGTLKISGNNLVILGDSNKSVWSTNITRGNERSPVVAELLANGNFVMRDSNNNDGSGFLWQSFDYPTDTLLPEMKLGYDLITGLNRFLTSSRSLDDPSSGDYSYKFESRRLPEFYLLKGSGFRVHRSGPWNGVQFSGMPEDQKLSYMVYNFTQNSEEVVYTFRMTNNSIYSRLTISSEGYLERLTWTPSSGMWNVFWSSPVDLQCDVYKICGPYSYCDVNTSPVCNCIQGFNPLNVHQWDLRDGTSGCIRRTRLSCSGDGFTRMKNKKLPETTMAIVDHSIGLKECKKWCLSDCNCTAFANTDIRNGGTGCVIWTERLEDIRTYFTDGQDLYVRLAAADLVKKRNANGKIASLIVGASVLLLLIMFCLWKRKQNRVKASAISIANRQRNKNLPMNGMVLSSKKQLRRGNKTEELELPLIELEAVVKATENFSNCNKLGEGGFGIVYKGRLLDGQEIAVKRLSKTSVQGTDEFMNEVTLIARLQHINLVQIFGCCIQADEKMLIYEYLENSSLDSYLFGKTRSSKLNWKERFEITNGVARGLLYLHQDSRFRIIHRDLKVSNILLDKNMIPKISDFGMARIFAREETEANTMKVVGTYGYMSPEYAMHGIFSEKSDVFSFGVIVLEIVTGKRNRVFYNLNYEDNLLNYAWNNWKEGRALEIVDPAILDSLSSLPSTFQPQDVLKCIQIGLLCVQDLAENRPTMSSVVWMLGSEATEIPQPKPPGYCLVRSPYEPDPSSNRQREDDESWTVNQYTCSVIDAR

SEQ ID NO: 14424 - protein, 1070 aa, Unknown
  Nocardioides sp. JS614
MPDDLQAGAEPTTDAPEQAPTAEKPAAKKATARKTAAKRTAKKAAAAEPADTLVDAPLLDAPADAGGDAAVEAPAKKTAAKKTAAKKAAAKKAPAKAVAKKSAAKKAAAEPVPAEEAPTPPHGDPLAQPTTEQAGPAAPAVLFQAPESTKPAKKTAKKAAAKKAPAKKAAATAPDEDQAAADSAETAEESARPAKKTAAKKTAAKKTAAKKGGGRKADGSSDQPETATEDEDDETTQPEDAESAETGGEGTGRRRRRRGGRRRRKAGDGDSGSGDAAHAGPGEDAEDASDRSDAAAAEDSGPESGGESGGESSSRRRRRRRRSGEDGGASAEDPEGTVTRVRSRRSAEDEITAVSGSTRLEAKKQRRREGREAGRRRAPIVSEAEFLARRESVDRVMVVRQREDLTQIGVLEDRVLVEHYVARESQTSLIGNVYLGRVQNVLPSMEAAFIDIGKGRNAVLYAGEVNWSALGHKDGQPRKIESVLSSGQSVLVQVTKDPIGHKGARLTSQISLAGRFLVYVPDGTTSGISRKLPDTERTRLKALLKEIVPDSAGVIVRTAAEGASEEELTRDVERLKARWEDIEGKAKGSAPQLLYGEPDLTLKVVRDLFTEDFSKLVIQGEDAWDTVQGYVHHVAPDLEARLERYDPGADGAGGKADVFAEYRIDEQIAKGLDRKVWLPSGGSLIIDRTEAMTVVDVNTGKFTGSGGNLEETVTKNNLEAAEEIVRQLRLRDIGGIIVVDFIDMVLESNRDLVLRRLVECLGRDRTRHQVAEVTSLGLVQMTRKRIGTGLLEAFSETCEHCQGRGVLVHEAPVEPRRAEDDSRRGSGRRGRGGRGRGSDQDAAASAPQKAPSPKDVAAMARPDSADLSTEAATDAATEAAVPEVDEVPPVAAEETPERPTDQPVEAAAPVETPPEPETPAEPEPPKVVTRSRRRSASRPAGTPTTATTATAPAAEPVAEPVVAEPVVAEPAEEAVPEAVGEPVPDPVPEPPKVVTRTRRRSASRPAGPPVTEAPASPASPVAETPPPGAIGSVGVPPVSGVVEPGTAEAETDDVPAIEHVPIKKKGSRKR

SEQ ID NO: 14425 - protein, 397 aa, Pseudomonas fluorescens
MGLNEFGEAQEGFAERPQEYEELMAKRDYYEVLGVERGSSEADLKKAYRRLAMKHHPDRNPGDKASEDLFKEANEAYEVLSDSSKRAAYDQYGHAGVDPSMGGGGAGFGGQNFSDIFGDVFSDFFGGGRGGSRGGAQRGSDLRYTLELNLEEAVRGTTVNIRVPTLVNCKPCDGSGAKKGSSPSTCPTCGGIGQVRMQQGFFSVQQTCPRCHGQGKIISDPCDSCHGDGRVEEYKTLSVKVPAGVDTGDRIRLSGEGEAGTQGGPTGDLYVVINVREHDIFQRDGKHLFCEVPISFVDAALGGELEIPTLDGRVKLKIPEGTQTGKQFRVRGKGVAPVRGGGAGDLMCRVAVETPVNLTRRQRELLEEFRSSLADDNSHSPKTTGWFDGVKRFFGDL

SEQ ID NO: 14426 - protein, 325 aa, Staphylococcus aureus
MSVDKYGKVYLIGAGPGNPNYLTKKAERLIREADVILYDRLVNPLILQYANLTTEIIDVGKKPYAKHIQQEKINECIVEAARRYNKVVRLKGGDPAIFGRVQEEVDTLNNFNIAFEIVPGVTSASAAVATMQTGLTMRAVAKSVTFSTGHFKDSEENEVDVNALVNGGTLAIYMGVKRLGKIIAQIQQYTDIDYPIAIVFQASCFNEFVVKGRLSNIVGKLEHYAIEAKPGICIIGEVVGYTENVSTTSNPTQQFYVVSGSRHDALMLCEHLYDEGYGCLLNPNDTSNGTYHSSQYDYYDAFIKQQENVTYISTDRADANTVLCH

SEQ ID NO: 14427 - protein, 490 aa, Lilium longiflorum
MLSLKIVILGLLVAISDAVAIPANINYKDALSKSIIFFEGQRSGKLPPNQTLTWRANSALSDGAADNVDLTGGYYDAGDNVKFGFPMAFSVTMLSWSVIEFGKLIPADIDKAREAIRWGTDYLLKACSALPDAIYVQVGDPTSEHQCWERPENMSTQRSVYKITPSNPGSDVAGETAAALAAASLVFHKIDHKYAKTLRETAKKAFTFAESHRGSYSDSLSSAVCPYYCSYSGFQDELLWAAGWLYKATHNASYLNFAQSLNVDSNADTFSWDNKFPGADILLAQDFIINKNQAASSYKQQAEKFLCTVLPNSPTLSAKYTAGGLLYKMTPSNLQYVTSTSFLLGVYAKYLRISRRTFSCGNMVVTPSVLIRLVEKQIGYILGHNPQALSYMVDFGNNFPLHIHHRGSSIPSVHADAQAIGCDEGFQYYNTSNPNPNILTGAVVGGPDENDSFADDRDNYSQSEPATYINAPLVGTLAFLAGDQVLGKLF

SEQ ID NO: 14428 - protein, 389 aa, Mycobacterium leprae
MAQREWVEKDFYKELGVSSDASPEEINRAYRKLARYLHPDANPDNSSGERFKVVSEAHNVLSDPVKRKEYDETRRLFAGGCLGGRRFDSSFGDFGMGGDGAEFNLNDLFDAASRTGGTNIGDLFGGLFGRGASVRPSSRRGNDLETEADLDFVEAAKGVAMPLRLTSPAPCTNCHGSGARPGISPKVCSTCNGSGVINRNQGAFGFSEPCTECRGSGSIIEHLREECKGTGVTTRTRTINVRIPSGVEDGQRIRLAGQGEAGLRGAPSGDLYVTVHVRPDKIFGRNGDDLTVTIPVSFTELALGSTLSVPTLDGTVGVRVPKGTSDGRILRVRGRGVPKRSGGHGDLLATVKVAVPLNLEGAAQKALEAYAAAERQVVSTLGRDGAGNR

SEQ ID NO: 14429 - protein, 459 aa, Pseudomonas putida
MTLRVAIIGAGPSGLAQLRAFQSAHAQGAPMPEIVCFEKQADWGGMWNYTWRTGLDQHGEPVHGSMYRYLWSNGPKECLEFADYSFDEHFGRPISSYPPREVLWDYIQGRVKKAGVRDYIRFNTVVKNVSFNERTREFTVSAHDYSVGVGIEQVFDFVVVASGHFSTPHVPEFEGFERFTGRILHAHDFREAVEFKGQDLLIVGSSYSAEDIGSQCYKYGARSITTAYRTQPMGYKWPKGWEERPQLVRVENDLAFFADGSSKRVDAIILCTGYQHHFPFLPDELTLKTNNRLWPAGLYQGVVWEQNPQLLYLGMQDLWYSFNLFDAQAWFARDYMMGRIKLPSRAGMQADSQRWREDEEGLETTASMYEFQGRYIKHLIEQTDYPRFDIDAVNRIFLQWKQDKKHDIMGYRDKSYRSVLTGTKAVPHHTRWMQAMDDSLQEYLRETDGKKGEVKALRG

SEQ ID NO: 14430 - protein, 491 aa, Pasteurella multocida
MDSVELLVNVTPSETRIALVDMGILKEVHIERQAKRGIVGNIYKGRVTRVLPGMQSAFVDIGLEKAAFLHASDIVSHTECVEESEQKQFVVKDIAELVREGQDIVVQVVKDPLGTKGARLTTDITLPSRYLVFMPENSHVGVSQRIESEEERARLKELVLPLCDELGGFIIRTAADGATEEELKQDADFLKRLWRKVLERRAKYPTKSMLYGELALTQRILRDFIGAGLEKIRIDSKLCFTEVKQFTEEFMPTLVDKLVLYSGNQPLFDVYGVEAAIQTALNKRVNLKSGGYLIIEQTEAMTTIDINTGAFVGHRNLEETIFNTNIEATKAIAQQLQLRNLGGIIIIDFIDMQTDDHRVRVLESLQEALSKDRVKTSVNGFTQLGLVEMTRKRTRESLEHVLCGDCPACEGRGRIKTVETVCYEIMREIIRVHHLFASEQFVVYASRAVADYLINEESHGLLAELEVFIGKQVQIKTEVYYNQEQFDVVVM

SEQ ID NO: 14431 - protein, 431 aa, Chorispora bungeana
HRFDGDGMVHAVKFEDGSASYACRFTQTNRFVQERELGRPVFPKAIGELHGHTGIARLMLFYARAAAGIVEPGQGTGVANAGLVYFNGRLLAMSEDDLPYQVRITPGGDLKTVGRFDFDGQLESTMIAHPKVDPESGELFALSYDVVSKPYLKYFRFSPDGKKSPDVEIQLDQPTMMHDFAITEKFVVVPDQQVVFKLPEMFRGGSPVVYDKNKVSRFGILDKYAEDSSNIKWIDVPDCFCFHLWNAWEEPETEEIVVIGSCMTPPDSIFNESDENLKSVLSEIRLNLKTGESNRRPIISDEDKQVNPEAGMVNRNMLGRKTKFAYLALAEPWPKVSGFAKVDLSTGEVKKHLYGENRYGGEPLFLPGDNEGGEDDGYILCFVHDEKTWKSELQIVNAVSLEVEATVKLPSRVPYGFHGTFIGASDLAKQV

SEQ ID NO: 14432 - protein, 201 aa, Anaplasma marginale
MLAKKHGYRSRSAYKLIDIDCKFKLLQRGRYVLDLGSCPGGWAQVAAERVAEGGKAHVVAVDMAPMERIPNVDFVQCDVEHSPELLRAALQDRKFDVVLSDMAPKSCGHRQVDHANIINLCEMALDLAVEFLRSGGSFVTKILQGEYEQEFRRSLQYYFASVTYFKPKSSRSESSEIYLVGTKFKNPEHPYGNSEDAPSEC

SEQ ID NO: 14433 - protein, 345 aa, Cryptococcus neoformans
MSTPAYLTKLESIPKEKFLFGPSPISYLPNLTAVLGGKVKLYAKREDCNSGLAYGGNKVRKLEYLVADAKAKGCNTLVSVGGVQSNHTRAVTAVAVASGLKAVTVQEKWVPIDPPLYSETGNILLSRLMGGDVRLNQETFDIRHKKATEDAFKDVEAKGGKPYYIPAGASDHPLGGLGFTNWVVELAKQEKELGVFFDVVIVCSVTGSSHAGTVVGAVAEGRKRKIIGIDASGKPEATRNQVLKIARNTAALLDERLEIKEEDVILDDRFHAGIYGIPDDETIAAMKLAAQTDAFITDPVYEGKSMAGMIRLVKEGAIKEGSNVLYIHLGGQPALNAYSSYFPHA

SEQ ID NO: 14434 - protein, 87 aa, Oryza sativa
  misc_feature (56)..(56): Xaa can be any naturally occurring amino acid
  misc_feature (62)..(62): Xaa can be any naturally occurring amino acid
  misc_feature (70)..(70): Xaa can be any naturally occurring amino acid
  misc_feature (75)..(75): Xaa can be any naturally occurring amino acid
  misc_feature (77)..(77): Xaa can be any naturally occurring amino acid
MALLPGFLEQRDRGRDRSIDIVRGPVRCYRQIKNKPYPKSRYCRGVPDPKIRIFDXVGQKKXRRDEFPLXVQLVXAXEKENVLSEGL

SEQ ID NO: 14435 - protein, 209 aa, Pseudomonas fluorescens
MARSKTSLGWLKRHVNDPYVKQAQKDGYRSRASYKLLEIQEKYKLIRPGMNVVDLGAAPGGWSQVTSRLIGGQGRLIASDILEMDSIPDVTFIQGDFTEDAVLAQILEAVGNSQVDLVISDMAPNMSGTPEVDMPKAMFLCELALDLAERILKPGGNFVIKIFQGEGFDTYLKDARKKFDKIQMIKPDSSRGSSREQYMLAWGYRGRSE

SEQ ID NO: 14436 - protein, 619 aa, Flavobacteria bacterium
MAEDNKKVAEVSTEETQAHTAPTATAQQTNPTEFLDTFDWERYSEGIEKVDEDQLKAFEKLVEDNFVDTIDNDVMTGVVIKITDRDAIIDINAKSEGVISLNEFRYNPNLKEGDKVEVLVDVREDATGQLVLSHRKARLIKAWERVNNAHDTGEIVNGYVKCRTKGGMIVDVFGIEAFLPGSQIDVKPIRDYDAYVDKTMEFKVVKINHEFKNVVVSHKALIEADIEEQKKEIISRLEKGQVLEGVVKNITSYGVFVDLGGVDGLVHITDLSWSRINHPNEVVELDQTLNVVILDFDEDKSRIQLGLKQLEPHPWEALSDKIKPGDNVKGKVVVIADYGAFVEIEEGVEGLIHVSEMSWSTHLRSAGDFVKVGDTVDAQVLTIDREDRKMSLGMKQLHPDPWTDITTKYPVGSRHTGVVRNFTNFGVFVELEEGVDGLIYISDLSWTKKIKHPSEFCAVGDKLDIVVLELDVEGRKLSLGHKQTMDNPWDKYEAEFGIGTTHDVTITDMVDKGAVVEFNEDITAFIPTRHLEKEDGTKLKKGESAQIQIIEFNKEFKRVVASHMVIHKEEEAKIVKQAAAKSQESTDKPTLGDANSKLQALKDRMEGKVAAPAASTEEE

SEQ ID NO: 14437 - protein, 996 aa, Lactococcus lactis
MMTMIDVLERKDWENPVVSNWNRLPMHTPMDFLEKQSLNGLWNFDHFSRISDVPKNWLELTESKTEIIVPSNWQIEFKDKSDVPIYTNVTYPIPIQPPYVPEANPVGAYSRYFDITKEWLESGHVHLTFEGVGSAFHFWLNGEYGGYSEDSRLPAEFDISNLAKEGQNCLKVLVFRWSKGTYFEDQDMWRMSGIFRSVNLQWLPDNYLLDFSIKTDLDEDLDFANVKLQAYAKNMDDACLEFKLYDDEQLIGECHGFDAEIGVVNPKLWSDEIPYLYRLELTLMDRSGAVFHKETKKIGIRKIAIEKGQLKINGKALLVRGVNKHEFTPEHGYVVSEEVMIKDIKLMKEHNFNAVRCSHYPNDSRWYELCDEYGLYVMDEANIETHGMTPMNRLTNDPTYLPLMSERVTRMVMRDRNHPSIIIWSLGNESGYGSNHQALYDWCKSFDSSRPVHYEGGDDASRGATDATDIICPMYARVDSPSINAPYSLKTWMGVAGENRPLILCEYAHDMGNSLGGFGKYWQAFREIDRLQGGFIWDWVDQGLLKDGNYAYGGDFGDKPNDRQFSLNGLVFPNRQAKPALREAKYWQQYYQFELEKTPLGQVFAFTVTNEYLFRSTDNEKLCYQLTNGLEVLSQNELILNMPAGGSMRIDLSELPIDGTDNLFLNIQVKTIEKYNLLESDFEVAHQQFVLQEKINFTDKIDSNEEITLLEDEELLTVRSAKQKFIFNKSNGNLSRWLDEKGNEKLLHELSEQFTRAPLDNDIGVSEVEHIDPNAWLERWKAVGFYELKTLLKNMIIQATENEVIISVQTDYEAKGKIAFSTIREYHIFRNGELLLKVDFKRNIEFPEPARIGLSLQLAEKAENVTYFGLGPDENYPDRRGASLFGQWNLRITDMTTPYIFPSENGLRMETRELNYGRLKVRAMGQSFAFNLSPYSQNQLAKKGHWHLLEEEAGTWLNIDGFHMGVGGDDSWSPSVAQEYLLTKGNYHYEVSFKLT

SEQ ID NO: 14438 - protein, 567 aa, Photobacterium profundum
MTKILIVGGVAGGASAAARARRLSEDAEIIMFERGEFVSFANCGLPYHIGGDIQDRSKLLLQTPESFLARFNVDVRVMNEVVNINRNEKTVTVKNLLDGNEYTERYDFLLLSPGAGPIVPPIPGVKNPLTYSLRNIPDMDRILQTIETNNVEHATVVGGGFIGLEMMEAFHQRGIKTTLLELADQVMTPVDKEMAGFAHAEIRDHGIDLRLGIALSGVEYVPETHIASFESGESTEHQHISGHLNLSLSNSESLETDLLIMAIGVRPETTLASEAGLKIGELGGIWTTPSMQTSDPAIYAVGDAIEEADFVTGNQTIVPLAGPANRQGRMAADNMLGRNESYQGTQGTAICKIFDLAIAATGKNEKQLKRDGVDYEKVYVHTASHASYYPGAEIVSFKMLFDPKSGKIFGAQAAGKDGVDKRIDIMAVAQRAGMTVEQLQHLELTYAPPYGSAKDVINQAAFVANNIIKGDATPIHFDEIDNLTDDQVLLDVRNPGELENGGYIEGTLNIPVDELRQRMHELPKDKEIVIYCQVGLRGNVAYRQLVNNGFKARNLIGGYRTYKFAKM

SEQ ID NO: 14439 - protein, 466 aa, Myxococcus xanthus
MQVVSVKKALAGGVEEGTKVEVRGWVRTRRDSKAGISFVNVSDGSTFDPIQVVAPNSLPNYEKEILHLTAGCSVISRGTLVKSQGKGQAYEVQADEVQVLGFVDDPDTYPIQPKQHTLEFLRDVAHLRVRTNTFSAVTRVRHRAAQAVHRFFDEEGFFWVNTPIITASDAEGAGQMFRVSTLDAVNPPRTSDGKIDWHKDFFGKEAYLTVSGQLNAEAYALAMSKVYTFGPTFRAENSNTTRHLAEFWMIEPEVAFADLNEDANLAERFLKHVFKAVLNDCAPDLKFFEERVQKGVIERMEKFINSSFERIDYTEAVEILKKAKKKFEFEPEWGKDLQTEHERYLTEEHVGRPVVVMNYPEAIKSFYMRLNDDGKTVAAMDVLAPGIGEIIGGSQREERLDVLDQRIQKFGLKPESYQWYRDLRRYGSVPHAGFGLGFERLIVYMCGLQNIRDAIPYPRVPGSAAF

SEQ ID NO: 14440 - protein, 174 aa, Nocardia farcinica
MTLPAFHCPTPSDMRRSMGRFTTGVAIVSADDGTGNPCAMTISSLTSVSLEPPILLVSLTHGSRTTDAVEAGGRFAVSILGSRQEAIARRFATRGGARFEGLPVDLSRSGLPLIPDALAQLECRVHSAHDVGDHRVFYGEVVDMRWRDGTGLAFYSGRFGDFHDFGHDELPWLY

SEQ ID NO: 14441 - protein, 316 aa, Unknown
  Rhodococcus sp. RHA1
MTALDNRHFGFGDIPDQWGRTVLVTGANNGLGLHAATALAGAGATVLLACRNPQTGAAALTRIRKAGSDAEHHLIPLDLTDLASVRDAAQHACGVAPRIDVLINNAGLMAVPFGRTADGFELQIGTNHFGHFALTGQLLPALLGAPAPRVVTLASIAHRRGRIVLDDLNFDRRKYTRMGAYNQSKLANLLFSGELARRSAAAGLPLLSVATHPGIAATNLFDSMAPPIPGALAVTHLGLRMVGNDEKDGALGQLYAATMPDVRTDDYLGPNELFGVRGPVARSPRTGGARNTKLAAALWEKSVELTGVEYTQLVRA

SEQ ID NO: 14442 - protein, 426 aa, Solibacter usitatus
MTESQRMSRTLAEVDPEIYQAIQHETARQDGQLELIASENFTSEAVLEATGSVFTNKYAEGYPGKRYYGGCEYTDVVENLARERASKLFGAEYVNVQPHSGSQANQAAYGAVVSPGDTVMGLNLAHGGHLTHGHALNFSGKTYKIVPYNVRKEDELIDYDEVEKLAREHQPKMIIAGASAYPRIIDFARFRKIADAVGAVFLVDMAHISGLVAAGVHPNPCEFADIVTSTTHKTLRGPRAGIILAREKYGKEIDKNVFPGTQGGPLVHVMAAKAVCFLEALQPEFAVYQRQVVANAKALAQSLIDAGFRVVSGGTDTHVVLLDVFSKGLRGKESEQALDRARITVNKNAIPFDTNPPMNPSGIRLGSPAVTTRGFKEAEMREVGTLIAEVLTNIANEDVIAGVRQKVQALTTRFPLYSWKRDTVQA

SEQ ID NO: 14443 - protein, 287 aa, Photobacterium profundum
MATINTVSKLNQVVNQKRDNTQLGKVVLVGAGPGDPDLLTVKALRLIQQADVIVYDRLVSNDIVALAPESTELVFVGKRAGHHCVPQEGINQILVEHALKGKLVVRLKGGDPFIFGRGGEELEALLPHQVPFEVVPGITAAAGCAAYAGIPLTHRDHAQSVQFITGHLKSEKEHIDWASLARSNHTLVFYMGLSQSGEIRRRLEANGMSPSTPVAIVERGTSKQQRVLPCSLQTLDIIAEHAESPALIIIGSVTQLTHKLSWFAPEKSIHDEYSEMRVAPIAKVAGL

SEQ ID NO: 14444 - protein, 684 aa, Methanobacterium formicicum
MDIKYVPTICPYCGVGCGMNLVVKDEKVVGVEPWKRHPVNEGKLCPKGNFCYEIIHREDRLTTPLIKENGEFREATWDEAYDLIASKLGAYDPNEIGFFCCARSPNENIYVNQKFARIVVGTHNIDHCARLCHGPTVAGLAASFGSGAMTNSYASFEDADLIFSIGANSLEAHPLVGRKLMRAKMNGAYFIVADPRYTPTAKQADQYIPFKTGTDVALMNAMMNVIISEGLEDKEFIEKRTKNYEELKEVVSKYTPEMAEEITQVPADVIRDIAIKYAKADKAAIVYSLGITEHSHGVDNVMQTANLAMLTGNIGRLGTGVNPLRGQNNVQGACDMGALPTDYPGYRKVADQEVMEDVTCTWGCSDLGCEPGLKIPEMIDAAAKGDLKVLYITGEDPVISDPDTHHVEEALNNLDFFVVQDIFMTDTAEFADVVLPAACWAEQEGTFTNGERRVQLIRKAVDAPGESKYDWEIFCDLAKKMGADPEMFTYESAQDIFEEVRTVTPQYAGMNRERLDRPEALHWPCPSEDHPGTAMMHIEKFAHPDGLGIFMPLEEQGPMETPDDEYPLILTTTRLLFHYHAAMTRRAATLDREVPTGYVEINTEDAAELGIANKEKVKVKSRRGEIEIAARVTDDIVKGIVNIPMHFRECSANILTNAAAIDPKSGMPEYKACAVAISKMEGSK

SEQ ID NO: 14445 - protein, 268 aa, Leptolyngbya boryana
QPNAMGGREAGGLSHLLPGYRSVTNPGHRAELETFWQLPTGSISSNPGLTAWEMITGLETGNLGMLWVAATNPAVSMPDIERTKAALRQSPFTVYQECYYPTEMADYAHVLLPTTQWSEKTGVMTNSERRVTLCPQFRVAPGEARSDWEIFAEVGRRLGYRKQFAFNYAAEVYAEFVRLTRDRPCDQSGLSHTYLREMGATQWPFSSKAEPTQQKVEKAKRLYTDLKFHTPDGRARFSLVYSRGLAEPPDDNYPFVLTTGRLYGHWHT

SEQ ID NO: 14446 - protein, 867 aa, Ustilago maydis
MPPFTPAVRAENTFAAQSTSTKPFSSKFAPASHDGQPRRLAVMTSGGDSAGMNAAVRSVVKMAIFRGCEAFVIREGWEGLVRGNQTPENTPSATPSVSRSASTFFDSPNIQAKPSHLEANPEQSDFVPTYGEGELLREGVGEAQELGLRGRYIIRVGWDDVRGWMDQGGTLIGTARSKTFRTPEGREQAAYNLIINGIDALAVCGGDGSLTGADKLRAEWPDLVASLKAKSKITEEQATKFAHLNIVGLVGSIDNDMATTDITIGASTALQRICEAVDSISSTAASHSRAFVVEVMGRHCGWLALMAGIATGADYVFIPERPPQGEQWHSEMSAVLQKHRDLGKRKSIVIVAEGAIDRELNDISPEMIKQVLSNDLGLDTRVTTLGHTQRGGKPDANDRILATLQGIEAVDAVLEATPETPSYVIGISENKITRIPLMFAVEQTQKVAKLIESKDFDGALALRDPEFAEGLRAFKYISQITEDEMLPQNKRLRMGVINVGAPAGGMNAATRTAVRYCLAKGHEAVVIYNGFPGLLEDNVSVLNWLRVDNWATRGGSELGVNRHLPDIDIGAVAAKLQEHKIEGLLIVGGFEAFSSVKILNDNRDRYPAFRIPIVGLPATISNNVPMNEFSLGSDTSLNALVDACDAVKQSASASRNRVFVVETQGGKCGYIAVMGALAAGAVLVYTPEVGIGLQQLGKDVAFLKKRFLLDVKGKSEGRLVIRNEKSSDVFTTEVITKILKEEGNSLFDARSASLGHTLQGGVPSPLDRVRATRLALKCCEFLESQALKQRSGSSASSKTGSGSSSDKSYSDDTAVMITIQGSTICFTSATEMSRNADMKNRRGKTAWWHELKALVELLGGRTALAEL

SEQ ID NO: 14447 - protein, 299 aa, Legionella pneumophila
MWNLSSRVHALNHFPKQGIECYVKRDDELGCGISGTKIRKYSSLIPFLKIKGIRHLIIIAGAQSNNLLAALQVARECQLKVTAFLVKPKHLKIQGNFKLSLLFLHENEIIWVNREEWYRVNEFAEQYLEGLRETAYILSEGASVKESMKGAMSLANDIKENEKILGFAFDHIFVDAGTGFSAIALIKGFHELQHKGFIHVLLLADSEEVFKKKLMHWAGVNPDNYACFYPTTAKSFGSVNQTIKQEIKRLAYEEGILADPIYSAKLFYEARRYIEKYELKGKVLIVHSGGILTMPGFAF

SEQ ID NO: 14448 - protein, 703 aa, Pseudomonas fluorescens
MNPVIKKFQFGQSTVTLETGRIARQASGAVLVTVDDDVSVLVTVVGAKQADPGKGFFPLSVHYQEKTYAAGKIPGGFFKREGRPSEKETLTSRLIDRPIRPLFPEGFMNEVQVVCTVVSTSKKTDPDIAAMIGTSAALAISGIPFDGPIGAARVAFHESTGYLLNPTYEQLAASSLDMVVAGTEEAVLMVESEAKELTEDQMLGAVLFAHDEFQSVIKAVKELAAEAAKPTWDWDWAAAPEATELLGAIRAEFGEAISQAYTITVKADRYARLGELKDQVVAKLSGEEGQPSASDVKAAFGEIEYRTVRENIVNGKPRIDGRDTRTVRPLNIEVGVLPKTHGSALFTRGETQALVVATLGTARDAQLLDTLEGEKKDPFMLHYNFPPFSVGECGRMGGAGRREIGHGRLARRSVQAMLPAADVFPYTIRVVSEITESNGSSSMASVCGASLALMDAGVPMKAPVAGIAMGLVKEGEKFAVLTDILGDEDHLGDMDFKVAGTAKGVTALQMDIKIKGITEEIMEIALGQALEARLNILGQMNQIIGQSRTELSANAPTMIAMKIDTDKIRDVIGKGGATIRAICEETKASIDIEDDGSIKIFGETKEAAEAARQRVLGITAEAEIGKIYVGKVERIVDFGAFVNILPGKDGLVHISMLSDARVEKVTDILKEGQEVEVLVLDVDNRGRIKLSIKDVAAAKASGV

SEQ ID NO: 14449 - protein, 259 aa, Unknown
  uncultured marine bacterium
QPNAMGGREVGGMANLLAAHRNLASADDRQEVADYWGVDKISDKPGLTATEMFKALESGEMKAVWIVCTNPLVSLPDARQAERALKNAKFVVVQDISSKSDTADYADLVLPAAGWTEKEGTMTNSDRRISYLPQINEAPGEAIPDTDILLKFAKAMGWEGFDYDSTEAVFNEHRELTRGTNIDITGLSYDYLKTKGTAQWPFVEGATEGTKRLFEDKVCWTPNQRAQIHTSLAANQSEKLTPDHPLVLTTGRIRDQWHT

SEQ ID NO: 14450 - protein, 606 aa, Cytophaga hutchinsonii
MYNRVNIMLTPKPEDFNWDLVGDKGFGGGYTAAEKEKIASLYEGTLSEVTEKQVLSGTVVGVTERDVIINIGFKSDGLIPLSEFRDVDGGVKVGEVYDVFVEDQENASGQLVLSRRKARIVKAWENIQGALDNDIIIEALVKRRTKGGLIVDLFGVEAFLPGSQIDVKPIRDFDIFVGKKMEVKVVKINYTNDNVVVSHKVLIEKDIEKQKAVILNNLEKGQVLEGVIKNMTNFGVFIDLGGVDGLLHITDISWGRISHPQEVLSLDQKVQVVVLDFDEEKKRISLGMKQLTSHPWDALAADVVVGSKIKGKIVNVADYGAFLELHPGVEGLIHVSEMSWSQHLRNPQDFIKVGDELETVVLTLDRDERKMSLGIKQLTEDPWTKSDAISKYAVGTKHTGLVRNLTNFGLFIELEEGIDGLVHVSDLSWTKKIKHPSEFVKVGDKLDVVVLELDVENRRLALGHKQLEENPWNTFETIFTPGSTHTATLISKNDKGAVLELPYGIEGFAMNKHLVKADGANAEQGESLDFKVLEFSKDDKRIVLSHTKTFSEVAEDAAAPADKKKKAAPAKGAKAPATAKTPAVEKSTLGDIEALSNLKDSMDGKK

SEQ ID NO: 14451 - protein, 829 aa, Unknown
  Vibrio sp. Ex25
MKMTRRAFVKANAAASAAAVAGVTLPASAANLIASSDQTKITWDKAPCRFCGTGCSVLVGTQNGKVVATQGDPEAPVNKGLNCIKGYFLSKIMYGQDRLTQPMLRMKDGKFHKDGEFTPISWDDAFDIMAEKWKASLEKKGPTSVGMFGSGQWTVMEGYAASKLMKAGFRSNNIDPNARHCMASAVVGFMRAFGIDEPMGCYDDFENADAFVLWGSNMAEMHPVLWTRITDRRLSHPHVKVNVLSTYYHRSFELADHGYIFNPQSDLAIANFIANYIIENDAVNWDFVNKHTNFTQADTDIGYGLRDDDPLQKAAKNPNSGKLTSISFEEYKKSVAPYTAEKASEISGVEKEKLIELAKQYANPNTKVMSLWTMGMNQHTRGVWMNNLVYNIHLLTGKISTPGNSPFSLTGQPSACGTAREVGTFAHRLPADMVVANPKHRKIAEDIWKLPEGTIPPKPGFHAVLQDRMLNDGVLNCYWVQCNNNMQAGPNINTERLPGYRNPENFIVVSDPYPTATAQAADLILPTAMWIEKEGAYGNAERRTQAWYQQVGTVGQAKSDLWQLMEFSKRFKMEEVWPEELLAKAPQYRGKTMYDVLYRNGNVDKFPIEEARELNDDAHHFGFYVQKGLFEEYATFGRGHGHDLAPYDRYHEVRGLRWPVVDGKETQWRFKEGSDPYAKEGSGWDFYGNADGKAKIISAPYEAPPEVPNDEFDMWLCTGRVLEHWHTGTMTRRVPELYKAVPDAVCYMHPEDAKARNVRRGEEVLMANKRGEVRVRVETRGRNRPPKGLVFVPFFDARILINKLILDATDPLSKQTDFKKCPVKITKIA

SEQ ID NO: 14452 - protein, 355 aa, Pinus sylvestris
MSLLTDLINLDLSDITEKIIAEYIWIGGSGMDIRSKARTLSHPVTDPKDLPKLNYDGSSTGQAPGKDSEVILYPQAIFRDPFRRGNNILVICDTYTPAGEPIPTNKRANAQKYLAIQMLFAEEPWYGIEQEYTLLQKDVNWPLGWPVGGYPGPQGPYYCGTGADKAYGRDIVDAHYKACLYAGINISGINGEVMPGQWEFQVGPTVGISSGDQVWAARYLLERITEVAGVVLSFDPKPIQGDWNGAGAHTNYSTKSMREEGGIKVIKKAIEKLGLRHKEHIAAYGEGNERRLTGRHETADINTFSWGVANRGASIRVGRDTEREGKGYFEDRRPASNMDPYIVTSMIAETNHPLK

SEQ ID NO: 14453 - protein, 249 aa, Oryza sativa
MKKKKKSKGSVEKMTRRYWNINLKEMIEAGVHFGHGIKKWNPKMAPYISAKRKGTHITNLARTTRFLSEACDLVFDAASQGKSFLIVGTKKRAADLVASAAIRARCHYVNKKWFSGMLTNWSITKTRLSQFRDLRAEEKMEKFHHLPKRDVAILKRKLSTLQRYLGGIKYMTRLPDIVIVLDQQKEYIALRECAILGIPTISLADTNCDPDLANISIPANDDTMTSIRLILNKLVFAICEGRSLYIRNH

SEQ ID NO: 14454 - protein, 262 aa, Trichodesmium erythraeum
QPNAMGGREAGGLAHLLPGYRMVKNSQHRAEVEKLWELTPGKISDVPGRSAWEMIMALERKEIGCLWIAATNPAVSMPDLKRTKAALLRSPFTIYQDAYNPTETAEYAHLLLPAAQWGEKTGTMTNSERVVTLCPAFREPHREAKADWEILAEVGRRLGFTNHFNFADSEAVRAEFLELTRDRPCDMTGITYQRLQEKGPTQWPCPDSSGVSQERLYTDFRFNTPDGRARFAAYYSQGLAEPPNPDYPFILTTGRLYGHWHT

SEQ ID NO: 14455 - protein, 565 aa, Rhodopseudomonas palustris
MASTDTYNPTRDDFAAMLDESFAGGNLQESSVIKGKVVAIEKDMAVIDVGLKTEGRVPLREFAGPGRDNEIKVGDTVEVFLDRIENALGEAVLSRDKARREESWGKLEKAFQNNEKVFGVIFNQVKGGFTVDLDGAVAFLPRSQVDIRPIRDVAPLMNNSQPFQILKMDRRRGNIVVSRRTVLEETRAEQRQELVQNLEEGQVIDGVVKNITDYGAFVDLGGIDGLLHVTDIAWRRVNHPTEVLTIGQTVKVKIIKINHETHRISLGMKQLLDDPWQGIEAKYPLNARFTGRVTNITDYGAFVELEPGIEGLIHVSEMSWTKKNMHPGKIVSTSQEVEVQVLEVDSVKRRISLGLKQTMRNPWEVFVEKHPVGSTVEGEVKNKTEFGLFLGLDGDVDGMVHLSDLDWKLPGEQVIDNFKKGDMVKAVVLDVDVEKERISLGVKQLEGDPFAEPGDVKKGAVVTCEVLDVKESGIDVQIVGTDFNTFIKRSELARDRNDQRSDRFAVGEKVDARVIQFDKKARKVQVSIKALEVAEEKEAIAQYGSSDSGATLGDILGTALKQRDK

SEQ ID NO: 14456 - protein, 522 aa, Rickettsiella grylli
MSESFAQLLEENFSERIFYTGMIITGTVVRIEKDRVVVNANLKSEGLIPIEQFYNEAGELEVSVGDQVDVSIESLEDGFGETRLSREKAKRAEMWAALQRAHDADTLVTGKVTGKVKGGFTVEIGSLRAFLPGSLVDVRPIRDSSIIEGKDLEFKVIKLDPKRNNIVLSRRAVLESEGQAGREQLLTELEEGQVIKGIVKNLADYGAFIDLGGIDGLLHVTDISWKRVKQPSEVLNIGDEIEVVVLKIERERGRVSLGLKQLVGDPWEDLVKRYPVGTRLKGKVTNVTDYGCFVEIEEGVEGLVHVSEMDWTNKNINPNKIVQAGMEIEVIVLDIDSDRRRISLGIKQCKSNPWEDFAHTHVKGERITGKIKSITDFGLFIGLPGNIDGLVHLSDIAWNLSGEEAVRKYKKGDELETIILSIDPERERISLGIKQLDTESSHPFDKYSKDQRVKGKIIEINDEGMKVDLGNHVEAQLKVAEYGEEGKNFEIGQEIEAKILSLDRKNHYISLSLLALEEKTAQ

SEQ ID NO: 14457 - protein, 509 aa, Capsicum chinense
MEGTTWTAYAAVFLGTLFLLLLSKFLRQKKLNLPPGPKPWPIIGNLHLMGNLPHRSIHELSVKYGPILQLQFGSFPVVVGSSVEMAKIFLKSMDINFVGRPKTAAGKHTTYNYSDITWSPYGSYWRQARRMCLTELFSAKRLDSYEYIRAEELHLILRNLNKLSGKPILLKDYLTTLSLNVISRMVLGKRYLDESKNSIVTPEEFKKMLDELFLLNGVLNIGDSIPWLGFMDLQGYVKRMKVLSKKFDKFLEHVLDEHNVRRKAVENYVAKDMVDVLLQLADDPSLEIKLERHGVKAFTQDLLAGGTESSAVTVEWAISELLKRPDIIKKATEELDRVIGQNRWVQEKDIPNLPYIEAVVKETMRLHPVAPMLVPRECREDCKVAGYDVQKGTRVLVSVWTIGRDPTLWDEPEAFEPERFLEKSIDVKGHDFELLPFGAGRRMCPGYSLGLKVIQASLANLLHGFKWSLPDNMTPEDLNMEEIFGLSTPKKFPLSAMIEPRLPPSLYSV

SEQ ID NO: 14458 - protein, 1429 aa, Colwellia psychrerythraea
MFSQKSVLRVIVLASVSMVLVACGGSESTEPGEVLLSCDVPMVSDAAGTSCVAPEPIECPVPTVPDALNESCVVGIDPKAPEPIIFAGENQALLFYNRADGEYSDYKMHNWNSAECDAYAADSLAPSWDNGLAHTGVDPVYGAYWLLNLKDDHNECGHFIIHKGTDDAGKEFGGGDFKMPLFQDDETYQRMNFTFSGVASIFEYPVVTLGKQALAISGFSAHWIDSNTFTWNVNFDLVTSVKLHHSATAGIGADEANEDVITGTVVELSEVDLTDEQKAAAPLVADWPAFSGNWSIEEAKAIAKNQLVLVGYNAEGLAVAATNVQADLVLDDLYTKGEMDANEATLGVVYDNGTVKVSVWSPTAQQLKLNVYNADKEMVSSHDMTEDSMTGVWSYTGDASLDRQFYRFALTLYHPENKAIEEIESTDPYSLSLSTNGEYSQFVNLSDEDLQPEGWDGHAVSTIENYEDAVIYEGHIRDFSAQDESTSVENRGKFLAFTEINSAPMQHLQKLVANGLTHFHMLPANDIATIDEDADKIIDLDSTVLALCKVNFKAPPCYQNLDDQTLRAVFESYSPYSNEAVKLTEAMRDTDSFNWGYDPKHFNVPDGIYASNPDGVSRIKEMRAMIKSLHDIGLRVVLDVVYNHTNSAGLWDNSVLDKFVPGYYHSRDVTTGAVQNSTCCSDTALEHRMMDKLMVDSLKQWTEQYQFDGFRFDIMSQGSKEQMLAARDAIQAIDPDNHFYGEGWYKDSRGFERADQENMAGTEIATYNDRIRDGIRNATLFNNESDSDYPFEQQDIVKFGMAGTQTDYVLKTFKGTDVVGSSAGMYAKDPADIINYVSKHDNETLWDILQFKLSPEMNNSERVRAQNISQSIVLLSQGIPFLQMGGDFLRSKSLDRNTYDAGDWYNLVDFTFELNNWNKGLPLDNGGRDYDDIVSLASSSSSTVSMTDILFASNVFNEFLSIRTSSPLFRLTTATDIINRVGFHNIGKNQTQGLIVMSIDDGSTLTDIDPNYDALVVVVNGTNSEQTHTIASASNFTLHPLLAGSVDGTVASATFEQGTDEGSFTVPPLTTAVFVKVQGESQASGLSAYVTAGAPDVVPYGDTVAYVRGEMNGWNPDDAFTYIGDGVYQAKITLAAGSYGFKVADFDWSSNINLGAPGSGGEVLEDQTFNLLPGSNDNLSITVAIDGTYFFTLDASNTDAPTLLVENEEPFVGTPIFIRGDMNGWGEDNELIYIGNGKYQATITISVSTPSFKIASADWSTVNMGAPADDMEITEGENQLLLSGSGDNFSMNFTVDGDYTFVFDASDLAEATLSIYSAEIFGATPVFIRGDMNGWGEVDQLSYAGASSYSVELNLTAGDYGFKIASGDWSTFNLGAPADTSVVALDSPLTLLQNSQDNLSVTIVDDGVYIVTVTGPDPTTPTINISKKL

SEQ ID NO: 14459 - protein, 260 aa, Vibrio diazotrophicus
QPNAMGGREVGGLANQLAVHRGFDTESVRLVKEYWQSPSIAAKPGLKAVELFEAVEAGKIKVLWIMATNPVVSLPNSDQVRRALKGCDFVVVSDITEQSDVAEYADLVLPAAGWGEKQGMVTNSERRMSRQRAFLPAPGEAKPDWWAVTQVGKKLRTKLNCESGFEFDSEAAVFREFAGLSAINTNSNYLFDLSKFASISDEEYANWQPTQWPLEKEAPYHDGVFSTPSGKAQFVAVTAPSTVMNGWWLNTGRLRDQWHT

SEQ ID NO: 14460 - protein, 801 aa, Staphylococcus aureus
MAKQKLVMIGNGMAGIRTIEEILERANDLYDITVIGKEPYPNYNRIMLSNILQNKMTVEETIMNPYEWYEEHGIELITNDPVIEVDRANQSVTTANGIEVSYDKLIFATGSKAFVIPVPGSTLPSVIGWRTIDDTEQMMNIAKTKKKAIVIGGGLLGLECARGLLDQGMEVTVLHLAEWLMEMQLDRKAGNMLKADLEKQGMKFEMQANTTEILGEDDVEGVKLADGREIPADLVVMAVGIRPYTEVAKESGLDVNRGIVVNDVMQTSDSNVYAVGECAEHNGKVYGLVAPLYEQGKVLADHLTNKETNGYKGSTTFTSLKVSGCDLYSAGQIVENAEIKGIEIFNSVDNNYKKIFLKDGNVVGAVLYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAAICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGVKKEELPNIWEDLGMRSASAYGKKTRSVKSCVGKEFCRFGTQYTTRLGIRLEKTFEYIDTPHKFKMGVSGCPRSCVESGVKDFGIISVENGFQIYIGGNGGTEVEKAEFLTTVETEDEVIKLCGALMQYYRETGIYAERTAPWLRRLGFENVKEVLLDPERQNELFERIMDAKKAVEAEPWEAITSNAQARKIFEVEKV

SEQ ID NO: 14461 - protein, 1057 aa, Pisum sativum
MERARRLANRATLKRLLSEAKQNRKTESTSTTTTTPLPFSLSGSSSRYVSSVSNSILRGRGSKPDNNVSRRVGGFLGVGYPSQSRSISVEALKPSDTFPRRHNSATPDEQTKMAESVGFDTLDSLVDATVPKSIRLKEMKFNKFDGGLTEGQMIEHMKDLASKNKVFKSFIGMGYYNTHVPPVILRNIMENPAWYTQYTPYQAEISQGRLESLLNFQTMITDLTGLPMSNASLLDEGTAAAEAMSMCNNIQKGKKKTFIIASNCHPQTIDICQTRADGFELKVVVKDLKDIDYKSGDVCGVLVQYPGTEGEVLDYGEFIKKAHANEVKVVMASDLLALTVLKPPGEFGADIVVGSAQRFGVPMGYGGPHAAFLATSQEYKRMMPGRIIGVSVDSSGKQALRMAMQTREQHIRRDKATSNICTAQALLANMAAMYAVYHGPEGLKAIAQRVHGLAGVFALGLKKLGLEVQDLGFFDTVKVKTSNAKAIADAAIKSEINLRVVDGNTITAAFDETTTLEDVDKLFKVFAGGKPVSFTAASLAPEFQNAIPSGLVRESPYLTHPIFNTYQTEHELLRYIHRLQSKDLSLCHSMIPLGSCTMKLNATTEMMPVTWPSFTDLHPFAPTEQAQGYQEMFNNLGDLLCTITGFDSFSLQPNAGAAGEYAGLMVIRAYHLSRGDHHRNVCIIPASAHGTNPASAAMVGMKIVTIGTDAKGNINIEELKKAAEKHKDNLSAFMVTYPSTHGVYEEGIDDICKIIHDNGGQVYMDGANMNAQVGLTSPGWIGADVCHLNLHKTFCIPHGGGGPGMGPIGVKKHLAPFLPSHPVVPTGGIPAPENPQPLGSISAAPWGSALILPISYTYIAMMGSQGLTDASKIAILNANYMAKRLESYYPVLFRGVNGTVAHEFIIDLRGFKNTAGIEPEDVAKRLMDYGFHGPTMSWPVAGTLMIEPTESESKAELDRFCDALISIRKEIAEVEKGNADVHNNVLKGAPHPPSLLMADAWTKPYSREYAAFPAAWLRGAKFWPTTGRVDNVYGDRNLVCTLLPASQAVEEQAAATA

SEQ ID NO: 14462 - protein, 114 aa, Caulobacter crescentus
MKMIVAVIKPSRLDAVLEAVTEAGASGLTVTEVRGYGRQKGKTEVYRGAEYEVKLLPKVKLEIAVPTDVLEPVIEALQRTANTGKIGDGKVFVMDLEQALRIRTGERDAAAIAG

SEQ ID NO: 14463 - protein, 149 aa, Zea mays
MAPKAEKKPAAKKPAEEEPAAAKAPAGKKPKAEKRLPAAKSSGKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 14464 - protein, 134 aa, Erwinia amylovora
MSETLKVLNNIRTLRAQAREVSLSELEEMLEKLEAVVNERRDAEAAIASEIKEKEEKLAKYRQMLLEDGIDLSELTSAENTSGKPRAKRAPRPAKYEYTDENGEHKSWTGQGRTPAVIKQALDAGKKLEDFLIK

SEQ ID NO: 14465 - protein, 267 aa, Unknown
  uncultured marine bacterium
QPNAMGGREVGGLANQLAAHMDFSEQDIETVKTYWNSPNIAKNPGLKAVDMFNAIATGQIKAIWIMPTNPLVSMPEVNQVRKALEQCELVIVTDCVKQTDTTELADILLPALAWGEKDGTVTNSERRISRQRAFLPSPGEAKADWWIINEVAKRMGFNDSFNYQSPDAIWREHAALTAANNDLQRDLDLSGLKDLSKLEYNRLQPVQGPCQDNSATNKNHMFEDRRFFHPDGKARFIPVKRCDSFPKTSLEYPLVLNSGRIRDQWHT

SEQ ID NO: 14466 - protein, 433 aa, Cytophaga hutchinsonii
MNEVVVFWFRRDLRLTDNAGLFQALTSGYAVLPVFIFDINILNALEHKNDARVEFIHDTIQSLKNELQKIHSDMEVYHATPAEAFEQLVKKYTVKAIYTNTDYEPAAIKRDNEISDWAAQQQIAFKSFKDQVIFEKNEILTDTGAPYRVYTPYKNKWLKKLTENPVTHSPSEKHTDAFLRMEAKPIVTLKQLGFTPSSIQIPPLETLRKTIQEYDKTRDYPYLEHGTSLLGIHFRFGTISIREKVVKALPLNATWLSELIWREFFMQLLFHFPHVVTESFQSKFNRLEWRYSQADFEKWCTGKTGYPLVDAGMRELNTTGHMHNRVRMVVASFLTKHLFIDWRWGEAYFAQKLLDYDLSANNGNWQWAAGTGADAQPYFRIFNPISQQEKFDPDFIYIKKWVPEFGTSSYIEPIIEHKKATERAKLLFSVLKN

SEQ ID NO: 14467 - protein, 233 aa, Oryza sativa
MAGKDDDVKVLGVVVSPFAIRVRIALNIKGVSYEYVEEDIFNKSELLLTSNPVHKKVPVLIHGGKPISESLVIVQYVDEVWAAAPSVLPADPYDRAVARFWAAYVDNNMFPGMAGVLFAATEEERAAKAEETLAALAQLEKAFAECAGGKAFFGGDSIGYVDLALGSNLHWFEALRRLFGVALLDAGKTPLLAAWAKRFVEAEAAKGVVPDAGVAVELGKKLQARAAAASTAA

SEQ ID NO: 14468 - protein, 437 aa, Bartonella quintana
MTKQENDIQKRFFNDNLQTVDVAIFDAINGEFKRQQHEIELIASENIVSRAVLEAQGSILTNKYAEGYPRKRFYGGCRFVDVVEDLAIERAKQLFGAAFANVQAHSGSQMNQAVFLALLQPGDTFMGLDLNSGGHLTHGSSVNMSGKWFDVVSYGVRKEDQILDMEEIERLAKEHKPKLIITGGSAYSRLWDWKRFREIADEIGAYLLVDMSHIAGLVAGGVHPSPVPHAHIVTTTTHKSLRGPRGGLILTNDETLARKINSAIFPGLQGGPLMHVIAAKAVAFEEALQPAFKNYSANVVVNAKTLAKTLQSNGFDIVSGGTDNHLLLVDLCSKKVTGKRAELALGRAHITCNKNAIPFDLQAPSVTSGIRLGSPAATTRGLAENEFVQVGHMISEVLDGLQMAKSDEDNNAVEMAVRKKVEDMTNKFPLYSYLPIC

SEQ ID NO: 14469 - protein, 194 aa, Rubrobacter xylanophilus
MARVGELERKTGETFVRVRLEVDGEGRADVSTGVGFLDHLLHLLAHHSGMDLEVRAEGDTWVDDHHTVEDTGLVLGRALDQALGDRSDLVRFADASVPLIEALSTAAVDLGGRSHLTCNTGPLPEKIGTFDTELFPEFLRAFTQYGRFTLHLNCHYGHNAHHKVESGVKALAVALRAAVSRRSSGTASTKGVVD

SEQ ID NO: 14470 - protein, 645 aa, Deinococcus radiodurans
MRSAHSGEQTPVPPMSAAAPVVAPVPAPAPAAATSIRVPAARLEGLMDQLGELVTARARMTQLLSRLDELQGSMTASQERFQRTVRDFEERYLNPDMVREEGAAPTTRMGGLDLSQQFAELEFDTYNDLNILSRSITELSADFAEVRRRLSDTAAELSEENEQLGKLVRRLRLDVNQTSRVAFSQTTARLRRWAREQQADLTLQVEGEDVLIESGILQRISDPLLHLLTNAAYHGLASESAESRRAAGKNPQGTVWIRAAEQGNFLEVTVADDGQGLDYARIRERALERGLRSAQELEQLSSDELGRLILLPGFSTAREVGNVAGRGVGLDVVATAVRQLGGELLISSERGVGTAFTLRVPTTQRIMDVLHLDLGAGHHAALPVGSVRSLRDVPLGDLRRDDGQLWLDFGGQPVPVVDARPIWGHAPQDTDTEAHLAVVSSISGLLALRVHDFGDIEEVAVTAPSGLLAPLDYLAGMAVSGTGQVLAILDPAGVLRLSRRPATWLGQAQRQVQATGNQRLLLVDDSLSVRRLVGRMLERGGYQVVTASDGQEALDLLQQDADFGAVVTDLEMPRVNGYELLSAVRARPATAGLPMLVMTTRAGEKHQRLAFQLGADDYFTKPVNEALLLRRLGTLQQAQQAGVSA

SEQ ID NO: 14471 - protein, 504 aa, Pericallis cruenta
MSILTLICTFITGLMFYGLVNLLSRRASRLPPGPTPWPIIGNLMHLGKLPHHSLADLAKKYGPLIHVRLGSVDVVVASSASVAGQFLKVHDANFANRPPNSGAKHMAYNYHDMVFAPYGPRWRMLRKMCSMHLFSAKALADFRQVRQEEVMILTRVLAGTEQSAVKLDQQLNVCFANTLSRMMLDRRVFGDGDPKADDYKDMVVELMTLAGQFNIGDYIPWLDLLDLQGIVKRMKKVHSQFDSFLDTIIDEHTIGTGRHVDMLSTMISLKDNADGEGGKLSFIEIKALLLNLFSAGTDTSSSTVEWGIAELIRHPQLMKQAQEEMDIVIGKNRLVTEMDISQLTFLQAIVKETFRLHPATPLSLPRIASESCEVKGYHVPKGSILFVNVWAIARQSELWTDPLEFRPGRFLIPGEKPNVEVKPNDFEIVPFGGGRRICAGMSLGLRMVNLLIATLVQAFDWELANGLELEKLNMEEVFGISLQRVQPLLVHPRPRLARHVYGTG

SEQ ID NO: 14472 - protein, 418 aa, Unknown
  Marinobacter sp. ELB17
MDIAAYMNEVGAQARAAAKHVARSTTAVRNQALLAMAQALDAARDELAEANQQDLSAAKASGLDSAMLDRLELTPARVDAMIEGLLQVAGLADPIGVITDMVYRPSGIQVGKMRVPLGVIGIIYESRPNVTVEAASLCLKSGNAAILRGGSESIHSNQAIARCISSGLAQAGLPETAVQIIATADRAAVGELITMPQYVDVIVPRGGKSLIERVSRDARVPVIKHLDGVCHVYIDSHADPEKALAVAVNAKTQRYGTCNTMETLLVDEEIAADILPLLNAAFVEKGVELRGCERSREIVSEMTPATEADWEAEYLAPILAVKIVDGLDGAIAHISQFSSRHTDSIITENYTRARRFLTEVDSSSVMVNASTRFADGFEYGLGAEIGISTDKIHARGPVGLEGLTSQKYVVFGDGHIRV

SEQ ID NO: 14473 - protein, 1022 aa, Bifidobacterium longum
MTDVTHVDRASQAWLTDPTVFEVNRTPAHSSHKWYARDPQSGQWSDLKQSLDGEWRVEVVQAADINLEEKPSTAESFDDSSFERIQVPGHLQTAGLMNHKYVNVQYPWDGHENPLEPNIPENNHVALYRRKFTVSTPVANAKQAGGSVSIVFHGMATAIYVWVNGAFVGYGEDGFTPNEFDITGLLHDGENVVAVACYEYSSASWLEDQDFWRLHGLFRSVELAARPHVHIENTQIEADWDPEAGTASLDAALTVLNATDAATVRATLKDADGNTVWQTTGDAEAQTAISSGPLPGIEPWSAESPTLYELDVDVIDQAGDVIECTSQKVGFRRFRIEDGILTINGKRIVFKGADRHEFDAERGRAITEQDMIDDVVFCKRHNINSIRTSHYPNQERWYELCDEYGIYLIDEANLEAHGSWSLPGDVLTEDTIVPGSKREWEGACVDRVNSMMRRDYNHPSVLIWSLGNESYVGDVFRAMYKHVHDIDPNRPVHYEGVTHNRDYDDVTDIETCMYLHADEIEKYLMDDPKKPYLSCEYMHAMGNSVGNMDEYTALERYPKYQGGFIWDFIDQAIYATQPDGTRSLRYGGDFGDRPSDYEFSGDGLLFADRKPSPKAQEVKQLYSNVHIDVTKDSVSVKNDNLFTATGDYVFVLSVLADGKPVWQSTRRFDVPAGETRTFDVAWPVAAYRADARELVLQVSQRLAKATDWAESGYELAFGQAVVPADATATPDTKPADGTITVGRWNAGVRGAGREVLLSRTQGGMVSYTFAGNEFVLRRPAITSFRPLTDHDRGAGHGFERVQCWAPDVRPLRGQRARADRDRTIKGTYTYELATAQRTKVTVSYTAHTDGRVNLHVEYPGEQGDLPTIPPFGIEWTLPVQYTNLRFFGTGPEETYLDRKHAKLGVWSTNAFADHAPYLMPQETGNHEDVCWAEITDDHGHGMRVSRADGAAPFAVSLLPYSSFMLEEAQHQDELPKPKHMFLRVLAAQMGVGGDDSWMSPVHPQYHIPADKPISLDVDLELI

SEQ ID NO: 14474 - protein, 139 aa, Brassica napus
MQGALCIKPTILPLSSPLFSPKLTILLPQTITNTKASRLSSLRPNTSSPTTSDPLTVDYDSLLSVFPAEACEVISGYACSADISPEVKLETKPVSRSVASESVNREYLEYNNPKTVFAAEACDDLGGEFCEPDYQKDVY

SEQ ID NO: 14475 - protein, 113 aa, Oryza sativa
MKTTGGGGSPKEAVVPSAASGDTTLGRHLAHRLVQVGVSNVFTMPGDLKLTLLDHLIAEPGLHIVGCCNELNAGYAADGYAWAHGVGACTVTFTIRGQLLHGRRRAAIGSGIR

SEQ ID NO: 14476 - protein, 849 aa, Photobacterium profundum
MSKVRLAIIGNGMVGHRYIEELVDKADMENFEVTVFCEEPRIAYDRVHLSSYFSHHTADELSLVKEGFYEKHGINVLIGERAITINRAQKVIHSNTGREIRYDKLIMATGSYPWVPPIKGNEGKDCFVYRTIEDLKTIEATAKRSKSGVVVGGGLLGLEAAGALKALGVETHVIEFAPVLMAEQLDRQGGEQLRNKIEKLGVKVHTGKNTKEILAEGTEARNTMNFADGTSLEVDFIVFSTGIRPQDKLAMQCGLATGRRGGIAINNTCLTSDEDVYAIGECASWNEIFYGLVAPGYKMAQVAVSHLIGEDKTFEGADMSAKLKLLGVKVGSIGDANGRTPNCKSYVYLDENEEVYKRIIVSEDGKKLLGAVLVGDTSDYGNLLQLKLNDMDLPKHPDTLILPAHAGAEKPSMGADSLPETAVICSCFDVTKGKIATAVADGHTTLGEIKAVTGAGTGCGGCIPLITQVLNAELAKAGIEVKNHLCEHFEYSRQELFHLIRVEEIKSFDELLKKYGKGYGCEVCKPTVGSILASSWNDYVLTKDNTQLQDTNDIFLGNMQKDGTYSVIPRMAGGEVTPVALLAIAQVANDYNLYTKITGAQRIGLFGAHKDDLPAIWEKLIAAGFETGQAYAKALRMAKTCVGSTWCRFGVQDSTALGVALENRYKGIRTPHKMKFGVSGCTRECAEAQGKDLGIIATDAGWNMYVGGNGGMKPRHADLLAADLDKDTLIKYIDRYMMFYIRTADKVQRTSVWLDNLEGGIEYLRDVIINDKLGINAQLENDVEKLIASFQCEWTTTLEDDNQLKRFNHFINSSERDSNVTFVPEREQHRPATENEKAPIYTISLEEKV

SEQ ID NO: 14477 - protein, 183 aa, Shigella flexneri
MQDSILTTVVKDIDGEVTTLEKYAGNVLLIVNVASKCGLTPQYEQLENIQKAWADRGFVVLGFPCNQFLEQEPGSDEEIKTYCTTTWGVTFPMFSKIEVNGEGRHPLYQKLIAAAPTTVAPEESGFYARMVSKGRAPLYPDDILWNFEKFLVGRDGKVIQRFSPDMTPEDPIVMESIKLALAK

SEQ ID NO: 14478 - protein, 347 aa, Unknown
  Cichorium intybus x Cichorium endivia
MALHTPGQVAPLLLLLGMVVNFHIFIDAQAVGVCYGRVAVPGSLPSEEATVNLYQQNGITAMRIYDPNQATLQALQGIDIELMLDVPNSELESLNNPVAATTWVRNNIQNYPGVNFRYIAVGNEVDPNNNATSDYVKLVLPAMRNVHQAIVDASLANQIKVSTATYTGLLENSYPPSDGVFHENVKAFIEPIIAFLVQNNLPMLANIYPYFAAQGSMQVNLSYALLQPDAPVVNDNGIMYSNLFDAMLDAHYAAQAPFGGENLEIVVSESGWPSCCDSIATVENAGTYYRNLIGHVTQVGGTSAKPGKSIETYQFAMFDENIKDGDESEKHFGIFSPNQTPKYQVNF

SEQ ID NO: 14479 - protein, 715 aa, Escherichia coli
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVCHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 14480 - protein, 502 aa, Trichodesmium erythraeum
MLTKLWSFRGRYRILHLTWFAFFLSFVVWFNLAPLATALKEDLGLETSQIRTIAICNVALTVPARIIIGMLLDKYGPRITYSLLLMYAAIPCIGFALAQNFSHLVISRLALSIVGGGFVIGIRMVAEWFPPKEIGLAEGIYGGWGNFGSAGAAFTLPTIAAWLTFGSGDVLNWRVSIALTGIIAALYGVFYFFNVLDTPPGKTYQKPKCARGLEVTTPKDFLFLVLMNIPLTGVLCLLGWRLSKVGFLSTSQLYIVWLVLLGLYAFQTYNCWITNKELIAQEKHYPPSDRYKFSQVAILELTYFVNFGSELAVVSMLPAFFENTFGLSKTMAGMIAASYAFMNLVSRPGGGLISDKLGSRKLTMTVLTVGMAIGYLTMGNVKGSWWLPAAVLLTMLCSFFVQAAEGSTFAIVPLIKRRVTGQIAGNVGAYGNVGAVLYLTLYSFLPEGAIGDKIFFEVIGVTSMIVAFICAFFLKEPEGSFAEHHEGEEEVQIESHTLFAEE

SEQ ID NO: 14481 - protein, 153 aa, Brassica napus
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNM

SEQ ID NO: 14482 - protein, 734 aa, Trichodesmium erythraeum
MKTTKTACPYCGVGCGLEVSPPATPGKVTNRDSKGNPTWQVRGDRSHPSSQGKVCLKGATVGEALDKSRLKYPMMRNTLDEAFRRVTWEEAFRRIVNQIQKVRFSQGPDAICMYGSGQFQTEDYYVAQKLLKGCLGTNNFDANSRLCMSSAVSGYIQSFGSDGPPCCYDDLEKTDCAFLIGTNTAECHPIIFNRLRASKKRNKKVKMIVVDPRRTKTAEVADLHLAIRPGTDIDLLNGIANLLIQWGLLDAMFIDECTKGFPEYVNIIRQYPPGLVARHCGIRLDELETAARYWGKSERVLSLWSMGMNQSSEGTAKVRTLINLHLMTGDIGKPGTGPFSLTGQPNAMGGREAGGLAHLLPGYRMVKNSQHRAEVEKLWELTPGKISDVPGRSAWEMIMALERKEIGCLWIAATNPAVSMPDLKRTKAALLRSPFTIYQDAYYPTETAEYAHLLLPAAQWGEKTGTMTNSERVVTLCPAFREPLREAKADWEIFAEVGRRLGFTNHFNFADSEAVRAEFLELTRDRPCDMTGITYQRLQEKGPTQWPCPDSSGVSQERLYTDFRFNTPDGRARFAAYYSQGLAEPPNPDYPFILTTGRLYGHWHTQTRTGRIEKIRKMYPLPFMEIHPQDAQRLEISDNDWVEVRSRRGYSRFPAKITKAITPGTVFVPMHWGALWAHQAEANTLTHPQACPESGQPELKACAVQLQPVKFQAAPIALWASKKSTPLGEVKSSK

SEQ ID NO: 14483 - protein, 126 aa, Fusarium proliferatum
TKQTARRSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLAR

SEQ ID NO: 14484 - protein, 420 aa, Rickettsia typhi
MNILNNNLYGMDKEIYEIIKNEKLRQNNVIELIASENFVSSAVLEAQGSILTNKYAEGYPSKRFYNGCDEVDKAEVLAIERAKKLFNCKYANVQPHSGSQANQAVYLALLQPCDTILGMSLDSGGHLTHGAAPNISGKWFNTVAYNVDKETYLIDYDEIKRLAVLHNPKLLIAGFSAYPRKIDFARFREIADKVGAYLMADIAHIAGLVATGEHQSPIPYAHVVTSTTHKTLRGPRGGLILSDYEEIGKKINSALFPGLQGGPLMHVIAAKAVAFLENLQPEYKCYIKQVISNAKALAISLQERGYDILTGGTDNHIVLVDLRKDGITGKCAANSLDRAGITCNKNAIPFDTTSPFVTSGIRFGTSACTTKGFKEKDFVLIGHMVAEILDGLKNNEDNSKTEQKVLSEVKKLIKLFPFYD

SEQ ID NO: 14485 - protein, 426 aa, Burkholderia pseudomallei
MAATSASPASLDKRAMPVLASSTIAFTLCFAVWMMFAILGIPLKKTLGLNDTEFGLIAAMPVLTGSLIRVPLGIWTDRYGGRIVFFILMLVTVVPIWLISYATELWQFLVLGLFVGLAGGSFSVGTPYVARWFPKARQGLAMGVFGAGNSGAAVNKFVAPALIAAAGTWTIVPRVYAVAMLAMALLFWLFSATDPAHRSTNATSLRAQLRVLKNPRVWRYSQYYSVVFGGYVGLSLWLTQYYVGEYGFGIQSAAFLAACFSLPGGVLRAIGGWLSDRYGAYRTTWWVMWVCWVMFFLLSYPPTDFTIRAAHGPLGFHLSLTPVAFTALLFAVGIAMAVGKASVFKFIADEFPNDIGAVSGVVGLAGGLAGFALPILFGALVDLTGVRSTCFMLLYGAVSVSLVWMYFSFRAERAAHDQRVLATRSA

SEQ ID NO: 14486 - protein, 403 aa, Zea mays
  misc_feature (213)..(213): Xaa can be any naturally occurring amino acid
  misc_feature (280)..(280): Xaa can be any naturally occurring amino acid
MSSPCVSHQQQVRLRLRAASRLPAPDTASFAPPAPRQLRMAHAAMSAKAPLGVAPTEEGAGTPGQQAVLGKEEEEANSMPQFPVTRGTVPAVGLVHAPFSLLPARFPAFFNQACELAPIFNELVDRVSLDGEFQAALSRQVNSIHWILLVNSLSFSNFRTKQVDEFTSRLLEIHDKMMSINKKEVVQNDIPPESMDAMRPVQQHLPTRTSTPXSKMNNLPKDAQNMEVSTPVPPINPEGNDEDETPKNTVSRNGGFLQNAVGQDLVHLGVARTASGCPSXVASGVSTRHQHNRMDLDPASSSVDNFKTPELTKENGLEEDGKGESSMYDERQPKRRKRTLMNNEQIDELEKALVDEPEMHKNPVLLQSWSEKLSLQVLIVECILIYGKYGRALVGPRDHNITT

SEQ ID NO: 14487 - protein, 268 aa, Unknown
  uncultured marine bacterium
QPNAMGGREVGGLANQLAVHMDIDNVQDQKDLKTFWQSPTMCEKQGLKAVDLFNAIGDGKVKAVWIMATNPVVSLPDADKVKSALSNCELVVVSDCIAETDTTAFAHIKLPATTWGEKDGTVTNSERRISRQRSFLSPPGQARHDWRIICDVAKRMGFGEQFDYQGPVDIFREYAKLSDYKNDGKRDFDISLVADISEEGYDNWTPTQWPITRRAPTGTQRMFDDGRFFTPDKKARFIPVTAALPANASDSDFPLTLNTGRSRDQWHT

SEQ ID NO: 14488 - protein, 571 aa, Xylella fastidiosa
MRRSFVCGDIFAVDSLYVSPSAICRAATPCAFNPPLQEIVMFDESLKAQLKAYLDRVIRSIHIHASVDESHKSREMLDLLENIVLLSGKKVVLEVHRDDDQRKPSFGLGTPGESISIRFAGLPMGHEFASLVLGLLQVGGHPPKVADDLIERVRNLDGHYRFETYFSVSCQSCPDVVQALNMAAVLNPQIEHVAIDGALFQDEVEARQIMSVPTVYLNGELFGQGRMTLEQIVAKLDSGAAKRTAESIQAKAAFDVLVVGAGPAGTAAAVYAARKGVRTGLVAERFGGQVLDTMTIENFISVPETDGPRMVAALEQHLRQYEVDIMNLQRVETLVPAGENGFIEVRLASGASLSSRTVILSTGARWRQMNVPGEDEYRNKGVAYCPHCDGPLFKGKRVAVIGGGNSGVEAAIDLAGIASYVTLLEFDTKLRADEVLQRKLRSMSNVEVIMGAQTTEVRGDGKKVTGLVYVDRSTGGSFTLALEGVFVQIGLLPNTEWLKGRVELSPRGEIVVDECGHTSLPGVFAAGDATTVPYKQIVIAMGEGSKAALSAFDYLIRNVVEITGIAQAQAA

SEQ ID NO: 14489 - protein, 268 aa, Unknown
  uncultured marine bacterium
QPNAMGGQEVGGLANQIAAHMDIANDKHRDLVTRFWNAPNIATEDGLKAVDMFAAIERGDIRAVWIMGTNPVVSMPEANGVRQALEKCDLVVVSDLFANTDTAAVADVCLPALGWGEKEGMVTNSERRISRQRKFLTAPGEARADWRIICDVATRMGYSEAFQFSSVDEIFREHAALSAFENNGSRDFNLELAQNLSSQAYEDWQPIQWPFTATSPTGQKRMFSDGQFFTAHKKAKMLPVAAPVTPSQPDQDYPFVLNTGRIRDQWHT

SEQ ID NO: 14490 - protein, 196 aa, Zea mays
  misc_feature (23)..(23): Xaa can be any naturally occurring amino acid
  misc_feature (60)..(60): Xaa can be any naturally occurring amino acid
  misc_feature (77)..(77): Xaa can be any naturally occurring amino acid
  misc_feature (177)..(177): Xaa can be any naturally occurring amino acid
MATSSARGYRQSKNKSYPKHRHXPSVPDPKTTIYNDAMIRMADDQLPYCLHIVSSHKVNXVPGKVLRLCRIACNKYXTLLHATTTSSFSPHTALLVLMPLLINRHAFLCAGADKLQTGLVRGAFGRASMSTCAMADMAQARPFCVDREDNSAALAIAPLLRAKIKFPERRKIIGRRXRGFTEFSLSSHYLKYKKLA

SEQ ID NO: 14491 - protein, 268 aa, Unknown
  uncultured marine bacterium
QPNAMGGREVGGLANQLAAHMDFTPDAIDRVQRFWQAPNMATQPGLKAVDLFNAVEQGKIKAVWIMGTNPVVSMPNADQVKRALQGCPLVIVSDCIASTDTTALAHVLLPAAGWGEKDGTVTNSERRISRQRALVECAGEARQDWRILADVATAMGYGETFAYRSNADIFREHVALSSFENDAAGFRQFNLAALKNITDTAYDSLQPVQWPLLQPEQGTQRLYADGFFSTADGKARFIAVSVRAPANAPDADWPLILNTGRVRDQWHT

SEQ ID NO: 14492 - protein, 958 aa, Bdellovibrio bacteriovorus
MKIADLSPTNEFIPRHIGPTDSDIHEMLKTLGFNSLDQMADKVIPAQIRTTHAYADVGNGISEHGLLNHLKQMVSKNKVYKNYIGMGYHDTITPTVIQRNIFENPVWYTAYTPYQPEISQGRLEALLNFQTMIADLNGMEIANASLLDEGTAAAEAMFMAHSLCKNKANAFVVSPDMHPHVIEVIGTRAEPLGFEMIVMDPAKYDFAKPVFGVFFQYPNTNGTVEDYAAIAKKYKDHGALVTASTDLLAMTLLTPPGEWGADMVVGNSQRFGVPLGFGGPHAGFLATKDAFKRLMPGRLVGVSVDSQGKSALRLALQTREQHIRREKATSNICTAQVLLANMASMYAVYHGPAGLKKIALRVQRLTAILSAGLKKLNLEVGAGHVFDTVTVKTDKAAEIIAQAEKMQMNFRNYGGGKLGVSLNEATTLEDVEQIWAAFNLGKAAGFTALSVDESLADVTLPANLTRSTAYMTHQVFNSHHSETEMLRYIHHLQNKDLTLTHSMIPLGSCTMKLNATTELVPVSWPEISKLHPFAPTAQAVGLIEMIHDLEKKLCDITGFAAVSLQPNAGSQGEYAGLLVIRKYHQSRGQGHRNICLIPSSAHGTNPASAALVNMQVVVVACDDQGNVDVADLKAKAEQHKDNLAALMITYPSTHGVFEEGIVEICKIIHDNGGQVYMDGANMNALVGMCRPGVFGPDVSHMNLHKTFSIPHGGGGPGVGPIGVGAHLAEFLPKHSLVPEAGPANGISATTSAPWGSASILPISWAYITMMGAQGLRKATLVSILSANYIAKKLEAHYPVLYKGKNGLVAHECIVDVREIKKTSGIDVTDVAKRLMDFGFHAPTMSFPVAGTLMIEPTESESKKELDRFIESMVTIRKEIAAVETGKMDKENNALKNAPHTAQMLMKPEWNHPYSREEAVYPVEWLRGNKFWPVVGRVDNAYGDRNLICSCPSIEDYQA

SEQ ID NO: 14493 - protein, 287 aa, Oryza sativa
MPPPSPPLFLSLPSPPPPPLPHLLPSHRPAAALTLAPALSSRRVSSVCPVASQRHSDYFDPRAPPPPPPRDGYGGPAYSPPAAQGGQQNGRVFSTYSIYKGKAAMSLDPRPPQFVPLDVGRGGAAACELRDCESGAYKVVKEGFVLLQFAPAVATRQYDWTRKQVFSLSVWEMGSLLTLGPTDSCEFFHDPFKGRSDEGKVRKVLKVEPTPDGNSRFFNLSVQNRLLNIDENIYIPITKGEFAVIVSTFNYIIPHLMGWSTFTNSIKPEDSRAYTRPQSGPEYEWRR

SEQ ID NO: 14494 - protein, 260 aa, Unknown
  Cytophaga sp. AEA-2001/3
QPNAMGGRKVEGMASLLAAHRDLGNPRHREEVRQFWGGKEINGEPGLTATEMFDALESGKMKAIWITCTNPIVSLPNAKKIEKALEKANFVIVQDISHNSETTKYADLLLPAAGWLEKEGTMTNSERRISYLPKVIDAPGEALPDAEILWRFAQKMGYGGFDYNNVSEVYDEYCLMTKGTNIDISGLSHERLQKEGSFQWPVPSPEHKGTPRLFQDQKYFTANGKVHFNAPRNLYNKSEITTTDFPLVLNTGRVRDQWHT

SEQ ID NO: 14495 - protein, 341 aa, Gibberella zeae
MASIIDTVKNTIAENFGGPAEQLATHQFSLSETPNLSGKVAVVTGGSEGIGYGVTHTLLTHDISKIFILSLSKEVVEGAKKSVAEELGQEKADRTEWVQCDLSNWAEVKKAADQIKDSTDRLDILVNNAGRGIQTYQLSSYGVDQHMATNHFGHVLLTSYLLELLKKTSEKHGIVRIVNQASNAHQGAPSDVKFESLEELNTDLGPNPQYGRSKLANILYTRYFDRNVTKAGSPKILMNATHPGFVSTRQSLEHIHEAYPLAGYAMSVGMEPFKKDQFQGATSAMYAATMTDKSGQYICPPAVPELGNEKSQDEKLGDQLMELTRKIISEKFESFDDRKFY

SEQ ID NO: 14496 - protein, 601 aa, Burkholderia thailandensis
MDAGRRHAHAVARPDRQDLTPHGGTAAVCAARRRVVRGPLPAPLAPRPPRPHTAGQYLLRYGIRIVMLDANLKTQLKSYLERITRPVELVASLDDGDKSRELRALLDEIASLSPQVFVVERRDEAERAPSFSVGEPGEAARIRFAGIPMGHEFTSLVLALLQTGGHPVKLDDATIEQIRALDGDYTFETYISLTCQNCPEVVQALNVMALVNPRIRHVMIDGALFQDEVDARRIMAVPTIFLNGETFGQGRSSVREILAKLDSGASRRAAQALAAKPVFDMLIVGGGPAGAAAAIYAARKGISTGVVAERFGGQVLDTMAIENFVSVTETEGPKFATALEQHVKQYEVDVIDVQRADRLVPGSLHEIRLASGAVLKAKAVVLATGARWREIGVPGEREYRNRGVAYCPHCDGPLFKGKRVAVVGGGNSGVEAAIDLAGIVSEVTLIEYGAQLRADEVLQRKLRSLPNVTVLTHARTTELAGDGARLNALVYEDMRTGETKRIALEGVFVQIGLVPNTEWLKGTVELSKHGEIVVDARGATSVPGVFAAGDVTTVPYKQIVIAVGEGAKASLGAFDYLIRSDADAVQPADADAPASAEVVAA

SEQ ID NO: 14497 - protein, 450 aa, Kineococcus radiotolerans
MTSVLWFRRDLRLSDHPALLAAAADGDVLPLFVIDPALWGPSGDVRRTYLLRSLRSLDAALGGALVVERGDPAVVVDRVAARIGASRVHVTADAGPLGRRRDDAVGRALAAGGRELVRTGTPYAIGPGTLRTGSGSPFQVFTPFSRAWRAHGWPAPADSPGAVRWVGDGEGVDGGHWPDEPDLGGLTLPEAGEDAAHERWHRFLDHALADYDGDRDRPDRDGTSQLSHALKWGELHPRTLLAALRGQSSKGAETYATELCWRDFYADVLWHRPDSAREYYKPQLAGLRYAEPGEQFRAWAEGRTGFPIVDAGMRQMRAVGWVHNRVRMITASFLVKDLHVEWQHGGREFMHWLRDADLASNMHGWQWVAGSGTDASPFFRVFNPVTQGQRFDPDGDYVRRFVPELRHLPGKSVHTPWEAADGYAHGYPERIVDHAHEREVALAEYARVRG

SEQ ID NO: 14498 - protein, 763 aa, Gibberella zeae
MSAPNPRKRAAPGASPIVPIPQQMQPQYNAGNGAGNQGPRWTGMDPSNYMNGVDGLMDDNKNSFGLVPAQQQYSQPVPTPSNTIARRQMNHALVPTNQRSFDGVVEPWGNFVGDENTLLQGNFENLNEQDNVEVLEERAQKAKRDAQAKRKQIPPFVQKLSSFLEERKNEDLIRWSEKGDSFIVLDEDEFAKTLIPELFKHNNYASFVRQLNMYGFHKRVGLSDNSMRASERKNKSPSEYSNPYFRRGHPNLLWLINKPKSGSKAKKGSKGAEGDNDSEDDVANEEVLTSGLGPTAAQPPRSLPAGESQPAPKKEMGLIREELSKVRDQQKLILGAINRLQRNNTELYNQALMFQTQHDRHQNSINAILNFLANVFRKTLEDQGNSQNVSDIISMITNQNQQSAQHGSVFELGDYIQQMNPNTYGTPKKTRGLLPAPQQNNRAQAVRSSSTPNRSTPGSTAYQPVSHHNHNPEMGHVTELVDNSPSDTTTPNLRQELEANPEERMMSLINEHNKHNNGHGMDIPDAADLVASAPNALSNAQRNNLANFIAGQTSAAPSGRSTPASTPVSATPIPTPTQIPTSNSHMAMPTMSTSASVSPPPASSVPPPSLSPIMGPPMVPPSINEINSNSMELNHLQRLQSQQDAKISEIGSMLGPLSPSGHVPGLSDDAAAYFDPQSTDFDQFFDIGDLSGGHDFTDGSDFDFAIDTDPNHQNQAPLHPGHVMSHTSLTNTPSPAGTEEISRDDLRLENNPSDRGTKRQRIA

SEQ ID NO: 14499 - protein, 545 aa, Thellungiella halophila
MAMLASYFDSFISKMPSLSTSDHASVVSLNLFVALLCACIVLGHLLEENRWMNESITALLIGLATGVVILLISKGKSSHLLVFSEDLFFIYLLPPIIFNAGFQVKKKQFFRNFVTIMLFGAIGTVISCTVITLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGVATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDSPGTSVAVSSILIGLLMLGRAAFVFPLSFLSNLAKKNESEKINFKMQVVIWWAGLMRGAVSMALAYNKFTRAGHTDLRGNAIMITSTITVCPFSTVVFGMLTKPLIRHLLPHQKATTSMLSGDNNTPKSIQIPLLDQDSFIEFAGNHNVPRPDSIRGFLTRPTRTVHYYWRQFDDSFMRPVFGGRGFVPFVPGSPIERDPPDLSKA

SEQ ID NO: 14500 - protein, 317 aa, Oryza sativa
MWGLLRRRSPSGFSPSSTAEEVTAGIDGSGLVALITGASSGIGAETCRVLVMRGVHVVMGVRNLSAGACVRDEILKQVPSAKIYILNLDLSSMSSVRRFAENFKALNLPLNILINNAGVCFVPFKLSEDGIELHFATNHVGHFLLTDLLIEKMKVTAIESGKEGRVVMVASIKDEKTDLYKDMTFNYIFLFSLARYNRFLAYGQSKLANILHSNLLSSHLKEQDAKVIVNSLHPGAVATNILHHWCPLYGAIRAIGKYFVKGVEQGAATVCYVALHSQVAGVTGKYFSDCNITELKSHALDRDLAKRLWDFSLSLIR

SEQ ID NO: 14501 - protein, 219 aa, Magnetospirillum magnetotacticum
MLLFRKRPEMPAPSEALPGRPEALPTAERHFVNGQPLKGPYPEGIETVVLGLGCFWGAERKFWQLPQGIHVTAVGYAGGYTPNPTYEEVCTGRTGHNEVVLVAFDPAVLPLEAVLKTFFESHDPTQGYRQGNDVGTQYRSGIYTTSEAQAQTARAVRDTYARALDAKGYGPVTTEIVPLETFFFAEEYHQQYLAKNPGGYCGLGGTGVSCPVGVGVAAE

SEQ ID NO: 14502 - protein, 488 aa, Ashbya gossypii
MVHLGPKKPPTRKGSMADVPKTLVEQIASFERIFTVSAEKLQEITKHFVTELDKGLSKKGGNIPMIPGWVMDYPTGNETGDYLAIDLGGTNLRVVLVKLLGNHQFDTTQSKYRLPNRMRTTQNASELWDFIAESLKDFLEEQFPEGVHQTLPLGFTFSYPASQDKINMGILQRWTKGFDIPGVEGHDVVPMLQESLRKVNVPIEVVALINDTTGTLVASLYTDAETKMGVIFGTGVNGAYYDVVKDIEKLEGRLPEDIPPESAMAINCEYGSFDNEHLVLPRTKYDILIDEQSPRPGQQAFEKMTSGYYLGEVLRLALLDLHGQGLIFQGQDISKLETPYVMDTSFPARIEDDPFENLEETDDLFKDNLDIDTTRPERKLIRKLSEMIGNRAARLSVCGIAAICQKRGYETAHIAADGSVFNKYPGFQTRAAEGLRDIYGWEHSSSQDYPIKIVAAEDGSGAGAAVIAALTTKRLAAGKSVGLPEAQN

SEQ ID NO: 14503 - protein, 279 aa, Oryza sativa
MDFKTQCASSGIGAETCRVLAMRGVHVVMGVRNSSAGARVRDEIARQVPAAKIEMLDLDLSSMSSVRRFAENFNALNLPLNILVNNAGIAFVPFKLSEEGIELHFSTNHLGHFLLTDLLLEKMKVTAIESGIEGRVVIVASDSYKHPYREGIRFDKINDESGYYFLTQRILFFTFIYLFNRSKEQDAKVTVNSLHPGAVVTNIMRHWYFVNGMLSTLGKFFVKGVEQGAATVCYVALHPQVAGVTGKYFVDCNVTELKSHALDMDLAKRLWDFSLNLIH

SEQ ID NO: 14504 - protein, 236 aa, Arabidopsis thaliana
  misc_feature (160)..(160): Xaa can be any naturally occurring amino acid
MSSYSIASAISRISPLIRFVKPYSTGFSFITCACNSTRRPKRFDQLCVFSMASEARESPANNPGLSTNRDEATKGYIMQQTMFRIKDPKASLDFYSRVLGMSLLKRLDFSEMKFSLYFLGYEDTTTAPTDPTERTVWTFGQPATIELTHNWGTESDPEFXKGYHNGNSEPRGFGHIGVTVDDVHKACERFEELGVEFAKKPNDGKMKNIAFIKDPDGYWIEIFDLKTIGTTTVNAA

SEQ ID NO: 14505 - protein, 362 aa, Enterococcus faecalis
MKKARVIYNPTSGKELIKKNLADILSILEECGYEASAFATTPEENSARNEAHRAARAGFDLLVAAGGDGTINEVVNGIAPLKRRPKMAIIPAGTTNDYARALKIPRDNIVKAAEVIKKNQTVKMDIGQAGKNYFINIAAGGHLTELTYEVPSELKSIFGYLAYLAKGAEMLPRVKPIKMRMTYDEGVYEGNASMFFLGLTNSVGGFEQIVPDAKLDDGKFSLIIVKTANIFEILHLVALMLNGGKHVEDHRLIYTKTSYLHAETLEKNNKMMINLDGEYGGDAPMTFKNMHQHIEIFANGDALPSNAIMGSVLTGSDEIVVESEDEEEEAYNEASKEFVKEVERLTDEDIDGDGKIAEKEKH

SEQ ID NO: 14506 - protein, 457 aa, Enterococcus faecalis
MKNYPVKKNDVIEVEIIDLTHEGLGVAKVDHYPLFIENALPGEKLEIKVLKTGKSFGYGKVLTVLKSSEQRVPVKDENFTKVGISPLQHLAYGAQLSFKTQQVENVMQRVAKLQEVPVLPTIGMNDPWHYRNKAQIPVRKIDNQLQTGFFRKNSHDLIPMEHFYIQDPEIDAAIVKIRDIMRKYSVKPYNESDNTGNLRHIVVRRGYHTGEMMVVLITRTPKLFPISKIVPDILEAIPEVVSIVQNVNPKRTNVIFGDETILLHGSEKITDTIFDLKFEISARSFYQVNPQQTEVMYQKVKEYAALTGNEIVVDAYCGIGTIGLTLAQDAKQVYGIEVIEEAVKDAENNAKLNNIENATFTAGLAEELLPKLVENGLQPDVVVVDPPRKGLDGQLVNTLIETQPERIVYVSCNPATLARDIALLTEGGYEAKEIQPVDNFPQTTHIESVTLLTKAVD

SEQ ID NO: 14507 - protein, 449 aa, Clostridium tetani
MNKITVDLNNTKPYIKDEEIKALEPFIKEAHKMLHEGSGLGNDFIGWLDLPINYDKDEFQRIKKASNKIKANSDILLVIGIGGSYLGARAAIEMLSHNFRSLLKKEDKEGTDIIFVGNSISSTYMAELLEVIKDRDFSINVISKSGTTTEPAIAFRIFKEILENKYGIEEAKNRIFVTTDKSKGALKTSSDKQGYETFVIPDNVGGRYSVLTAVGLLPISVAGINIDEMLKGAYDAREDFMYDNIEENQCYKYVAARNALYNKGKNTEILANFEPSLHYFGEWWKQLYGESEGKEGKGIFPASVSFSTDLHSMGQYIQEGLRIIFETFINIEKPRKDLEIKSEKENLDGLNFLSGKTVDFVNKQAFRGTVLAHNDGEVPCIVINVPEVSPYYFGYLVYFFEKACGISGYILGVNPFDQPGVEAYKKNMFALLGKEGFEDRKKELEKRMN

SEQ ID NO: 14508 - protein, 484 aa, Unknown
  Azoarcus sp. EbN1
MSIEFLINFTPQETRVAIVEQGVVQELHVERTASRGIVGNIYLGRVVRVLPGMQSAFIDIGLERTAFLHVADIWSDRHNGDAGRPIERILAEGQNLTVQVLKDPIGTKGARLSTQISIAGRLLVYLPQEKHIGISQRIEDESEREALRERLTRLVPADEAGGFIVRTMAESASDDELGADIGYLRKLWSEIRNSATGRFPPSLLYEDLGLGQRVLRDLVDDDTSRILVDSRENHQKLTAFAAEYSPKVLPLLEHYSGERPLFDLHNVEDEIQKALARRVSLKSGGYLIIDQTEAMTTIDVNTGGFVGARNFDDTIFKTNLEAAQTIARQLRLRNLGGIIIIDFIDMENVEHRDMVLDEFQKALARDHTKMTVNGFTALGLVEMTRKRTRESLAHLLCEPCPTCDGRGEVKTARTVCYEILRELLREARQFNAREFRVLAAPNVIDLFLDEESQSLAMLSDFIGKQISLHPEASYSQEQFDIVLL

SEQ ID NO: 14509 - protein, 468 aa, Klebsiella pneumoniae
MSKQQIGVVGMAVMGRNLALNIESRGYTVSVFNRSREKTEEVIAENTGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPVGDKAGFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTVSAAIAYYDSYRSAVLPANLIQAQRDYFGAHTYKRTDKEGVFHTEWLE

SEQ ID NO: 14510 - protein, 592 aa, Hordeum vulgare
MQTLTASSSVSSIQRHRPHPAGRRSSSVTFSARAVSSAPRAPAPSRFVRGADAAPAKPLIAVPKPPAVERQEKKLNFFQRAAVTALDAFEEGFVANVLERPHGLSRTVDPAVQIAGNFAPVGETPPVQALPVTDRIPPFINGVYARNGANPHFDPVAGHHLFDGDGMVHALRIRNGVAETYASRFTETERLQQERALGRPMFPKAIGELHGHSGIARLALFYARAACGLIDPSRGTGVANAGLVYFNGHLLAMSEDDIPYHVRVTDDGDLQTVGRYDFDGQLECPMIAHPKLDPATGELHALSYDVIKKPYLKYFYFAADGTKSADVEIPLDQPTMIHDFAITENYVVVPDHQVVFKLQEMLRGGSPVVLDKEKTSRFGVLPKCAADASEMVWVDVPDCFCFHLWNAWEEEETDEVVVIGSCMTPADSIFNESDECLESVLTEIRLNTRTGESTRRPILALSEQVNLEVGMVNSNLLGRKTRYAYLAVAEPWPKVSGFAKVDLATGELTKFEYGEGRFGGEPCFVPMDPATSRGEDDGYILTFVHDEAAGTSELLVVNAADMRLEATIQLPSRVPYGFHGTFITGKELESQA

SEQ ID NO: 14511 - protein, 258 aa, Glycine max
MAAATSSAVLNGFGSHFLCGGKRSHALLAASIGGKVGASVSPKRVIVAVAAAPKKSWIPAVKGGGSFIDPEWLDGSLPGDYGFDPLGLGKDPAFLKWYREAELIHGRWAMAAVVGIFIGQAWSGVPWFEAGADPNAIAPFSFGSLLGTQLLLMGWVESKRWVDFFNPDSQSVEWATPWSKTAENFGNSTGEQGYPGGKFFDPLGFAGAIKDGVYIPDADKLERLKLAEIKHARIAMLAMLIFYFEAGQGKTPLGALGL

SEQ ID NO: 14512 - protein, 499 aa, Photobacterium profundum
MVFRFRRSQSASVKESMMKGDIGVIGLAVMGQNLILNMNDHGFKVVAFNRTVAKVDEFLAGPAKDTNIIGATSLEDLVANLEAPRKVMLMVRAGDVVDHFIDSLVPLLDKGDIIIDGGNSNYPDTNRRVADLEAKGIYFVGTGVSGGEEGARFGPSIMPGGSPEAWPHVKPIFQVISAKTDQGEACCDWVGKDGSGHFVKMVHNGIEYGDMQLISEAYHFMKEGLGLSYDEMQAIFKEWNDTELNSYLVEITADILGYRDEDGEPLLEKILDTAGQKGTGKWTGINALDLGIPLTLITESVFARCLSAIKDQRVEAEALFGKTIQPIDGDKKEWVDALRQALLASKIISYAQGFMLIREASEENNWSLNYGNVALMWRGGCIIRSAFLGNIRDAYEATPDIKFLGTDPYFKDILVDSLPAWRKVAAKAMEVGLPMPTMTSALTFLDGYTTGRLPANMIQAQRDYFGAHTYERLDQPRGQFFHTNWTGTGGDTASTTYDV

SEQ ID NO: 14513 - protein, 175 aa, Bacillus cereus
MNIEIKDTLISEEQLQAKVKELALQIERDFEGEEIVVIAVLKGSFVFAADLIRHIKNDVTIDFISASSYGNQTETTGKVKLLKDIDVNITGKNVIVVEDIIDSGLTLHFLKDHFFMHKPKALKFCTLLDKPERRKVDLTAEYVGFQIPDEFIVGYGIDCAEKYRNLPFIASVVTE

SEQ ID NO: 14514 - protein, 335 aa, Cytophaga hutchinsonii
MQKKVDATKIAVIGGGSWATALVKILSEQNVRINWWLKNKKDVDYILQHGKNPNYLSNVPIDTKKVTPTTNVRKALEGASVVIFVVPAAFIGEVLETIPAADLKDKIVVSAIKGMIPSENILVTDLLQKTHAVPSQKICIIAGPCHAEEVALEKRSYLSIAGEDFTAASVVADLLQCGFVKATVVEDLYGVEYCAVMKNVVAIACGIARGLNYGDNFQAVLVSNAMLEIELFVDALSKKERNWNASAYLGDLLVTCYSPYSRNRTLGNMVGRGYSVKAAQVEMNMIAEGYYAVKCVYELNKKLHVQMPITKAVYNILYEKISPSVELRILEDSMC

SEQ ID NO: 14515 - protein, 1041 aa, Unknown
  Polaromonas sp. JS666
MKRMLVNATQAEERRLAIVDGQKLLDYEIEIEGREQRKGNIYKAVVTRVEPSLEACFVDYGEDRHGFLPFKEISKQYFAQGVPVSQARINDVIREGQELLVQVEKEERGNKGAALTTFVSLAGRYVVLMPNNPRGGGVSRRIEGDDRAELKEAMDQLEYPNGMSIIARTAGIGRSAPELQWDLNYLLKLWTAIDGAGKGGKGAFLIYQESSLVIRAIRDYFNSDIGDILFDTDDVYEQARQFMAHVMPEHEHRVKRYRDDAPLFSRFQIEHQIESAYARTVQLPSGGAIVIDHTEALVSVDVNSARAIKGGDIEETATRTNLEAADEVARQMRLRDLGGLIVIDFIDMEESRNRRDVENRLRDALRQDRARVQFGTISKFGLMEMSRQRLRPALSEGASIPCPRCGGSGHIRDTESSALQILRVIQEESLKDSTASVLCQVPVDVASFLLNEKRSEIGKIELKQRINVLLVPNKTLETPNYRLERLKHDDPRLDNIEASYKLADEVEDPTTVTRRSQEKHNKQEPVIKGVLPDAPAPIAPPKPEPVAPAAKAAPRPAPAAPAHVAAEKGFFGWIKSLFGGTEAPAAAPAAEVKKDERSGEARREGRDGRGERGERSERGGRDGRRGGRSRGEGRGEGRGEARPESRPEGRGDRGEGRGGERRERSPEARGEGARQERPAGEARAEARPENRGEGQPRSEGRTDGRGEGRGDRSRRERGERGDRIPRDAAEQDLALANQAAMAAAMGGDAAVQGQDRPAQEAGRDGDRQQGGREGRGEGRRERGERGGERGGRRNDRRGERTEGQGPAADTAGNTVSGEAAPMAAVALDETGQTLTQNQNGQGDSPVDEQRQPRERRSRDRYGRDRRERGEERAESGERSEQAAESATAPASSEQNQAPALEERAPVATEFVASSVAPVAASAPAPAYTAPMAAAAPVATPVPVPVPVPAPAAASIMLPKVQAYALPLQDLAQVAESSGLQWVNSDAAKIAEAQAAIAAEIKPVHVPRERPPLAVSDEGPLVLVETRRDLGSMAQPFEQPSA

SEQ ID NO: 14516 - protein, 352 aa, Arabidopsis thaliana
MGELDEAFIQAPEHRPNTHLTNSGDFIFSDEIPTIDLSSLEDTHHDKTAIAKEIAEACKRWGFFQVINHGLPSALRHRVEKTAAEFFNLTTEEKRKVKRDEVNPMGYHDEEHTKNVRDWKEIFDFFLQDSTIVPASPEPEDTELRKLTNQWPQNPSHFREVCQEYAREVEKLAFRLLELVSISLGLPGDRLTGFFNEQTSFLRFNHYPPCPNPELALGVGRHKDGGALTVLAQDSVGGLQVSRRSDGQWIPVKPISDALIINMGNCIQVWTNDEYWSAEHRVVVNTSKERFSIPFFFFPSHEANIEPLEELISEENPPCYKKYNWGKFFVSRNRSDFKKLEVENIQIDHFKA

SEQ ID NO: 14517 - protein, 271 aa, Unknown
  Marinobacter sp. AEA-2001/5
QPNAMGGREVGGLANTLAAHMDYDSPGARSRVADFWGTGTVADGPGLKAVDMFEAVHRGDIRVIWIMGTNPAVSLPDSARVREALARCPTVIVSDCVAHTDTTDLADILLPAAGWGEKDGTVTNSERCISRQRCFLPLPAEVKPDWWIMSSVAGKLGFGEAFNYKRPADIFREHAALSAHENNGERLFNLAGLANLSDAGYEALIPVQWPVMEGAGMEAEGSTRLVFRWPFCHRQPACPLCRHQHPIARQRTSDDYPMVVNTLRIRDQWHT

SEQ ID NO: 14518 - protein, 267 aa, Unknown
  Pseudoalteromonas sp. AEA-2001/6
QPNAMGGREVGGLANQLAAHLDIENEAHQSLVQRFWLAPTIAKKAGSNAIDMFDEIAAGKIKAVWIMATNPMVSLPNNTAIKKALETCELVVVSDCIAKSDTLKFADVAFPSTGWGEKNGTVTNSERRISRQRPLVAPYSGAKNDWQIMCEVAKKMGFEGFDFTDPSGIFEEWAQLTDFENNGSRVLNLSGLVGLTKSQYDNLKPIMWPVVKNQPYKNGQVFTDNQFSTADKKARFIPITPQLPIQQTSSDYPFVMNSGRIRDQWHT

SEQ ID NO: 14519 - protein, 319 aa, Geobacillus stearothermophilus
MKRIGVLTSGGDSPGMNAAIRSVVRKAIYHGVEVYGVYHGYAGLIAGNIKKLEVGDVGDIIHRGGTILYTARCPEFKTEEGQKKGIEQLKKHGIEGLVVIGGDGSYQGAKKLTEHGFPCVGVPGTIDNDIPGTDFTIGFDTALNTVIDAIDKIRDTATSHERTWVIEVMGRHAGDIALYSGLAGGAETILIPEADYDMNDVIARLKRGHERGKKHSIIIVAEGVGSGVDFGRQIQEATGFETRVTVLGHVQRGGSPTAFDRVLASRLGARAVELLLEGKGGRCVGIQNNQLVDHDIAEALANKHTIDQRMYALSKELSI

SEQ ID NO: 14520 - protein, 258 aa, Unknown
  Vibrio sp. AEA-2001/7
QPNAMGGREVGGLANQLAVHRGFDDESIAKVEQFWQAPNMATEPGLKAVELFDVVSRGDIKVLWIMATNPVVSMPNSIEVRKALKACDFVIVSDISADSDVAEYADLLLPAAGWGEKQGMVTNSERAISRQRQFRPIPGEAKPDWWAINQVGQKWCAQNHWQNGFGFQTPAEIFREYAALTGINRKSRFQLDLSMFQTLSDSDYQNWQPTQWGGERPFTDHQFSTPLGKAQLVVTKPLKRDVSGLWLNTGRLRDQWHT

SEQ ID NO: 14521 - protein, 257 aa, Unknown
  Vibrio sp. AEA-2001/8
QPNAMGGREVGGLANQLAVHRGFTSEDISAVAQFWQAPNVATQPGLKAVDLFSAAERGEIKVLWIMATNPAVSMPDNQQVRRALEKCDFVIVSDITADTDTARYADLLLPASGWGEKHGMVTNSERRLSRQRQFLPAPGETRPDWWQIARVGSALCDYLGVADAFDYSTPAQIFREFAAMTGLNSGTPLKLDLSQFAHLSDEAYDNWLPWQWGGNKPFGDHHFSTDTGKARFAVTVPCVRRSDLWLNTGCQRDQWHT

SEQ ID NO: 14522 - protein, 674 aa, Unknown
  Synechococcus sp. CC9605
MCGIGGVFNADRQQTVDRQLLVNMAAIQAHRGPDGFGVEVLDQAGVGFCHARLSIIDLNESRARQPFLTDDGEVLMAHNGEFYDFQRIRADLTAQGVRFSSKSDSEILLRLYQRQGLEATLPLLRGEFAFALFDRSEDCLYLVRDRFGIKPQYWAITPEGLVFGSELKVLFAHPAVERRFTSEGLFHQLMQTMVPGTTAFAGVHQVKPGHVLKVQRVNGHLEVSESTYWDVDFPRKDERDPKRTEADYIAAVRAALLEAVELRMVADVPVGCYLSGGIDSCSILGLASAVSQAPVKAFTIGFDDARYDESPIAREMAEATGAEQDLMRLSGQELYGHMERTIWHAERTIYNTLAVAKFLMSRHVNDVDYKVVMTGEGSDELFGGYPAFRRDMFLHGLDDLPQEERASWESLLQQSNALVKGAMLAENQVDDPDLDAVVGFTPSCLQPWLACAPLVPELLAESHAAALEGYSPGKAIAEQLDADQLDGRHALDKAQYVWIKTMLEGQILTWGGDRVDMANSMEARPAFLDHHLAAVAVQVPPELRIKGKTEKYVLREAMAGLLPEVLYRREKFAFMAPPAHTEPEKWGQMKQLADDYLSDEAIDSAGLLSKAGVLALFERHEDPATTDAERVQMDAVINHLLGVQMLHRMFVAEDVPALARREADRLGWRVLMPV

SEQ ID NO: 14523 - protein, 261 aa, Unknown
  uncultured marine bacterium
IAATNPAVSMPDLERTKAALLQSPFTVYQDAYYPTETAEYAHLLLPAAQWGEKTGTMTNSERMVTFCLAFREPLGEAKADWEIFAEVGRRLGFTNQFNFADSEAVRAEFLEFTRDRPCDMTGITYQRLQEQGPTQWPCPDSSGVSQERLYTDLQFNTPDGKARFAAYYSQGLAEPPNPDYPFVLTTGRLYAHWHTQTRTGHIEKIRKLHPLPFIEIHPQDAQRLEISEKDWVEVRSRRGYSRFPAKITRSITPGTVFIPMH

SEQ ID NO: 14524 - protein, 427 aa, Moorella thermoacetica
MFCYQCEQTAGGSGCTRVGVCGKNEDIASLQDTIIIGLKGIAAYAYHAGELGARDPEVDAFMHEALFTTLTNVDFDLNRHIETALKVGAMNLRVMELLDRAHVERFGAPEPTKVSTGTKAGPGILVTGHDLLDLYELLRQTEGTGINVYTHGEMLPAHAYPELKKFPHLVGNYGSAWQNQKKEFEDFPGAILGTTNCVLIPKESYRERMFTCGIAGLPGVTHIKNRDFTPVIEKAKSLPPLEEKAGGELTTGFHHQAVLKLAGQIIDAVKAGKIRHFFLVGGCDGAKPGRNYYTEFVEKVPKDCVVLTLGCGKYRFNHLDLGDIDGIPRLLDMGQCNNAYSALQVALALADAFKCSVNELPLSLVLSWFEQKAVAILLTLLHLGVRNIRIGPSLPAFLTPGVLKVLQEKYNLKPITTPEQDLKEILG

SEQ ID NO: 14525 - protein, 441 aa, Pasteurella multocida
MNIYTYICFLSAISIFIGFVTRKLSDKIQYTIAITATSIIVSVLFLIFGHLSWFKLDIIATQVMEQLDFKSFLLNGILGFLLFAGALGIKLPVLKNQKWEITVFALFSTLASTFIIGVLLYSVAYLIGLPIDLIYCILFGALISPTDPIAVLAIIKNLKAPKRLSMQVEGESLFNDGVGLVIFTTIFAVAFGGHAPTLAGITELFLQEAVGGILFGLVIGFVAHLLISSTDDGSLEILLTLTIPTAGFMLANMLHVSGALAMVVAGILIGNWTRHTGFSKQSQLYLDHFWEMIDHFLNSLLFLLIGLALLLVDFGAQGFILLILAIPICLIGRYISVWMPFKVMQRFRSYNPYTLRILTWGGLRGGLSLAMALSIPKGMLYLEHIGMDVRDLLLVMTYAVVTFSILVQGSTIETMIKKSKESILHQRGYVGLHPNKTSSED

SEQ ID NO: 14526 - protein, 374 aa, Methanosarcina mazei
MFRFADELGPFKIIHIYEPSIDLKAVLVVDNIARGPALGGVRIAPDVSAEECFRLARAMTLKNAAADLPYGGGKIVVYGDPKMPFEKKSQLLRALAGALRYTEEYIFAPDMGTDEICMACIKDEIGRVVGLPCEMGGIPLDEVGATGWGLFNATEVALKYCDFELKGARVVIQGFGAVGKHAARFLVRKGAVLVGVADSRGAVHNPEGLDVDSLIALKNEGKNVFEYPEGKKLASDEIVSVPCDIWIPAARPDVINGNNVHLLDTKLVVEGANIPLTGEAEKILYDKGILYVPDFIANAGGVICAASEHQKTTRSIVFGLIEEKVRSNTEQVLEASKTRGILPREAAFELAIKRVNRAMKYRRWSIFSSAPGFV

SEQ ID NO: 14527 - protein, 141 aa, Zea mays
  misc_feature (11)..(11): Xaa can be any naturally occurring amino acid
  misc_feature (25)..(25): Xaa can be any naturally occurring amino acid
  misc_feature (75)..(75): Xaa can be any naturally occurring amino acid
  misc_feature (83)..(83): Xaa can be any naturally occurring amino acid
  misc_feature (108)..(108): Xaa can be any naturally occurring amino acid
  misc_feature (122)..(122): Xaa can be any naturally occurring amino acid
RQNALARCYRXIENKAYPKSRYCRXVSPDPKIMIYDVGMKRKGVDEFPYCEHLVSCQKENDSRGGLVDDGIGCIXYLTYLALXDDFLLRVRLRALHGLRIIYMFSCAXADKVQIGMRGGFGXTQGICAMVDVVKVLLSVCC

SEQ ID NO: 14528 - protein, 162 aa, Brassica napus
MAATSASALLTPTTFSSTISQKHPNSISFHGLRPLRLGGSSSALPKLSTTSGRRSSSSAVVRAELSPSVVISLSTGLSLFLGRFVFFNFQRENVAKQVPEQNGKTHFEAGDDRAKEYVSLLKSNDPVGFNIVDVLAWGSIGHIVAYYVLATSSNGYDPSFFG

SEQ ID NO: 14529 - protein, 715 aa, Zea mays
MDFGDDVMDGGSDAQRRKKRYHRHTPRQIQQLEAMFKECPHPDENQRMQLSRELGLEPRQIKFWFQNRRTQMKAQHERQDNCFLRAENDKIRCENIAMREALRSVICPTCGGPPVADDYFDEQKLRMENARLKEEASRFAFTLDRVSSLTSKYLGRPITQLPPAQAALSMSSLDLSVGGLGSPSLDLDLLSGGSSGYPPFHLPMPVSEMERPMMAEMATRAMDELIRMAQAGEHLWVKAGGREVLNVDTYDSVFAKPGAASFRGPDVHVEGSRDSGLVFMSAVGLVDMFMDSSKWTEFFPAIVSKARTVDVLVNGMAGRSESLVLMYEELHVMSPVVPTREFCFLRYCRQIERGLWAIADISVDLQQHDARFGAPPSRSCRLPSGCLIADMADGSSKVTWVEHMEIEDRVPIHLLYRDLILSGAAFGAHRWLAALQRACERCACLVPAGMPHRDIAVAGVNLMRKLLTAVTPEGKRSMMKLSQRMVSSFCASLSASQLHRWTTLSGPSDVGVRVTVHRSTDPGQPSGVVLSAATSIWLPVPCDRVFAFVRDEHTRSQWDVLSHGNPVQEVSRIPNGSHPGNCISLLRGLNASQNSMLILQESCTDGTGSLVVYAPIDIPAANVVMSGEDPSAIPLLPSGFTILPDGRPGAPSSSSAGGPLVGSPAAAGSLVTVAFQILVSSLPSSRLNAESVATVNSLISTTVEQIKAALNCASH

SEQ ID NO: 14530 - protein, 738 aa, Saccharomyces cerevisiae
MHKERPLNKASMIRSPVDEIYMEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 14531 - protein, 362 aa, Neurospora crassa
MASESTILSNAENLKKFLRLPQNGQLIAEYIWIDSEGGTRSKSRTLPEKESQYLPEELPIWNFDGSSTGQAPGENSDVYLKPVAVFPDPFRGSPNILVLSECWNADGTPNKFNHRHEAAKLMEAHADQVPWFGLEQEYTLLDINDRPYGWPRNGFPAPQGPYYCGVGTGKVVQRDIVEAHYKCCLYAGVKISGTNAEVMPAQWEFQVGPCDGIEMGDHLWLARFLLHRVSEEFGAKVSFDPKPIPGDWNGAGLHTNFSTENMRKEGGMKYIEDAIKKLEARHKEHIAVYGEGNDKRLTGRHETGSIDSFTYGVANRGASIRIPRECGAKGYGYFEDRRPASNADPYQITGIIMETCFGAVSE

SEQ ID NO: 14532 - protein, 358 aa, Tuber borchii
MSENSTIVSNTANLVKFLNLDQKGSILAEYIWIDGANGVRSKTKTLFKKPSSVEDLPEWNFDGSSTGQAPGEDSDIYLRPVAIFPDPFRMGDNILVLAECWNADGSPNKFNHRHECAKIMEAHKDQKPWFGLEQEYTLFDLYGNPYGWPKGGFPGPQGPYYCGVGTGKVYCRDIVEAHYKACLFAGIKISGINAEVLPSQWEFQVGPCVGIEMGDHLWISRYLLHRVAEEFGVKISFHPKPIPGDWNGSGLHTNVSTQAMRDEGGMKAIEEAIQKLSTRHAEHIAVYGDDNTLRLTGRHETGNIDAFSYGVADRGSSIRIPRSCAKEGKGYFEDRRPASNACPYQITGIMMETICGGI

SEQ ID NO: 14533 - protein, 226 aa, Oryza sativa
  misc_feature (141)..(141): Xaa can be any naturally occurring amino acid
MGRRPARCYRQIKNKPYPKSRYCRGVPDPKIRIFDVGQKKRSADDFPLCVHLVSWEKENVSSEALEAARIACNKYMAKHAGKDAFHLRVRAHPYHVLRINKMLSCAGADRLQTGMAGAFGKPQGVCARVRIGQVLLSVRCXATRTAAHAQEALRRAKFKFPGRQRVIFSVQVGFTRFKRDEYLKLKSEGRIVPDGVDRKLLTRHGSVADRQPGRGVFPPSVAGSDA

SEQ ID NO: 14534 - protein, 217 aa, Medicago sativa
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHGTFENVRQMAERTAKPHRFQHCCVLVGNKADLRHLVAVSTEDGKSYAEKESLYFMETSALEATNVENSFAEVLTQIYRILSKKAVEGAENGNASVPAKGEKIDLKNDVSALKRVGCCSS

SEQ ID NO: 14535 - protein, 257 aa, Elymus ciliaris
CELDNIMRLTGITGIVNGMDVSEWDPTKDKFLAVNYDITTALEGKALNKEALQAEVGLPVDRKVPLVAFIGRLEEQKGPDVMIAAIPEILKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKAPAKNWEDVLLELGVDGSEPG

SEQ ID NO: 14536 - protein, 383 aa, Porphyromonas gingivalis
MAEKRDYYEVLGVSKNATDDELKKAYRKKAIQYHPDKNPGDKEAEEHFKEVAEAYDVLSDPQKRSQYDQFGHAGLGGAAGGGFSGGGMSMEDIFSRFGDLFGGFGGFGGFSDMGGGSRRRVRRGSDLRVRVKLSLADISKGVEKKVKVKKQVVCSKCRGDGTEEANGKTTCQTCHGTGVVTRVSNTFLGAMQTQSTCPTCHGEGEIITKPCSKCKGEGVEIGEEVISFHIPAGVAEGMQMSVNGKGNAAPRGGVNGDLIVVIAEEPDPNLIRNGNDLIYNLLISVPLAIKGGSVEVPTIDGRAKIRIEAGTQPGKMLRLRNKGLPSVNGYGMGDQLVNVNVYIPESIDAKDEQAIAAMENSDSFKPTDAARKDIDKKYREMLD

SEQ ID NO: 14537 - protein, 156 aa, Phaseolus vulgaris
MDDGGGSKLSGIRQIVRLKEMFQKWQTVTLGSKESNHDSDVARPGGIPPMINKRLTNVLYCDSDEDSCYSPQPPHDVPKGYLAVYVGPELRRFIIPTSYLSHSLFKVLLEKAAEEFGFDQSGGLTIPCEIETFKYLLNCMENHDDSSAGNTGTVEE

SEQ ID NO: 14538 - protein, 349 aa, Arabidopsis thaliana
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEIWTNDKYWSAEHRVVVNTTRERYSIPFFLLPSHDVEVKPLEELVSPENPPKYKGYKWGKFYVSRNRSDFRKLEIENIQIDDFKVKT

SEQ ID NO: 14539 - protein, 415 aa, Triticum aestivum
  misc_feature (20)..(20): Xaa can be any naturally occurring amino acid
  misc_feature (78)..(78): Xaa can be any naturally occurring amino acid
  misc_feature (192)..(193): Xaa can be any naturally occurring amino acid
GVHLFYYFIRSERNPAEDPXMIWLTGGPGCSAFSGLVYEIGPLSFDRRTDVNGFPKLLYKPDSWTKVSNIIFIDSPVXTGFSYSKTEQGYKSSDTQVVTQIVIFIRKWFDEHPEFMSNPFYVAGDSYCGITVPGITLGIAKGIEDGSGSALNLKGYLVGNPVTAYWYYDNPAKIPFAHGKGLISDEMYPGVXXESCSAWEFSPECTKSHAAIDECVKDICPNHILERLCAFASPHPYNLKLNSSAREMLQLQEDYTARAGLQLSEISTECRTAEYAMSMIWANNDTVREALGVHKGTVSSWLRCNFDIRYTNDIFSSVEHHLDVTTRGYRSLIYSGDHDMIVPSIGTQAWIRSLNFSVVDEWRPWYVDAQVAGYTRSYSNNLTFATVKGGGHTHTEYMPKQCLAMFARWLSGEPL

SEQ ID NO: 14540 - protein, 227 aa, Thalassiosira pseudonana
MADINLAQLLDAGVHFGHKAYRWNPKMFPYIYTERNNIHILDLVQTAQLLKRANAYVQNAASEGKTFLFVGTKRQASAVIAQEAKRCPSGYYVNHRWLGGMLTNWVTLKSRIERLKTLEQQEVEGVFNLLPKKEASLRAKELEKLRKHLNGVKDMSKLPDVAIIIDQKREMTAIQECRKLGIPVISILDTNCDPDLVDIPIPGNDDAVRSIKLILNSLTNSIVQGCQ

SEQ ID NO: 14541 - protein, 419 aa, Burkholderia vietnamiensis
MFSKEQTIAGFDPDLHEAMRLERQRQEAHIELIASENYTSPRVLEAQGSVLTNKYAEGYPGKRYYGGCEHVDVVEQLAISRAKALFNADFANVQPHSGSQANAAVYLALLTPGDTILGMSLAHGGHLTHGAKVSFSGKVFNAVQYGVDATTGLIDYDEIERLALEHRPKMIVAGFSAYSRVLDFARFRAIADKVGAYLFVDMAHVAGLVAAGLYPNPVPFADVVTTTTHKTLRGPRGGLILARANEEIEKKLNSMVFPGTQGGPLMHVVAAKAVAFKEALGPEFVTYQKQTLANARAMVEVFNARGYDVVSGGTDDHLFLVSLVKKGITGKDADAALGRAHITVNKNTVPNDPQSPFVTSGIRIGTPAITTRGFLEADAAHTAQLMCDALDRLGDAQVEAAVRTQVAQLCARFPVYLGL

SEQ ID NO: 14542 - protein, 911 aa, Solanum tuberosum
MAASVENRQFTHLEPGLSGVGRNFKPRPDSPVRGCNFPPSSNHELPFQKQQNLPIYLDYSSSEDEDDDDEKNEYVQMIKKGKTELEPSIHDTRDEGTADNWIQRNFSLIRLTGKHPFNSEPPLARLMHHGFITPVPLHYVRNHGPVPKASWADWSVEVTGLVKRPMKFTMDQLVNEFPSRELPVTLVCAGNRRKEQNMVKQTIGFNWGAAAVSTTVWRGVPLRPLLKRCGVHSKKKGALNICFEGSDVLPGGGGSKYGTSIKKEFAMDPSRDIIVAYMQNGEMLSPDHGFPVRMIIPGFIGGRMVKWPKRIVVTTQESESYYHYKDNRVLPPHVELELANAEAWWYKPEYIINELNINSVITTPSHEEILPINAWTTQRPYTLRGYAYPGGGKKVTRVEVTLDGGETWSVCTLDHPEKPTKYGKYWCWCFWSLEVEVLDLLRAKEIAVRAIDETHNTQPEKLIWNVMGMMNNCWFRVKMKCVKPHKGEIGIVFEHPTQPGNQSGGWMAKERHLEISAVAPPTLKKSISTPFMNTASKMYSMSEVRKHNSSDSAWIIVHGHIYDASRFLKDHPGGVDSILINAGTDCTEEFDAIHSDKAKKLLEDFRIGELITTGYTSDSSPNTSVHGSSSISSFLAPIKELVQTPTRSVALIPREKIPCKLVDKQSISHDVRKFKFALPSEDQVLGLPVGKHIFLCATVDDKLCMRAYTPTSTVDEVGFFELVVKVYFKGVHPKFPNGGQMSQHLDSLPIGAFLDVKGPLGHIEYQGKGNFLVHGKQKFPKKLAMIAGGTGITPVYQVIESILKDPEDDTEMYVVYANRTEDDILLKEELDAWAEQIPDRVKVWYVVQESITEGWKYSTGFVTEAILREHIPQPSHTTLALACGPPPMIQFAINPNLEKMGYDIKEELLVF

SEQ ID NO: 14543 - protein, 277 aa, Clostridium thermocellum
MESSNLRKYLSDSKRIVIKVGTSTLTYENGEMNLARMEKLVRVISDLMNQGKDVVLVTSGAIGVGVSKLKLGSRPKELKDKQAVAAVGQCELMYMYSKLFLEYGHTVGQILLTRDVVENPTGKTNVINTFETLLEMRIIPIVNENDSVAVDEIESETNHVFGDNDTLSAIVATLVNADLLIILSDIDGFYDCDPRANECSKLISVIEKITPELEKCAGGVGSSRGTGGMVTKLSAAKIATLAGINMVLANGDNPNIVYDILAGKEVGSLFLAQKSDS

SEQ ID NO: 14544 - protein, 1025 aa, Kluyveromyces marxianus
MSCLIPENLRNPKKVHENRLPTRAYYYGQDIFESLNGPWAFALFDAPLDAPDAKNLDWETAKKWSTISVPSHWELQEDWKYGKPIYTNVQYPIPIDIPNPPTVNPTGVYARTFELDSKSIESFEHRLRFEGVDNCYELYVNGQYVGFNKGSRNGAEFDIQKYVSEGENLVVVKVFKWSDSTYIEDQDQWWLSGIYRDVSLLKLPKKAHIEDVRVTTTFVDSQYQDAELSVKVDVQGSSYDHINFTLYEPEDGSKVYDASSLLNEENGNTTFSTKEFISFSTKKNEETAFKINVKAPEHWTAENPTLYKYQLDLIGSDGSVIQSIKHHVGFRQVELKDGNITVNGKDILFRGVNRHDHHPRFGRAVPLDFVVRDLILMKKFNINAVRNSHYPNHPKVYDLFDKLGFWVIDEADLETHGVQEPFNRHTNLEAEYPDTKNKLYDVNAHYLSDNPEYEVAYLDRASQLVLRDVNHPSIIIWSLGNEACYGRNHKAMYKLIKQLDPTRLVHYEGDLNALSADIFSFMYPTFEIMERWRKNHTDENGKFEKPLILCEYGHAMGNGPGSLKEYQELFYKEKFYQGGFIWEWANHGIEFEDVSTADGKLHKAYAYGGDFKEEVHDGVFIMDGLCNSEHNPTPGLVEYKKVIEPVHIKIAHGSVTITNKHDFITTDHLLFIDKDTGKTIDVPSLKPEESVTIPSDTTYVVAVLKDDAGVLKAGHEIAWGQAELPLKVPDFVTETAEKAAKINDGKRYVSVESSGLHFILDKLLGKIESLKVKGKEISSKFEGSSITFWRPPTNNDEPRDFKNWKKYNIDLMKQNIHGVSVEKGSNGSLAVVTVNSRISPVVFYYGFETVQKYTIFANKINLNTSMKLTGEYQPPDFPRVGYEFWLGDSYESFEWLGRGPGESYPDKKESQRFGLYDSKDVEEFVYDYPQENGNHTDTHFLNIKFEGAGKLSIFQKEKPFNFKISDEYGVDEAAHACDVKRYGRHYLRLDHAIHGVGSEACGPAVLDQYRLKAQDFNFEFDLAFE

SEQ ID NO: 14545 - protein, 327 aa, Oryza sativa
MDLVAGGVIRGLPSSWERIRSPRTPLFLSSWASRRRVAFAACSSCPLVVCRNASAVVPFAKKKRKGGSEEPPDEEEGDDFVDEMEGEDDDDEEEEDVDDDDLLDDNEDDDDDYSFEDDFESDDEQDLYVGDGGAGGGISLAGTWWDKEALALAEEVSNSFDGDLKIYAFKTAANLTIRVRIEKMSTRYGSPTIDDIEAFTIAYRAKIDDAESAGRIPQNISLEVSSPGVERVIRIPDDLERFKERAMYVRYTITSDGGEGMTPQEGDGVFRLISYDMDLCECTWGIADVKINRQQAGKGRPLSKKQREWRLQTPFESLKLVRVHSDC

SEQ ID NO: 14546 - protein, 438 aa, Cytophaga hutchinsonii
MNTHKATTINLFSLKTPNMKAFHMTWMAFFLCFFGWFGIAPLMVMVRDELHLTKGEIGNIMIASVSITIFARILIGYLCDRVGPRIMYAALLILGAFPVMLIGLSNDYTSFLLFRLTIGVIGASFVVTQFHTSAMFAPNIIGTANAVTAGWGNLGGGVTQLVMPLIFAGFVGLGYSNSESWRLAMVVPGIALLIMGILYFLYTTDTPEGNLADLKKKDPNFTLKKKQSQVSFAEIFKDYRVWVLAFCYGACFGIEITIDNIAALYFKDKFNLSLEAAGLIAASFGMMNLFARALGGMLSDKIGNTKGLNGRVLVLGACILLEGIGILIFSNMEVLVFSVISMIGFALFVKMSNGATYAVVPFVNKNAVGSVAGIVGAGGNIGAVLMGFLFKSESLTYNDAFSIIGYCVLGIAVLAFTIRFVTSTEKKQVEFTAVESLA

SEQ ID NO: 14547 - protein, 126 aa, Schizosaccharomyces pombe
MSAAEKKPASKAPAGKAPRDTMKSADKKRGKNRKETYSSYIYRVLKQVHPDTGISNQAMPILNSFVNDIFERIATEASKLAAYNKKSTISSREIQTAVRLILPGELAKHAVTEGTKSVTKYSSSAQ

SEQ ID NO: 14548 - protein, 559 aa, Pseudomonas aeruginosa
MGARALRRERRLLWSPNWTRILPMQPQKTLTAGQALVRLLANYGVDTVFGIPGVHTLELYRGLPGSGIRHVLTRHEQGAGFMADGYARVSGKPGVCFVITGPGVTNVATAIGQAYADSVPLLVISSVNHSASLGKGWGCLHETQDQRAMTAPITAFSALALSPEQLPELIARAYAVFDSERPRPVHISIPLDVLAAPVAHDWSAAVARRPGRGVPCSEALRAAAERLAAARRPMLIAGGGALAAGEALAALSERLAAPLFTSVAGKGLLPPDAPLNAGASLCVAPGWEMIAEADLVLAVGTEMADTDFWRERLPLSGELIRVDIDPRKFNDFYPSAVALRGDARQTLEALLARLPQEARDAAPAAARVARLRAEIRAAHAPLQALHQAILDRIAAALPADAFVSTDMTQLAYTGNYAFASRAPRSWLHPTGYGTLGYGLPAGIGAKLGAPQRPGLVLVGDGGFLYTAQELATASEELDSPLVVLLWNNDALGQIRDDMLGLDIEPVGVLPRNPDFALLGRAYGCAVRQPQDLDELERDLRAGFGQPGVTLIELRHACAR

SEQ ID NO: 14549 - protein, 1176 aa, Cytophaga hutchinsonii
MSQSTKTYTSTCSYCGVGCGVKIHKAVNGSLQIEGDKSYPANQGMLCSKGMNLHYAAMDQTDRLLYPEMRGNRNMPLQRVSWDTALDRAAAVFKALIEKYGPDSVGYYVSGQCLTEEYYIANKITKGFIGTNNIDTNSRLCMSSAVVGYKLALGEDSVPLSYDDIELADCFFITGANPAWCHPILFRRLENHKAANPHVKIIVADPRKTQSCSLADVHLQLQPGTDIVLCHAIARRLIETGKIDQAFIDAHTSGYEAFKEKVFTLSLQEAADICVLEKELIIQAADMIGDSQAFISMWAMGLNQSVIGVNKNVSLLNLSLITGQIGKPGAGPLSLTGQPNAMGGREVGGLSNMLPAHKNLLNPAHRKEVADFWGVPAINEKPGFTATEMFDQLLSGKMKAVWIICTNPLVSLPDARNAEAALRNARFVVVQDISNKSDTLKYADLVLPAAAYMEKEGVMTNSDRRISYLSKVMEPPGEALPDVDILCRFAHKMGWKESFNYASNAEIFEEYTRITKGTNIDISGLSYADLIQRRSVQWPVPEKGHPGTPRLFTDHTFYTPTGLANIISVDSMNHSEKLDDDFPLILTTGRIRDQWHTMTRTGKVRKLNKHISKPFLEIHPEDAGIRGIKQDDVVTIESRRGDVRVTAILTEDIKKGVVFLPMHWGRMLSTDLTRTNNVTNNLIDPVSKEPDYKFTAVQVTKYVKPREHIVIVGAGAASCQFIKRHRELGAEDTITVFSAENFHFYNRVLLPEYVSKHKSWDNLEKLRKAEWLELGVTLIPRKITRLITESKSIVDDTGEVHCYDRLLVATGSRSTQMKHIAPVKGIFTMRRREDADALIHHLSTGDSVVVVGGGLLGLEMADSLLEIGMKVSVIQRSSRLMDRQLDKTAANLLAKELTERGMDLYFDDEVLYVNGEYAVESLRLKSSRKIDCKAILFAIGTQPNVEFLKEAGIQVNRGVIVDEHLQTSNEFVYAMGEIAERNGALFGITAGAEEQATVLAEYLNGSTTSNYTGTLSMNILKVHGVELCSIGMVEAPPNNPDYEEIIFLDKTRKYYKKCIVYQDRLVGAILMGDKSEFNEFRDWIKSGVELGEKRESLLMSGSISKEPMLGTLVCSCNTVGSGNIENAIKGGCKDVTSICNTTGAGTGCGSCKPEVKAILERMHAVTESSNSQKTYA

SEQ ID NO: 14550 - protein, 231 aa, Methanosarcina mazei
MFGREAILLKSTIPEKNAIIQRDGETYVIAPRTPGGIVDPATLRKIADVAEKYGAATLKMTSEQKMAIVGLKEEDIDAAWADLGMDAGIVAGPFVKAVKFCPGTTFCRKGQQDAVSLGMKLEARYRGVKLPYMMKMAVSGCPSSCSEPVIKDVGVMGTATGYTLMVGGSAGLKPRLADVVAKGLSEDEVLAAVDRIVEFFKNYGENRKRLGTIIDKIGLEEFKKEVGLWEK

SEQ ID NO: 14551 - protein, 513 aa, Unknown
  Synechococcus sp. CC9605
MLGDLWSFQGRYRTLHLTWIAFFLTFVVWFNLAPLATTVKTDLGLTVGQIRTVAICNVALTIPARVLIGMLLDKFGPRITYSSILVFSAIPCLLFASAQDFNQLVVARLLLSIVGAGFVIGIRMVAEWFPPKEIGLAEGIYGGWGNFGSAFSALTMVALAGFLSFSGGFELPTGAVLNWRGAIALTGIVSAVYGLFYFFNVTDTPPGKTYQRPEKTAGLEVTSMRDFWGLLGMNVPFAAILCVLCWRLGKVGFLTPSTYPLALGAVAVWFAFQTWGIIRTNRDLILGNKVYPKEDRYEFRQVAILELTYIVNFGSELAVVSMLPTFFETTFDLPKATAGILASCFAFVNLVARPAGGLISDSVGSRKNTMGFLTAGLGVGYLVMSMIKPGTFTGTTGIAVAVVITMLASFFVQSGEGATFALVPLVKRRVTGQVAGLVGAYGNVGAVTYLTIFSLLPMWMGGGGEPTPEVIAASNSAFFQILGVAGLIVAFFCFFFLKEPKGSFADLHEGETA

SEQ ID NO: 14552 - protein, 322 aa, Prochlorococcus marinus
MPIASDITTLVGKTPLVRLNRLPKAFGCEAELIAKLESFNPTASVKDRIAGAMVAAAEKDRTIVPGKTVLVEPTSGNTGIALAMVAAAKGYRLILTMPDTMSIERRSMLRAYGAELQLTPGKEGIQGAITLAQEIVSSLPDAYLLQQFDNPSNPEVHEQTTAEEIWVDCDGQIDGLVVGVGTGGTITGCAKLLKQRNPKILIYAVEPSASAVLSGKSANPHHIQGIGAGFIPSVLDTALIDEVIEVDDNQAMEIGRQLARQEGLLSGISSGAAVAAALKVGSRKEMKNKRLLVVLPSFGERYLSTSMFNSVSSIPPRPDGYI

SEQ ID NO: 14553 - protein, 743 aa, Unknown
  Synechococcus sp. CC9605
MTNSPRSVRSQCPYCGVGCGLELLPPAVKGEAVKRDAEGNPMWNARGDREHPSSLGQVCIKGATIGETLAPGRLRQPLFRQTLEDDFAPISWDDALNKITGQIKASVARRGNADGIAMYGSGQFHTEDYYLAQKLLKGALGTNNFDANSRLCMSSAVAGYTRSLGSDGPPCSYEDLDHCSVAFLIGTNTAECHPVLFQRLLKRKRKNPGRVKIVVVDPRRTDTAKAADIHLPIAPGSDLALLHGIAHLVLRENGQDPAFIDDHTENYDSFFDVAARWTPRRVARFCNIPEKRLREAAALFHRREKVLSLWSMGVNQRREGTAVVQGLINLHLLTGQIGKQGAGPFSLTGQPNAMGGREAGGLAHLLPGYRLVANAEHRAEVEQAWQLPAGQINAKPGLAAWQQIEAMEQGALDLWWVAATNPLVSLPDLDRVKSAMQKCPLVVVSEAYADSETSHYAHLILPAAQWSEKAGAMTNSERRVTYCPAYRRRFGESRPDWEVFAEVGRRLGYSEQFNFESAAEVYAEFTALTQGRLCDVSGLSHELLEDEGPQQWPYPSGSTPTTAAKRLYENHQFATPNKRARFSTDQPLGLAEPPCDTYPLVLTVGRYLGQWHTMTRTGKVERLMKQHPEPLLEIHPGDAQDLKLRNGELAAISSRRGHLTATVKVTDRIRRGSVFLPMHWGFTQEKACEANTLMHDEACPVSKQPELKACAVIVAPAVSVVKPIEQQKGRLEALRRLLTPALR

SEQ ID NO: 14554 - protein, 219 aa, Methanosarcina mazei
MKDNLPEKGAIVQRDRETYTIAPHLPGGIVDPDTLIKIGEVAKKYGAAALKATSAQRIAIVGLKEEDLDNAWADLGIKPGAAIGLCVRSIKFCPGTTFCKQAKQDAVGLGLKLDEKYHGMSMPSKLKIGVSGCPNSCAEPAIKDIGLMGTAKGYNLMVGGSAAAVPRLAQVVAKDLSEDDALEIVDRILNFYKNSGTKKRLGRFIEDMGLDEFKKQVGL

SEQ ID NO: 14555 - protein, 320 aa, Unknown
  Candidatus Blochmannia floridanus
MIKKIGVLTSGGDSPGMNAAIRGVVRAGLSEGIEVYGIYDGYLGLFQNRMMLLSYCSVSDIINKGGTVLGSSRFPELKKDMIRSVVMNNISKSHLDALVIIGGDGSYIGARRLSDLGCPCIGIPGTIDNDVAGTDYTIGYFTALETIIEAIDRLRDTSSSHQRISIVEVMGRYCGDLTISAAIAGGCEFVIIPELKFQMQDLVDKIKLNISKGKKHAIVAITERICNVFDLAQYIENETGKETRATVLGHIQRGGKPVAYDRILASRMGAYSIELLLKGYGRHCIGIENEKLVHHDINDATKYMRRSFRQDLLTTAKKLC

SEQ ID NO: 14556 - protein, 363 aa, Pseudomonas fluorescens
MNDIQLDQASVKKRPSGAYDATTRLAASWYVAMRSNELKDKPTELTLFGRPCVAWRGATGRAVVMDRHCSHLGANLADGRIKDGCIQCPFHHWRYDEQGQCVHIPGHNQAVRQLEPVPRGARQPTLVTAERYGYVWVWYGSPLPLHPLPEISAADVDNGDFMHLHFAFETTTAVLRIVENFYDAQHATPVHALPISAFELKLFDDWRQWPEVESLALAGAWFGAGIDFTVDRYFGPLGMLSRALGLNMSQMNLHFDGYPGGCVMTVALDGDVKYKLLQCVTPVSEGKNVMHMLISIKKVGGILRRATDFVLFGLQTRQAAGYDVKIWNGMKPDGGGAYSKYDKLVLKYRAFYRGWVDRVASER

SEQ ID NO: 14557 - protein, 312 aa, Yarrowia lipolytica
MGKSSKDKRDIYYRKAKEEGWRARSAFKLLQLDQQFHLFDGVQRVVDLCAAPGSWSQVLSRELFEKRGIEAGSGKTVAGSTFGGKVVTGESTAQKSSTMEKAKIVSVDLQPMAPIAGVTTIQADITHPQTLKMILDEFGGEPADFVCSDGAPDVTGLHDLDEYTQAQLILSALQLTTQLLRPGGNFVAKIFRGRDIDLMYFQLGLLFEQVTCAKPRSSRGSSLESFIVCQGYKPRSGWSPDLATGVMVNKELPLPISERVVAPFVACGDLSEYDSDATYTLPSGEGVRVSLDPVQSPTCPPYKRAVEMKRKN

SEQ ID NO: 14558 - protein, 666 aa, Bacteroides fragilis
MKMNYLAFIGVTAATAVVSCTPAKKEYASYELYPVRSGSLTEMEYSPESTKFTLWAPTADEVRLMLFDSGEGGHAYETIPMEPGEEGTWMATVRKDLMGKFYTFNVKVNDKWMGDTPGINAKAVGVNGKRAAIINLKSTDPQGWETDQRPPLKSPADAIIYEMHHRDFSVDSTSGIQHKGKFLALTEHGTMNSAKLLTGIDHLIELGVTHVHLLPSYDYASVDETKLDENKYNWGYDPQNYNVPDGSYATDPYDPAVRIREFKQMVQALHKAGIRVVLDVVYNHTYNTDGSNFERTVPGYFYRQKPDGSLANGSACGNETASNRPMMRKYMIESVLHWIREYHIDGFRFDLMGIHDIETMNEIRKAVSAVDPSIIIYGEGWAAEAPQYPGDSLAMKVNTCKMPGIAAFSDEMRDALRGPFNDNHKGAFLAGIPGEEESIKFGIVGAVSHPQVNNDSVNYSKAPWASQPTQMISYVSCHDDMCLVDRLKSSIPGITPEQLVRLDKLAQTAVLTSQGIPFIYAGEEVMRDKKGVHNSFESPDSINAIDWNRKTTHEDVFAYYKRLISIRKAHPAFRMGDAEMVRKYLEFLPVDGGNLVAFRLKDRANGDTWDNIIVALNARSVPAKLAIPEGKYTVVCRDGVIDERGLGSLYGPEVTVPAQSALIIHQ

SEQ ID NO: 14559 - protein, 501 aa, Zea mays
MTTAAWPRPRFLVLPQPGFLRSVCHGLCSRCLFCFLLLLAFACSSSSGRVVVTSLPGFDGDLPFHLETGYVEVEEDAGVELFYYFVQAESGAAAAADDTPFLFWLTGGDRCSVFSGLAYEIGPIRFVLEPYNGTLPRLRYNHNSWSKVSHILFVDSPVGAGFSFSRDPKGYDVGDISASLQLQEFLIKWFSDHPEYLANPFYIGGDSYVGKIVPFLGQMISEGIELGRRPFPNLKGYLVGNPITGESIDFTSRVPYAHGVGIISDQLYETILGHCQGEDYTSPANALCAQALDTFNNLINEVQNAQILLDTCVYASPAPNVLSRPVDGGRRILRAAGMGGGATLNHPPARPRFGCITYGYYLSYFWANDERTRTALGIKKGTVDEWVRCHDADLPYTIDLKSAIKYHRNLTSRGYRALVYSGDHDLLVPHLGTQAWVRSLNFPVVDDWRAWHLGGQAAGFTINYSNNMTFATIKGGGHTAPEYEPERCFAMFSRWILDRPL

SEQ ID NO: 14560 - protein, 1338 aa, Kluyveromyces lactis
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTERSSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 14561 - protein, 135 aa, Erwinia amylovora
MSEALKILNNIRTLRAQARECTLETLEEMLEKLEVVVNERREEESQAQAEVEERARKLQQYRDMLIADGIDPNELLSTLAAAKTPGKAKRAARPAKYSYVDENGENKTWTGQGRTPAVIKQAIEEQGKKLEDFLL

SEQ ID NO: 14562 - protein, 255 aa, Elymus dentatus
LDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMIAGADVLAVTSRFEPCGLIQLQGMRYGTPCACASTGGLVDTIVEGKTGFHMGRLSVDCNVVEPADVKKVATTLKRAIKVVGTPAYHEMVKNCMIQDLSWKGPAKNWEDVLLELGVEGSEPG

SEQ ID NO: 14563 - protein, 381 aa, Zea mays
SILISPRTHQSQPHLRILAQNGPPKKPPPTSSPTHRGQDLAHDTHKGGPSQEHTHTQRQHDGLNSPHHTTTTTQLSSRSTKPHPLAPLSSSPSPPFSVSGSQLSCVLLPPMANASLQSFLLPHDHSFAGAGGSRDGSASAVHKLSTNTSGSISFRLYTKTSPSVTAASATNSSAPTPVAPASAPAAGDEEEEEGPSLDLLRRQLAAGDYRQADETTRALIIDLAGEPARRRGYVFFSEVQFIPAEDLAAIDGLWKEHSGGRFGYSVQRRLWEKSRRDFTRFFIRVGWMRKLDTEVEQYNYRAFPDEFMWELTDDTPEGHLPLTNALRGTQLLANILTHPAFQEEDQGDGAAAAEESANTKDDNKGRERPRSMRDFKPDYSF

SEQ ID NO: 14564 - protein, 255 aa, Elymus dentatus
LDNIMRLTGITGIVNGMDVSEWDPTKDKFLAVNYDITTALEAKALNKEALQAEVGLPVDRKVPLVAFIGRLEEQKGPDVMIAAIPEIVKEEDVQIVLLGTGKKKFERLLKSVEEKFPGKVRAVVRFNARLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 14565 - protein, 314 aa, Arabidopsis thaliana
MYSLVFKLFLFLSLLQISVSARNLASQEPNQFQLLKYHKGALLSGKISVNLIWYGKFKPSQRAIISDFITSLTHTSPTSKTLHQPSVATWWKTTEKYYKLATPSKNSSPLSLTLGKQIIDESCSLGKSLTDKKIQTLASKGDQRNAINVVLTSADVTVTGFGMSRCGTHGHARGLGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGDLLVDTTTGGSFNAYGANGRKFLLPALYDPTTSACSTMV

SEQ ID NO: 14566 - protein, 265 aa, Synechococcus elongatus
MTLISSVTKGKVYLVGAGPGDPGLLTLRGKALLEAAEVVVYDALVSDAILSLINPKADKIHAGKRRGQHSLLQTETTQLLIEKAQQQAVVVRLKGGDPFVFGRGGEEMADLQAAGIAVEVVPGVTAGVAVPAYAGIPITHRDRSSSVTFVTGHEMAGKYRPSIAWEAIARGSETIVIYMGLHNLALIIEQLQTAGLPGITPIALIRWGTRPEQEELFATLETVVAAVAERQFQAPAIAVIGQVVSLSPLLPPTMMTASDRGLPTA

SEQ ID NO: 14567 - protein, 48 aa, Triticum aestivum
MPSLQKALPPELADNALRLFRECLRRAKFIGNQVCIFSLELSCYLVTS

SEQ ID NO: 14568 - protein, 177 aa, Sulfolobus solfataricus
MEVATLGGGCFWCTEAVYKRVKGVISVKPGYSGGHVPNPTYEDVCTDTTGHAEVVQITFDSSIISYREILEIFFEIHDPTTLNRQGNDVGTQYRSIILYHNEEQRKIAEEMIREVEKRIGKKVVTELKPFEVFYEAEDYHHDFYDKHKYNPYCRLVISPKVKKFMKLFPDKVKIHEG

SEQ ID NO: 14569 - protein, 921 aa, Sorghum bicolor
MTTTAARALVALLLVAVAVADDGATLVEIKKSFRNVGNVLYDWAGDDYCSWRGVLCDNVTFAVAALNLSGLNLEGEISPAVGSLKSLVSIDLKSNGLSGQIPDEIGDCSSLRTLDFSFNNLDGDIPFSISKLKHLENLILKNNQLIGAIPSTLSQLPNLKILDLAQNKLTGEIPRLIYWNEVLQYLDVKNNSLTGVIPDTIGNCTSFQVLDLSYNRFTGPIPFNIGFLQVATLSLQGNKFTGPIPSVIGLMQALAVLDLSYNQLSGPIPSILGNLTYTEKLYIQGNKLTGSIPPELGNMSTLHYLELNDNQLTGSIPPELGRLTGLFDLNLANNHLEGPIPDNLSSCVNLNSFNAYGNKLNGTIPRSLRKLESMTYLNLSSNFISGSIPIELSRINNLDTLDLSCNMMTGPIPSSIGSLEHLLRLNLSKNGLVGFIPAEFGNLRSVMEIDLSYNHLGGLIPQELEMLQNLMLLNVSYNNLAGVVPADNNFTRFSPDSFLGNPGLCGYWLGSSCRSTGHHEKPPISKAAIIGVAVGGLVILLMILVAVCRPHRPPAFKDVTVSKPVRNAPPKLVILHMNMALHVYDDIMRMTENLSEKYIIGYGASSTVYKCVLKNCKPVAIKKLYAHYPQSLKEFETELETVGSIKHRNLVSLQGYSLSPVGNLLFYDYMECGSLWDVLHEGSSKKKKLDWETRLRIALGAAQGLAYLHHDCSPRIIHRDVKSKNILLDKDYEAHLTDFGIAKSLCVSKTHTSTYVMGTIGYIDPEYARTSRLNEKSDVYRLWHCSAGAADWQEASGQRILSKTASNEVMDTVDPDIGDTCKDLGEVKKLFQLALLCTKRQPSDRPTMHEVVRVLDCLVNPDPPPKPSAHQLPQPSPAVPSYINEYVSLRGTGALSCANSTSTSDAELFLKFGEAISQNME

SEQ ID NO: 14570 - protein, 286 aa, Picea mariana
MEHMNTTAQSSSSLYGVHMVEYGGDVGVGSMMALMTEHQPESESIMTSIPIPSSYSSYSHGHGHGHGHGHGHGHGQSECLLSAAAMFQTSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 14571 - protein, 174 aa, Zea mays
  misc_feature (49)..(49): Xaa can be any naturally occurring amino acid
  misc_feature (60)..(60): Xaa can be any naturally occurring amino acid
  misc_feature (145)..(145): Xaa can be any naturally occurring amino acid
MATSSGPKEAPANNPGLQTEVDPATKGYFLQQTMLRGNDPKVSLDFYFXEMEFSLYFLGXYEDVTLAPDDHIKRTEWTFRQKATLELTHNWGTENDPEFKGYHNGNSDPRGFGHIGVTVDDVHKACERFERLGVEFVKKPDDGKXKGIAFIKDPDGYWIEIFDQTIGTVTSSAS

SEQ ID NO: 14572 - protein, 346 aa, Ustilago maydis
MGKSTKDKRDIYYRQGKSEGYRARSAYKLLHLNEQYGFLGGAEDYALDAGAASTCASSSDSANAPKTTSEKRFQTPTRVVDLCAAPGSWSQVLSRRLASVPGSHLVAVDLQAMAPLPGVTQIIGDITTPATADAVSTALSDGPLSNSTCVKGKGKGKARAQLIVCDGAPDVTGLHDLDEYLQSQLLLAATQITFRLLEIGGTFVAKIFTQHPQAGLGASLGNMDLKAARPATSGALLADQLRTFFDRVDIAKPRSSRLGSVEHFLVCLGFKPPQNLPAGLVGSLAGTLSSTSTEEEARDDLVRYAQKLRSELQRPDVPTSGMAQSKRELSAILSFVVHGDLSGFDQ

SEQ ID NO: 14573 - protein, 499 aa, Clarkia lingulata
  misc_feature (291)..(296): Xaa can be any naturally occurring amino acid
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYXXXXXXKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRIGQLLAIYEHRVAVQG

SEQ ID NO: 14574 - protein, 333 aa, Unknown
  Candidatus Blochmannia floridanus
MEKFSVTVIGAGVYGTAIAVAIAKHGNMVLLWGHNSQHIKILKIDRSNQVDLPGVFFPDSLYVEESLSVAADFSQNILIAVPSHVFRCVLLKLRLNLKNNFRIIIASKGLEPKTGWLLQDVVYDVLGKEVPCAVISGPTFAHELAIGLPAAIELASADIKFRYDIEHLLYSVKNLRVYKTTDVIGVQIAGAVKNVIAIGVGISDGMGFGANARAALITRGLSEMIRLGKSIGAISVDVFVGLAGLGDLVLTCTDDQSRNRRFGMLLGQGMHVDYAQKSIGQLIEGISNTKEVYMLSVKYKVIMPITEQIYKILYENKNVHEAVYSLIRRSYIL

SEQ ID NO: 14575 - protein, 253 aa, Lactobacillus reuteri
MAIVSFVGAGPGETDLITLKGYKLLSEADVVIYAGSLINTDLLDYCKDGAEKYDSAKMTLDDIVDRMEESVKNGKSVVRLQTGDFSIYGSIREQIEEMKKRGIKYQCVPGVSSFLGAASSMGVEYTVPEVAQSVIITRMAGRTPVPEGESLKSLAQHQTSMVIFLSVQGIRKVVEQLEEGGYPSDTPAAVIYKATWPDEKVVRGTLADIAEKVHDADIRRTALIMVGKFLGDEYNYSHLYDAGFSTMFRKKSK

SEQ ID NO: 14576 - protein, 499 aa, Clarkia lingulata
  misc_feature (291)..(296): Xaa can be any naturally occurring amino acid
MATPALISDTEAWKDLKAHLEGIKHTHLRELMGDTERCQSMMVEFDNIFLDYSRQQASPDTINKLYKLAEAAHLKQKIDSMYNGDHINSTEHRSVLHVTLRAPRNSAICSDGKNVVPDVWNVLDKIKDFSERVRNGSWVGATGKELKNVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYXXXXXXKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQG

SEQ ID NO: 14577 - protein, 282 aa, Ostreococcus tauri
MVRLLTPTPLRPIIKRLTAEAVEGAALALERVDDIHGGDRLSASVLGVGHGITDDVLEEHLEDASGLFVDETRDALDTTTASQASDRRLRDALNVVAKDLAVTLGAALSETLTTFTTARHCLVFERNSHIDELTANSPRLRQVTSAAARCRHKSTRSNTKQCLAVVKVVRVLRDNIQGITKPAIRRLARRGGVKRISGLIYEETRGVLKVFLENVIRDAVTYTEHARRKTVTAMDVVYALKRQGRTLYGFGDAKRFSSFVSSFLTLRNESFARVKIQGSRCP

SEQ ID NO: 14578 - protein, 837 aa, Cytophaga hutchinsonii
MKNETHILVVGNGMVGYKFCEKLKKKDSSGNFTITVLGEEPRPAYDRVHLSEYFSTRSADHLTMAPKEWYAANNINLVLGNPVVSIDREQKSVTTFSGAVYTYDKLILATGSAAFVPPIKGVEKDGIFVYRTIEDLEMMIKQAEKSKVGAVIGGGLLGLEAAKALLDLGLKPHVIEFAPRLMPRQLDEAGSKILQQKLESLGLSIHLNKTTSYFDGDAAVTAMQFADDTRLELDMVVISAGIKPRDEIAKKAGLTVGPRGGIEVNDALQTSDPNIYAIGECALHWGMIYGLVAPGYEMAEVVAENLIHEHSKAFRSFDMSTKLKLIGVDVASFGDAFGTEEGSVTITYENKDKGIYKRLNLSADKKRVIGGILVGDAESYNMLLQMVTNKMALPPDPEDLILGSRGEGRSEGGNAGVMSLPDEALICSCEGVTKGMICCAVTDQHVTDLPGMKKCTKAGTGCGGCVPMVNDLISETLKSQGKVIKKVLCEHFDYSRQELLDLIKINEYKSYDVILNEAGKGDGCEICKPAIGSILASVWNEVILKQATIQDSNDRFLANLQKGGTYSVVPRVAGGEITADKLIVLGEVAKKYDLYCKITGGQRIDLFGAPVHQLPDIWEELIHAGFESGHAYGKSLRTVKSCVGSTWCRFGVQDAVSYAIRIEDRYKGIRSPHKVKMAVSGCVRECAEAQSKDFGIIATDKGWNLYVCGNGGAKPQHALLFASDLDDETCIRYIDRIMIFYIRTAEPLMRTATWLNKLEGGMDYLRDVIINDSLGMCSQFEKELQLLVDTYHCEWKEVVENPELRKRFNTFINSEEADETMAFVEMRTQKKPANWKA

SEQ ID NO: 14579 - protein, 474 aa, Trichodesmium erythraeum
MSNLILFWHRRDLRISDNVGLTQASQEGQTVVGIFCLDENILKRDDIASARVTYMIGCLQHLQKRYKQIGSQLLIMSGKPIEAIPKLATFLEAKAVYWNLDVEPYSRKRDRQVKENLEAANIQVKTFWEQLLHSPEEIFTSTKKPYSVYTPFWKNWQGKKKSNPLNTPVLKGLTEDQLQYTKKIGVIDLPTAKQLGFNWDNKLILEPGETAALEKLEKFSNGAISSYQEQRNFPSLDGTSQLSVALKFGTIGIRTVWAKTQELIENCYSSEVFENIETWQKEIAWREFYQYVMYHYPELETGPYREHWKNFPWKNNKAHFQAWCEGNTGYPIVDAAMRQLNETGWMHNRCRMIVASFLTKDLIINWQWGEKYFMQNLIDGDLCANNGGWQWSASSGMDPKPLRIFNPVSQTQKYDPEGEYIRQWVCELRSVDTQYLVTGKIPAEEREAIGYPLPIVDHKKQQQLFKDLYREQKN

SEQ ID NO: 14580 - protein, 245 aa, Aspergillus niger
MSTPNIAQDFPELFDLQSNRFGDDLSSPESNMLSPQINTSFFSPMGEVAPPGTVSPKDLFFDASAPPSTTFTDLSTPPLDTPGFFSQNTSPMINTEMDLNAVPEEWESLFPQDGFSLDLDSAALELAASLQQPKATGPPPTPVIRASASPAPSASPAPSRQGTKHSTVAGVNARQRKPLPPIKFDSADPAAMKRARNTEAARKSRARKLERQGEMERRIEELERMLEESKQREEYWRSMAKTGTN

SEQ ID NO: 14581 - protein, 262 aa, Unknown
  Synechococcus sp. CC9605
MTTAEQTGTVYLVGAGPGDPELLTLKAHRLLSHCDALVYDSLVPEEVLDLVPATCERRFVGKRRGHHSVPQPSTNAVLVEMAQKHSTVVRLKGGDPFLFGRGGEEAAYLAERNIPVQVVPGVTAGIAAPAYAGIPVTHRRAGSSVTFVTGHEEIDKRRPSVDWRALAAASDGLVIYMGLHNLPRIAEELMAGGLAATTPVAVIQQGTVAGQRCLKASLVDIADQCRAEAFKSPSIVVVGEVIDHQVEACRPTPAAVTMPIPF

SEQ ID NO: 14582 - protein, 416 aa, Bordetella bronchiseptica
MQHAPVIQQDAPGLVVVGAGCAGVEAAFAARNAGWQGPITLLGEESAEPYHRPPLSKAFLQGTAGIDSLGLKQAALYERAAIARIGATRVTRIDRAARRLHCADGRTLPYGKLVLACGGRARRLDEALAEGGGHVHYLRTLDDARGLRARLEHSRRVVIVGAGYVGLEVASACRALGLAVTVLEAAPRVLARVTAPVVSAFYEATHRGQGVDLLLDTGVAALEPAGDGGVAAVHTSDGQRIPTDLVIAGIGLAPNVELAREAGLAVGDGIVVDAMLRTEDPDILAIGDCALAYNPRYGRAMRIESVPNALEHARQAAATVCGKPRELDPLPWFWSDQYGLKLKMAGVAHGHDQVVVRGDPRQGAFSVFYLKSGQLLAVDTVNRPGEFMAARKLIFSTIGQADRLADETRELKHWLA

SEQ ID NO: 14583 - protein, 312 aa, Ostreococcus tauri
MVEKHVLSSKRSLGRFERYARAHCLNSADTSCSSLGVLSAKFMKLLSETENGILDLNHAATSLSAQKRRVYDITNVLEGIGLVSKLSKSKVALRRVDEDFVETTSGQHKEHKSLSRTVNIESSQTLPLASEDDASLHIETIRSFIRSTGIFISQADIIEQHALSSDMLIAVRAPTGAALLLPSPFTQERSPPHYRLFLRSNENSSAGVEVFTLGRRSGTCDAHDVIQILNGFSSLCREAQRAVWLLNSCDVLYFDINKDHVPVSFATILEFDNVHHNVTLIRQLPTFFLGVLFCHFLQVGNVFGTYSQGEKF

SEQ ID NO: 14584 - protein, 262 aa, Fagus sylvatica
TNNIQRMRLYDPNQDALRALGGSNIELMLGLPNDNLQSIASSQANANAWVQNNVKNFGNVRFKYIAVGIEVKPSDSFAQFLVPAMQNIQNAISAAGLKNQIKVSTAIDTGVLGESFPPSKGSFRADYKPLLDPIIRFLVNNGSPLLVNLYPYFSYIRNTKDIRLDYALFTAPSTVVNDPPLSYRNLFDAILDAVYAALEKAGGRSLVIVISESGWPSTGGTATTLDNERTYITNLVQHVKGGTPKRPGRAIETYVFAMFDEN

SEQ ID NO: 14585 - protein, 726 aa, Chorispora bungeana
MEELDRSRAFGKDVKRIVVKVGTAVVTGKGGRLALGRLGALCEQLAELNSDGFEVILVSSGAVGLGRQRLRYRQLVNSSFADLQKPQTELDGKACAGVGQSSLMAYYETMFDQLDVTAAQLLVNDSSFRDKEFRQQLNETVKPMLDLRVIPIFNENDAISTRRAPYQDSSGIFWDNDSLAALLALELKADLLILLSDVEGLYTGPPSDPNSKLIHTFVKEKHQDEITFGDKSRLGRGGMTAKVKAAVNAAYAGIPVIITSGYSAENIDKVLRGLRVGTLFHQDARLWAPITDSSARDMAVAARESSRKLQALTSEDRNKILHDIADALEANEKTIKAENELDVAAAQEAGFEESLVARLVMTPGKISSLAASVRKLAEMEDPIGRVLKKTEVADGLLLEKTSSPLGVLLVIFESRPDALVRIASLAIRSGNGLLLKGGKEARRSNAILHKVITDAIPETVGGKLIGLVTSREEIPDLLKLDDIIDLVIPRGSNKLVSHIKNSPKIPVLGHADGICHVYVDKSGKLDMAKRIVSDAKLDYRAACNAMGTRLVHKDLEQEGVLNELIFALQTNGVTLYGGPRASAVLSIPEARSFHHEYCSKACTVEVVEDVYGAIDHIHRHGSGHTDCIVTEDPEVAELFLRQVDSAAVFHNASTRFSDGFRFGLGAEVGISTSRIHARGPVGVEKLLTTRWLMRGNGQVVDGNNGIVYTHKDLPVLQRTEAVENGI

SEQ ID NO: 14586 - protein, 455 aa, Thermobifida fusca
MRVSNSLIELVGNTPLVRLKKVTAGLAPTVLAKVEYFNPGGSVKDRIALRMVEDAERRGLLKPGGTIVEPTSGNTGVGLAIVAAEKGYRCVFVCPDKVGADKLAVLRAYGAEVVVCPTTVAPDHPESYYSVSDRLAATIPGAWKPDQYSNPNNPESHYYSTGPEIWEQTEGRITHFVAGIGTGGTITGTGRYLKEVSNGRVKVIGADPEGSVYSGGTGRPYLVEGVGEDIWPATYDTKICDEIIAVSDKDSFLMTRRLAKEEALLVGGSCGLAVVAALKVAAQAGPDDVIVVLLPDGGRGYLGKIFNDEWMADYGFLEPETEEATAGQVLAAKDDSLPEFVHTHPHETVGTAIAIMREYGVSQLPVMKEEPPVMAAEVVGAIAERDLLDALFNGRAQLGDPVEQHMRPPLPVVGSGEPVSRCVELLQSSGAVVVLEDGKPSGILTRQDLLAHLAS

SEQ ID NO: 14587 - protein, 718 aa, Brassica napus
MSFVGGVGGSGSGGGDGGGSGSGSQQHHDGSETDRKKKRYHRHTAQQIQRLESSFKECPHPDDKQRNQLSRELGLAPRQIKFWFQNRRTQLKAQHERADNNALKAENDKIRCENIAIREAIKHAICPNCGGPPVNEDPYFDEHKLRIENAHLRDELERMSTVASKYMGRPISSHLSTLHPLHISPLDLSMTGPSLDFDLLPGSSMHSHPNNNLATISEMDKPLMNDIALTAMEELLRLFNTNEPLWTRADGGREILDLGSYENLFPRSGNRGKNHNVRTEASRSSGIVFMNAMTLVDMFMDGVKWGELFPCIVASSKTLAVVSSGMGGTHEGALHLMYEEMAVLSPLVATREFCELRYCQMIEQGSWIVVNVSYHLPQFVSQSSHSYKFPSGCLIQDMPNGYSKVTWVEHVETEEKEQTHELYREVIHKGIAFGAERWVTTLQRMCERFASLLAPSTSSRDLGGVIPSPEGKRSMMRLAHRMVSNYCISVSRSNNTHSTVVAELNEVGVRVTAHKSPEPNGTILCAATTVWLPNSPQNVFNFLKDERIRPQWDVLSNRNAVQEVAHIANGSHPGCCISVLRASNASQSQSNNMLILQETSIDSSGALVVYSPVDLPALNIAMSGDDTSYIPLLSSGFAISPDGNHSSSTTEQGGGASTSSGFGGGGSLITVGFQIMVSNLPSAKLNMESVETVNNLIGTTVHQIKTGLNNCPSGSTTA

SEQ ID NO: 14588 - protein, 516 aa, Arabidopsis thaliana
MKQNETFDQEREDLYHTFDEEDEESQTESSVPSTPLSRNRSEDVPVPWPRSYRQSMDLLTGVTPPTSTSFVSSFRQRRQSSVFGSFTSSPSKQQLLIDKDEIQSSVVSSIKSFLASHLQLSVPGDLLTPQENRSCTFSQSVLNGINVLCGVALLTMPYAVKEGGWLGLFILFSFGIITFYTGILLKRCLENSPGIHTYPDIGQAAFGTTGRILVSASCVEYIIMMSDNLSRMFPNTSLYINGFSLDSTQVFAITTTLIVLPTVWLKDLSLLSYLSGVISSILLALCLFWAGSVDGVGFHISGQALDITNIPVAIGIYGFGFGSHSVFPNIYSSMKEPSKFPTVLLISFAFCTLFYIAVAVCGFTMFGDAIQSQFTLNMPPHFTSSKIAVWTAVVTPMTKYALTITPVMLSLEELIPSSSRKMRSKGVSMLFRTILVLSTLVVALTVPFFATVAALIGSFIAMLIALIFPCLCYISIMKGRLTNFQIGICILIVIIGIVSGCCGTYSAIARLIGEMT

SEQ ID NO: 14589 - protein, 543 aa, Arabidopsis thaliana
MKLDEEFLHDRDHSFLTDDEENQAALACSDDEHDGDDDGRRGGENSDSSSPLSRDRSDNNLSDVSNPPWPQSYRQSMDLLTGMTPPSVSFMPQSSSRRLASSFQKKQQSSFCDSLSSSSSKPLLSQPVPDKEETILPVNPQSQLKLSVTDLPLPEPNLCSFSQSVLNGTNVLCGLGLITMPYAIKESGWLGLPILLFFGVITCYTGVLMKRCLESSPGIQTYPDIGQAAFGITDSSIRGVVPCVEYIIMMSDNLSGLFPNVSLSIASGISLDSPQIFAILTTLLVLPTVWLKDLSLLSYLSVGGVLASILLGICLFWVGAVDGIGFHATGRVFDLSNLPVTIGIFGFGYSGHSVFPNIYSSMKDPSRFPLVLVICFSFCTVLYIAVAVCGYTMFGEAVESQFTLNMPKHFFPSKVAVWTAVITPMTKYALTITPIVMSLEELIPTAKMRSRGVSILFRTMLVTSTLVVALSVPFFAIVAALIGSFLAMLVALIFPCLCYLSILKGKLSNTQIGLCIFIIVFGVVSGCCGTYSAISRLANQMTD

SEQ ID NO: 14590 - protein, 541 aa, Streptococcus agalactiae
MTIDKRKVVYQIYPKSYKDTTGNGVGDLRGIIEKLPYLAELGIDMVWLNPFYPSPQRDNGYDISDYTAINPDFGKMDDFEEMIEVGRQYRIDFMLDMVLNHCSIEHEWFKKALAGDRYYQDFFILRDNPTDWVSKFGGNAWSPFGDTGKYYLHLFDITQADLNWRNADVRKELFKVVNFWRDKGVKGFRFDVINLIGKDEILENCPINDGKPAYTDRPITHDYLKMLNNASFGQADSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKQKLLVLNNFFAEKVKIKLPENYLQGQVLLSNYKDVTLDETVTLQPYQTLAILVS

SEQ ID NO: 14591 - protein, 340 aa, Unknown
  delta proteobacterium MLMS-1
MAGGVTVLGAGSWGTALAGVLAGKGLPVYLCCRDPQHAARMAAERENSAYLPGFKLPPGIQPTTDLGVVADCRAVVMAVPSHGFRSVFKRVIPHLAPDTAIVSATKGIENDSLLTMTAVMAEELAAADPSPACHLGCLAGPSFAREVAEGLPTAVTVAAASREEALFFQELFFTQRFRVYIGTDLIGQELGGALKNIIAIAAGISDGLGYGTNSRAALITRGLAEITRLGVAMGANPLTFSGLAGLGDLVLTCTGDLSRNRSVGLKLGQGMSLADILAEMRMVAEGVKTTRSARALAHRQGVEMPILEEVYLVLYEDKPCRQAVYDLLAREGKEELEFGG

SEQ ID NO: 14592 - protein, 152 aa, Pasteurella multocida
MQSTARTLSVNKHIALVAHDHCKQDLINWCKTHRTLLAQHTLYATGTTGNLIQKEANLPIKSLLSGPMGGDQQLGGLIAEKQIDVLIFFWDPMNAVPHDPDVKALMRIATVWNIPVAMNMATADFLITSPSFAQETQVRIPDYDGYLKERLK

SEQ ID NO: 14593 - protein, 255 aa, Elymus mutabilis
LDNIMRLTGITGIVNGMDVSEWDPTKDKFLAVNYDITTALEAKALNKEALQAEVGLPVDRKVPLVAFIGRLEEQKGPDVMIAAIPEIVKEEDVQIILLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 14594 - protein, 701 aa, Prochlorococcus marinus
MYLMLTVEGKNSVGKINLGTAWPLGSSITKRGVNFSVAAPNASYVELLLFNNANDSTPKEIVKLNSENKSGDYWHIEVEGITIGCNYAYRVYGKGDLGDANKHCGKILLDPCAREISGWDEFQRISSKEEIPNLSNCLKGIVSERDEFNFNAHPRPRHPWHKTIIYELHVGGFTRSVSSGLKSGNKGTFLGLIEKIPYLKDLGITTIELLPVFAFDPSDAPYGVENFWGYSPVNWFTPHQSFISKVDNLSPRDQFRKLVATCHDNGIEIILDVVYNHTTEGNENGPVISWKGFGESIYYHKNEQDEFLDVTGCGNTIAANQPIVRQLILESIKCWSQELGVDGFRFDLGVALSRGKDLAPLDSPPIFEEIESDPLFSELKLISEPWDCGGLYRLSDFPAKRVSTWNGHFRDDLRRFWKGDKDSTWALKDRLLGSPSIYKNNKNSVEKSINFITSHDGFTLIDLVSFDKKHNLSNGESNRDGENHNNSWNHGVEGPTTNQKLNMIRQRQQRNLLSSLLLSPGVPMLLMGDEVGRSQGGNNNAWCQNTSIGWMIWNTGSCDNELKDFVKNLISIRKNLSEFFSPETTPISHPSISQNNKNHWVQWHGVKTNTPDWGSWSHTISYSINKGDQGSLMWLGLNAYDQSMKFQLPHPISAWMKLIDTTSNMNDGLNSKEISNQNEIHLESRSLVLLASNEYRKSLSV

SEQ ID NO: 14595 - protein, 258 aa, Triticum aestivum
SGTGKTSMIALTVCQVVDTSVREVQALILSPTRELASQTEKVILAIGDFINIQAHACVGGKSVGEDIRKLEYGVHVVSGTPGRVCDMIKRRTLRTRAIKMLVLDESDEMLSRGFKDQIYDVYRYLPPDLQVCLISATLPHEILEMTNKFMTDPVRILVKRDELTLEGIKQFFVAVEREEWKFDTLCDLYDTLTITQAVIFCNTKRKVDWLTEKMRNNNFTVSSMHGDMPQKERDAIMGEFRAGTTRVLITTDVWARGL

SEQ ID NO: 14596 - protein, 353 aa, Pseudomonas fluorescens
MYPKNAWYVACTPDELQGQALGPARSAAKRMVFYRAHEGRVAAVEDFCPHRGAPLSLGYVENGNLVCGYHGLVMGCDGKTVEMPGQRVRGFPCNKTFAAVERYGFIWVWPGDQALADPALIHHLEWADNDQWAYGGGLFHIQCDYRLMIDNLMDLTHETYVHASSIGQKEIDEAPPQTTVDGDQVVTARHMHNVMPPPFWRMALRGNQLADDVPVDRWQICRFSPPSHVLIEVGVAHAGHGGYDASAQYKASSIVVDFITPESDTSIWYFWGMARNFNPQDQALTESIREGQGKIFSEDLEMLERQQQNLLAQPQRSLLKLNIDAGGVQSRRVLERLIAQEPEPREALIAASR

SEQ ID NO: 14597 - protein, 255 aa, Elymus mutabilis
LDNIMRLTGITGIVNGMDVSEWDPTKDKFLAVNYDVTTALEGKALNKEALQAEVGLPVDRKVPLVAFIGRLEEQKGPDVMIAAIPEIVKDEDVQIVLLGAGKKKFERLLKSVEEKFPGKVRAVVRFNAPLAHQMMAGADVLAVTSRFEPCGLIQLQGMRCGTPCACASTGGLVDTIVEGKIGFHMGRLSVDCNVVEPADVKKVATTLKRAIKVVGTPAYHEMVKNCMIQDLSWKGPAKNWEDVLLELGVEGSEPG

SEQ ID NO: 14598 - protein, 376 aa, Crocosphaera watsonii
MPGDYYDILGVDRNANKEDLKKAYRRLARQYHPDVNKEAGAEERFKEINRAYEVLSEPETRSRYDQFGEAGVSGSGGFNYGDMGDMGGFADIFETIFSGFGGGMGTGGTRRRTGPTKGDDLRLDLKLDFREAVFGGEKEIRIPHLETCQVCKGDGAKPGTGAKTCPTCNGQGQVRRATRTPFGSFAQVTTCPTCNGQGQIIEEKCEVCNGAGRRQVTEKVKITIPGGVDDGTRLRVSRKGDAGLRGGTPGDLYVYLYVEADKVFTRDKMNILSEITISYLQAILGCTVAVDTVDGEQELSIPAGTQPNTILTLENLGVPKLGNDAIRGDHLITVKVDIPTRINAEERDLLEKLAHIKGQSHGKGGLEGFLGSLFHK

SEQ ID NO: 14599 - protein, 499 aa, Clarkia heterandra
  misc_feature (221)..(231): Xaa can be any naturally occurring amino acid
MASPALISETEAWKDLKAHLEGIKMTHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKNFSDRVRNGSWIGATGKELKDVIAVGIGGSFLGPLFVHTALQTDPEASKNARGRELRFLANVDPIDVARNISGLNPETTLVVVVSKTFTTAETXXXXXXXXXXXSSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSISILLPTLDAYRIGQLLAIYEHRVAVQG

SEQ ID NO: 14600 - protein, 2042 aa, Cytophaga hutchinsonii
MNQKIRNLIIICAGLFFLSTHLSAQTPYFTPAEYKKALWMTTRFYGGQRAGDNNWLLYNHLPSGVNASLRGKSFLQDGDAGYDLSGGWFDCGDHVKFGQTEYYSAYMLLKGYAEFPTGYGDYYAYDYQGYKTANSWNWEGTGHSPNGIPDILDEVKHATDYFIKCAKNSTTFYYQVGQGGPDHMLWETAVQMQTESVGNGGEPRVVYKNPSDASMPSFCGATLALMSRLYRQYDAAYADLCLEHAKYAYDYAKAHPGTIGSPDGGFYPANSNWRDDYSSMCAELFWATNTAAYKTEALSFTIAASGSANITGNTYGFDYSNNGDIAIYNQALLGNTSAKGVLNTIVTSNYLGNVQGDGQFNGGNTTWGPTRYNANTAFIVALWQKLYGTDATPHKYIYDNIDYLLGKNSSNQSFIVGFGTKSPKFPHHRNVYLRDNNPSDAVKATMTIPAKNQQFGLMVGGSRNASSFSDNVVNYQHTEGGIDYNACLVGVLAYLNSVLAPVSQHPSPNLGADKSLCGTGSIVLNSGIATDTKKTFTWKKDNVVVQAASTTANTYTATAAGTYVVVLDSAGKWSTQDEIIITATLPAFSLGSGVQLCNPATATLDIGATGTGYTYQWKKNNVVLVGATAKTLEVSSAGTYVGTLSASGCTSTTSSVIVTSSLPVAGNDTLCAAGTAALTITGSGGPYQWYTAATGGTLLTTGTSYSPSVTASTTYYVQDGSSVSVTAGPSSASNPLSGGTNGGNVGMKFTASKAFTITQLKILPYVYSCGSSDNVFATFDLSKDGTKIGTYTSSSVPCTGTQSGSPFNTFYTLNFPTAISIPGAGNYTLTPNGGNAIVWFASGANFSTMDAAGVMDITDDTRDDMANSFPGIFDIKIQSGSGCARTPVYAIVNAAFPNCKASKSAQTITFGALPAKVYGDAPFTLAATASSGLAVTYTSSNPAVATVTAAGVVTIVGAGTTVITANQAGNTNYNAATAVPQTLTVGKANQTITFATLPAKTVGDADFTLAATASSGLAVTYTSSNPAVATVTTAGVVTIVGAGTTVITANQAGNANYNAATAVPQTLTVGKANQTITFATLPAKIVGDADFTLAATASSGLAVTYTSSNPAVATVTAAGVVTIVGAGTTVITANQAGNTNYNAATAVPQTLTVGKANQTITFATLPAKIVGDADFTLAATASSGLAVTYTSSNPAVATVTAAGVVTIVGAGTTVITANQAGNANYNAATAVPQTLTVGKANQTITFGTLPAKTVGDASFSLTATASSGLAVTYTSSNPAVATVTAAGVVTIVDAGTTVITANQTGNANYNAAPAVTQTLTVNTPAKTNQTITFGTIPAKTVGDASFSLTATASSGLAVTYTSSNPAVATVTAAGVVTIVGAGTTVITANQAGNTNYNAATAVPQTLTVGKANQTITFATLPAKTVGDADFTLAATASSGLAVTYTSSNPAVATVTTAGVVTIVGAGTTVITANQAGNANYNAATAVPQTLTVGKANQTITFATLPAKIVGDADFTLAATASSGLAVTYTSSNPAVATVTAAGVVTIVGAGTTVITANQAGNATYNAAPAVTQTLTVGKANQTITFGTIPAKTVGDASFTLTATASSGLAVTYTSSNPAVATVTAAGVVTIVGAGTTVITANQAGNATYNAAPAVTQTLTVNTPAKTNQTITFGTLPAKTVGDASFTLTATASSGLAVTYTSSNPAVATVTAAGVVTIVGAGTTVITANQAGNATYNATPAVTQTLTVNTPAKTNQTITFGTIPAKTVGDASFSLTATASSGLAVTYTSSNPAVATVTSAGVVTIVGAGTAVITANQAGNTTYNAAPAVTQTLTVNAPAPVSVIQVLTSTSAIVENDGATINIGSNLMNTSTSLYTFTIKNTGSSNLIIDNIVGSTGFSANQISPSGPILPNSSATFTISGIPNNVGSPRQGTATIFYNSKIFTINVSVSVGTPTGVATMLSQSDIEIYPNPTSGNSNLEFKGTFDNIEVTIYSIDGSKISVSQLGSASSSVGTVEVQELPSGVYLVEVNTTQGKLIKRLIKE

SEQ ID NO: 14601 - protein, 496 aa, Unknown
  Rhodococcus sp. RHA1
MNLPQHVHTLIVGAGFAGMGLAARILQTQPQADVLIIERGDDVGGTWRDNTYPGCACDVPTSLYSYSFAPSADWSHTFARQPEIHRYLKKVAADTGVRSRVVTDCELQEAHWDADEAVWTVRTSRGTVTADVVVAATGALSTPSVPDMPGLETFGGTTFHSATWNHDHDLTGERVAVIGTGASAVQFVPEIAPVAEHLTVFQRTPAWVIPRLDRELSGSEKRLYRRLPLVQKAVRGTVYGFREALGGVLAHATGLLPVFEMVAKAHLRRQVRDPELRRKLTPNFTIGCKRMLLSNDWLRTLDRPDVTLVDAGLAGVTPDGVVDALGNEHKVDTIIFATGFTPTEPPVAHALRGANGRTLAEHWDGSPSAYKGTTVAGFPNLFLMYGPNTNLGHSSIVYMLESQSAYIADALNVMHHSEITAFEVTEEAQRRYNTRIQSELQTTVWNKGGCSSWYYDSEGRNSVQWPTFTWKFRSQLQRFDQENYVSRRRAAKETVA

SEQ ID NO: 14602 - protein, 559 aa, Clarkia heterandra
MATPTLISETEAWKDLKAHLDGIKRTHLRELMGDTERCQSMMVEFDNIFLDYSRQQASPDTINKLYKLAEAAHLKQKIDRVYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGISAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEEGFNFSTKTLLTRYLQATSDV

SEQ ID NO: 14603 - protein, 978 aa, Cytophaga hutchinsonii
MIKKTSLLLFAYLIVFTHQLFSQTPYFTSTEYKKALWMTTRFYGGQRSGDNNWLLYNHLPSGVDASLRGKAFIADKDGTYDLSGGWHDCGDHVKFGQTEFYSAYMLLKGYAEFPAGYGDYYAYDYQGYKTSGSWSFEGTGHAPNGIPDILDEVKHATDFFIKCAKDATTFYYQVGQGDPDHKQWVTAVKMQTLSVANGGQTRATYKNPNDASMPSFCGATLALMSRLYRPYDAAYADLCLVHAKYAYDYAKTKTSTVGSPDGSFYAANDNYKDDYSTMCAELFWATNTASYKTEALSFSISTAPGQGADIYGKNYGFDYSNNGDIAIYNQALLGNTYAKDVLNSIVNSFYLNNTRSDGQFNDGNTSWGPLRYNANTAFIVALWQKLYGTSATPNKYIYDNIDYILGKNSSNQSFVVGFGTKSPAHPHHRNVYLSDANTPVNSLAIPAKNQQFGLMVGGTRNAGSFNDNLETYTHTEGGIDYNACLVGVLAYINSVLSPVVTHSTPSLGADQSLCGKTSIVLNSNVNVDNIKTYTWKNGTTIVQAASKTAKTLTVTSAGTYTCILDSLGIWSTQDEIVITSTLPAVNLGATKQLCNPATATLDIGASGTGYTYQWKKNNVVLLGETSKTLVVHKSGTYIGILSATGCPSTSGSVTITSLLPNAGNDTLCSAGIANLSISGSGGPYQWYTAATNGTLLTTGTTYKPAVSAPVTTYYVQDGGSVNVTAVPSNTGFTGPQNAGSIGITFTAAKAFTITQLKVLPYVYSCNGENVFVTFDLFQGTTKLASYTSSSVVCTGTQSGTTFTPYTLNFPTAINIPAAGSYTLTPSAGNQLVWYSGGADYTTMDVSGVIDVTGPTSTYQPNSFPGIYDIKILSGSGCARTPVYAVVNSNYPSCKITTDINTSAQAKGYNIYPNPSNETFRLTSPSTVDITIMNALGQAVESFSNITELNFGQHLKPGMYYVIMSQDGLTIQTMNIIKY

SEQ ID NO: 14604 - protein, 206 aa, Arabidopsis thaliana
  misc_feature (2)..(2): Xaa can be any naturally occurring amino acid
HXSPPPPPKSVSKRAKEEEKQQEVVMASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 14605 - protein, 711 aa, Yersinia enterocolitica
YKDTILLTPIIRKFQYGQHTVTIETGMMARQATAAVMVSMDDTAVFVTVVGQKKAKPGQSFFPLTVNYQERTYAAGRIPGSFFRREGRPSEGETLTSRLIDRPIRPLFPDSFLNEVQVIATVVSVNPQINPDIVALIGASAALSLSGIPFNGPIGAARVGFINDQYVLNPTTDELKESRLDLVVAGTAGAVLMVESEADILSEDQMLGAVVFGHEQQQVVIENINALVAEAGKPKWDWHAEPVNEALHARVAELAAARLGDAYRITEKQERYTQVDAIKADVTEALLAQDDTLDAAEIQDILGSVEKDVVRSRVLRGEPRIDGREKDMIRGLDVRTGVLPRTHGSALFTRGETQALVTATLGTARDAQNIDELMGERTDSFLLHYNFPPYSVGETGMVGSPKRREIGHGRLAKRGVLAVMPSPSEFPYTVRVVSEITESNGSSSMASVCGASLALMDAGVPIKAAVAGIAMGLVKEDENFVVLSDILGDEDHLGDMDFKVAGSRDGITALQMDIKIEGITREIMQVALNQAKGARLHILGVMEQAISTPRGDISEFAPRIYTMKINPEKIKDVIGKGGSVIRALTDETGTTIDIEADGTIKIAATDGDKAKHAIRRIEEITAEIEVNRIYAGKVTRIVDFGAFVAIGGGKEGLVHISQIADKRVDKVTDYLQMGQEVPVKVIEVDRQGRIRLSMKEATTPDAEAPAPEAAE

SEQ ID NO: 14606 - protein, 261 aa, Xylella fastidiosa
MRTMTQSRWRLDGRTALITGASTGIGLAVARELLGLGADVLLVARNADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVYYYEQVIERTPMRRIGEPEEVAAAVAFLCLPASSYVTGECIAVDGGFMRYGF

SEQ ID NO: 14607 - protein, 380 aa, Clarkia dudleyana
MASPALISETEAWKDLKAHLEGIKTTHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSSVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 14608 - protein, 157 aa, Brassica napus
  misc_feature (2)..(2): Xaa can be any naturally occurring amino acid
  misc_feature (8)..(8): Xaa can be any naturally occurring amino acid
  misc_feature (10)..(11): Xaa can be any naturally occurring amino acid
  misc_feature (18)..(18): Xaa can be any naturally occurring amino acid
  misc_feature (26)..(26): Xaa can be any naturally occurring amino acid
  misc_feature (29)..(30): Xaa can be any naturally occurring amino acid
  misc_feature (36)..(36): Xaa can be any naturally occurring amino acid
  misc_feature (44)..(44): Xaa can be any naturally occurring amino acid
  misc_feature (48)..(48): Xaa can be any naturally occurring amino acid
  misc_feature (50)..(50): Xaa can be any naturally occurring amino acid
  misc_feature (52)..(52): Xaa can be any naturally occurring amino acid
  misc_feature (55)..(55): Xaa can be any naturally occurring amino acid
  misc_feature (57)..(57): Xaa can be any naturally occurring amino acid
  misc_feature (64)..(64): Xaa can be any naturally occurring amino acid
  misc_feature (67)..(67): Xaa can be any naturally occurring amino acid
  misc_feature (70)..(70): Xaa can be any naturally occurring amino acid
  misc_feature (73)..(74): Xaa can be any naturally occurring amino acid
  misc_feature (92)..(92): Xaa can be any naturally occurring amino acid
  misc_feature (104)..(104): Xaa can be any naturally occurring amino acid
  misc_feature (106)..(106): Xaa can be any naturally occurring amino acid
  misc_feature (112)..(112): Xaa can be any naturally occurring amino acid
  misc_feature (114)..(114): Xaa can be any naturally occurring amino acid
  misc_feature (119)..(119): Xaa can be any naturally occurring amino acid
  misc_feature (124)..(125): Xaa can be any naturally occurring amino acid
  misc_feature (129)..(130): Xaa can be any naturally occurring amino acid
  misc_feature (132)..(134): Xaa can be any naturally occurring amino acid
  misc_feature (136)..(141): Xaa can be any naturally occurring amino acid
  misc_feature (143)..(156): Xaa can be any naturally occurring amino acid
MXSSMLSXAXXVTSPAQXTMVAPFTXLKXXAAFPVXRKGNNEIXSIAXNXGXVSXMXVCPPVRXKKXETXSYXXDLTEVELAKEVDYLLRNXWIPCVEFEWEHXFXVYRGHXSXPGYYXGRYWXXRKPXXFXXXDXXXXXXGXXXXXXXXXXXXXXK

SEQ ID NO: 14609 - protein, 486 aa, Burkholderia pseudomallei
MSSSISIAPAVVWFRDDLRVSDHPALMRAAESGRPVIGVYVFDERAGGRPLGGAARWWLHGSLRALGAALAALGGTLALLRGDEHDTIVSFAAALGAGAVYWSRRYALAARAVDNAVQTALDAQGIAVETFNASLLFEPGDLVNADGRPYQVFSAYWRAAMRRGVPAPPLGAPRRLNGGALPAALARQCVALDALGLEPTGPDWAGGLRDAWRFGEDAAHRRLRAFVDSRLGGYAAERDRPGIASTSRLSPYVRFGNLSARQLWHAAADAYAHGAATQADLDKFLSELGWREFGWTQLHHFPDLPRRNLRHTLDGMPWRDDPAALAAWRRGATGYPFVDAGMRELWATGWMHNRVRMVCASFLVKHLLIDWRAGEAWFWDTLVDADAASNAANWQWVAGCGADAAPYFRIFNPVAQGRKFDPDGAYVRRWVPELAGLPPATIHEPWAAPGAQLAAAGVRLGETYPLPIVAHDAARRRALDAFGAIR

SEQ ID NO: 14610 - protein, 424 aa, Burkholderia thailandensis
MSNANPFFSQSLAERDASVRGAILKELERQQSQVELIASENIVSRAVLDAQGSVLTNKYAEGYPGKRYYGGCEFADEVEALAIDRVKQIFNAGHANVQPHSGAQANGAVMLALAKPGDTVLGMSLDAGGHLTHGAKPALSGKWFNAVQYGVSRDTMLIDYDQVEELAQQHKPSLIIAGFSAYPRKLDFARFRAIADSVGAKLMVDMAHIAGVIAAGRHANPVEHAHVVTSTTHKTLRGPRGGFVLTNDEEIAKKINSAVFPGLQGGPLMHVIAGKAVAFGEALTDDFKTYIDRVLANAQALGDVLKAGGVDLVTGGTDNHLLLVDLRPKGLKGAQVEQALERSGITCNKNGIPFDAEKPTITSGIRLGTPAGTTRGFGAAEFREVGRLILEVFDALRTNPAGDHATEQRVRREIFALCERFPIY

SEQ ID NO: 14611 - protein, 380 aa, Clarkia dudleyana
MATPSLISETEAWKDLKAHLEGIKRTHLRELMGDTERCQSMMVEFDNIFLDYSRQQAAPDTINKLYKLADAAHLKQKIDRMYNGDHINSTENRSVLHVALRAPRSSAICSDGKNVVPDVWNVLDKIKDFSERVRSGSWVGATGKELKDVIAVGIGGSFLGPLFAHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 14612 - protein, 1378 aa, Unknown
  Rhodococcus sp. RHA1
MQQQKAGTSTVKTACSYCGVGCGMVLEVGIDPETSARRVLKASGDKDHPTNFGRLCTKGATSAEMLVAGGRMETGYVRDERGEAPTSIDVGAAISETARRLKAQLDEHGPDALSFYVSGQMSIEAQYLITKLAKGFVGTNQIESNSRLCMASAGTGYKQSLGADGPPGSYQDFDKADVFFVIGANMADCHPILFLRMMDRVKAGAKLIVVDPRRNATADKSNLFMQIAPGTDLALLNGLLHLLVKNGHTDPEFIAEFTEGWEVMPEFLEEYTPEKVAEITGIPESEIRRAAQWIGEAENWMSCWTMGLNQSTHGTWNTNAICNLHLATGAICRPGSGPFSLTGQPNAMGGREMGYMGPGLPGQRSVLAADDRAFIEDLWELPEGSIRTEVGTGTVDMFERMVAGEIKACWIICTNPVATVANRRTVIEGLEAAELVITQDVFLDTETNGYADILLPGALWAESDSVMINSERNLTLLQQAVDPAGQALPDWQIIARVACEMGYADAFTYDSSEDVFEEIKRTWNPRTGYDLRGITYDRLRETPVQWPSPPGNRTDRNPLRYVNDGVSQNLLSAPDGSLPRLAFATATGKAAFFPRPHMLPAEMPDDDYPFVLNTGRLQHQWHTMTKTGKVAKLNKLHSGPFVEINPADAQKLSITDGDKVEVASRRGRAVLPAVVSDRVLAGGCFAPFHWNDSFGEYLSINAVTNDAVDPTSFQPEFKACAVSLTRVAPVSAPEVPETGGALTLAQGSPAAEMSRILGLDDSASPTFDEHERMYLAGLLSGLQSTAIQGVPVLPRSAPISGSKRVWLDGLMAGLFSRSDVPQSVVVPDANAESVQHPVVVVWASQTGNAEEFAAECAEQLEAAGHGTRLTSMDDYDVAGLADVRDLLIITSTFGDGDAPDNGSSFWSALSSDEAPKLSQTRYAVLAFGDSNYDDFCGHGKRIDARLEQLEAKRLTERVDCEPDYEEQARQWLTQVQKLVRERAAADGATVVASTPAPARPAAKKAATFTRKTPLITRLTKNIPLSAAGSSKDVRQFGFEVSDPEFTYEAGDALGVWPTNSDAVVDEWLKVTRSIPDTPVKLPDLPEMTLREALRTKLEITKVTPELLRFVQSRTQDTELARLLRPQNKIALQQWLWGRQSMDVLAEYGVDADADEWLSVLKRLQPRLYSISSSPKVDPGEVQLTVSAVRYNHEGKNRAGVCSTFLADHCDEADVPIFVQKSAHFRPPQAADAPMIMVGPGTGIAPFRGFLHERRELGHTGKNWMFFGEQHEATDFYYREEMEAMHRDGFLTHLDAAFSRDQRQKIYVQDRIREHGAKLWGWMQEGASLYVCGDASRMAKDVDETVREVVRTHGRLDEEDTELYMKQLATDKRYVRDVY

SEQ ID NO: 14613 - protein, 104 aa, Campylobacter coli
MGKYIELTSDNFAQAKEGVALVDFWAPWCGPCRMLAPVIDELANDFDGKAKICKVNTDEQGDLAAEFGVRSIPTLIFFKNGEVVDQLVGAQSKQAISDKLNSLL

SEQ ID NO: 14614 - protein, 380 aa, Clarkia dudleyana
MATPALISETEAWKDLKAHLEGIKRTHLRESMGDTERCQSMMVEFDNIFLDYSRQQASPDTINKLYKLADAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEI

SEQ ID NO: 14615 - protein, 312 aa, Campylobacter coli
MLDVAIIGGGPAGLSAGLYTTRGGLKNVVMFEKGMPGGQIISSSEIENYPGVAQVMDGISFMAPWSEQCMRFGLKHEMVGVEQISKNEDGSFTIRLEGGKTELAKAVIVCTGSAPKRAGFKGEDEFFGKGVSTCATCDGFFYKNKEVAVLGGGDTALEEALYLANICSKVYLIHRRDEFRAAPSTVEKVKKNEKIELITSASIDEVYGDKMGVTGVKVKLKDGSIRDLNVPGIFTFVGLNVRNEILKQDDGKFLCNMEEGGQVSVNLKMQTNVPGLFAAGDLRKDAPKQVICAAGDGAVAALSAMAYIESLH

SEQ ID NO: 14616 - protein, 260 aa, Fagus sylvatica
STMALSSPSLAGKAVKLAPSTPELNVGRVSMRKSASRNVSSGSPWYGPDRVKYLGPFSGEPPSYLTGEFPGDYGWDTAGLSADPETFAKNRELEVIHSRWAMLGALGCVFPELLARNGVKFGEAVWFKAGAQIFSEGGLDYLGNPSLIHAQSILAIWATQVLLMGAVEGYRIAGGPLGEVTDPLYPGGSFDPLGLADDPEAFAELKVKELKNGRLAMFSMFGFFVQAIVTGKGPIENLADHLADPVTNNAWAYATNFVPG

SEQ ID NO: 14617 - protein, 240 aa, Oryza sativa
  misc_feature (40)..(40): Xaa can be any naturally occurring amino acid
  misc_feature (120)..(120): Xaa can be any naturally occurring amino acid
MAGGGGAGELKLLGHWASAYVTRVKLALHLKGVSYEYVEXEDLRNKSDLLLASNPVHKTVPVLIHNGNPIRESQIIVQYIDEAFSGAGDSLLPADPHERAVARFWTAYIEDKLVAPWEKXVFRAKTEEERAAWMKQMFVAVEALEGGLKECSKGKGCFFGGDSVGYVDVVLGGGVSFVHANDVITGGKLFDAAKTPLLAEWLGRFGELDAAKAVLQDVDRAVEYTKVLYARNAATTAANN

SEQ ID NO: 14618 - protein, 181 aa, Unknown
  Vibrio sp. Ex25
MKGLLKLVALVGFLSMNSLALASECPDILQGKQRLLNSTEEVDLCESFKGKTLLVVNTASQCGFTPQFEQLETLYQTYKEQNFTVIGFPSNDFRQDRGSETNTAKVCYLDYGVTFPMMARSSVLGVDANPVFSEITNQAGIKPKWNFYKFLISSEGKVIATFPSSTSPTSTTLTNMIEQQL

SEQ ID NO: 14619 - protein, 1014 aa, Burkholderia pseudomallei
MPGKLKELLIQPFKLNHRKALFDPRRMLAHQRLLTYGGAIGISAFILFCLLLMIRMEAMDYVSNARSEFLIQQSKLTIKLQIRRTALMRAVMHAEGLWNRRIEPSTELLSQFDAHQGYAVLHTPQGAPAALAVGIPAPGRSASAFAPYLALLETQLLMGDGQSPLPDDRVEGYSFSPDGTYLSLLWSREDQAPEAFIESHSASGLIGDAMRGIRYLRDASTIVPLRADRRTVWLPPHPDPLTGKPMIRIVQPAIDATGKLFAIYVRSLPLDMFYSNLNDAPAGSTLTIVDRKGNVILGSSNQHGGDGGATASALGIRSLGDGFGGLVERYQDGMFVTSDQLPGTDWVLVHAYSWKTIAAALALRFSLVTGLVAGIIVMLWLFAIQFDRKGLIPNYRRAQRLLESEVLNRTILRTAPVGLGLLSAQDGSVLLQNNAMLELSARTSDEPLPIRLWEAYRHAVGRSSDEDGALLQHDLAIEREGANPVYLQANVVAARYRGANVLLCTLLDISLRKESELKLKEARIAADQANKAKSTFLATMSHEIRTPLNAIIGNLELLRRSPLSEQQSERLHVVESCSNALLHIINDILDLSKVESGQMTLENIPFDIHALLQETVDAYAPLAESKGLALLSSIGEGVARHYAGDPTRIRQVLSNLIGNAIKFTERGHISIDVHRAKAARDGSAIEIWVNDTGIGIRPDRIATLFDVYTQADASIHRRFGGSGLGLPLCQRLVTIMGGSIEIDSLPDFGTTVTVALPLREARHATALSNGPAARRRNATALARPTLHVLVAEDHPANRALLRDQLEALDHRVDVVENGREALRAFGEHQYDIVLTDLGMPELDGYGFARFANKMRAGTPIVAMTAHATDEDYQRSKKVGIAEIVLKPLSLTTLEKVLQRHAMRAPAEEIVTAAGPGPAHAEPRMRALPPAVAAALRTATLQSIDKIAQALAARNFETIRQELHSIKGGFALTGNRLLIARCAATEELAEAEDLDTLRAAWRKLEASLLEALERL

SEQ ID NO: 14620 - protein, 471 aa, Zea mays
MEADSGKLFVGGISWETDEDRLRAYFGRFGEVTEAVIMRDRNTGRARGFGFVVFADSGIAERVTLDKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNFLNGFNQGYNPNPLGGYGMRVDARYGLLAGARNGFSSFGPGYGMGMSVEGGMRGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMSNISSLGSGNLGRGTGDNNFGLPSGNYVRSNSTGTIGEPFSAAGNTYEVNNRDTYGSSSIYGGTAWRFASSEDATYQSWPVDAHGGVLQDELIKEHELREKDPVVLGKDQLGALM

SEQ ID NO: 14621 - protein, 794 aa, Gibberella zeae
MTDRYVAVHEAANGPGDARPTADQIIKDENLEGKLKDHVIFLTGCSAGIGVDTAKALYLTGATLYLTARNLDKAKTALGDLVQDDRVHLLELDLESLDSVRSCAAKFLSESLKLNILICNAGVMCTPEGRTKEGFETQFATNHLAHFLLFNLLRPSLQKGVKPDRAARVVMLSSLGHRFGEPDFNNINMEGCYDPHKAYVKSKTANLWTANEIERRYGSEGIHAWSVHPGAVLTDLGRHLSEEQKNSLGGDPYLNSVWKFSSQGAATTVWAATAEALEGQGGRYLEDCQIIGKWDPSTSRYAPGYGDHAYDEGKAKAFHIFNSCISNATSPFIDFVFPSLAVTLVVYRVAKGVPIKNSKPCKLQASILVGVQKDTLLAKDIDCFTCPFLATSKRLPGVNPLDSIELFLRRRIGLADSPKAMRIVSCNHSYLCHFLEGCRQPWIGFLSPNFKNTAHFRQKVEAVASAQLTSVTFNYPIHIFHRFRLIFTKTLHKPTSTALPLNMESITTEPPQYDVLFKDQDFPGSLPTPNDTESGEPLPIDRTFCDKLVRIRNDFIMKYGPEVKPIEAHNMLYVAKNTSLVVPKVYAIYQGKETPQNFTYILMQHIQGKTLKELWPELDGTRKTSIAKTLRDSLQQLRRLQHPGYFGNIDGGPPLDDVFTGTQGGLKNVTSPFATEEELINSVIRIFSLETRSWSVNLVKYYQYVLPTVLHSNKAPVFTHNDLQRKNIMVQDDGTIVIIDWEYSSWYPVYWEYSTAMFANGGWRDDWGEYLRIILDEYLNEAVWICQMKTQMWS

SEQ ID NO: 14622 - protein, 306 aa, Unknown
  Erythrobacter sp. NAP1
MKATSILETIGNTPHIRLSRMFPDHEVWLKSERANPGGSIKDRIALAMVEDAEASGALKPGGTIVEPTSGNTGIGLAMVAAVKGYTLVLVMPESMSIERRRLMLAYGATFDLTPKEKGMKGAIERATEIVETTEGAWMPSQFDNGSNPAVHARTTAKEILGDFADNPIDVMITGVGTGGHLTGCAEELKKSWSDFKAYAVEPVGSPVISGGEPGPHPIQGIGAGFIPGNLHTNAIDGAIKVDPEDAKEMARRAAREEGMLIGISSGATLAAIAQKLPDLAAGTRIMGFNYDTGERYLSVPDFLPVE

SEQ ID NO: 14623 - protein, 179 aa, Oryza sativa
MIISKKNRREICKYLFHEGVLYAKKDYNLAKHPKVDVPNLEVIKLMQSFKSKEYVRETFSWQHYYWYLTNDGIEHLRSYLNLPSEVVPNTLKKSAKPPSRPFGSGPPGDRPRGPPRFEGDRPRFGDRDGYRGGPRGAPGDFGGEKGGAPAEFQPSFRGSRPGFGRGGGGAFGGGASSME

SEQ ID NO: 14624 - protein, 344 aa, Triticum aestivum
  misc_feature (103)..(103): Xaa can be any naturally occurring amino acid
MDMIDSIECVSSSDGMEDDDAMSSNLPRPFLKASAAAIAAASIGVVPGGVGGASGAGAAGGIAGPLIPPATSVHELLECPVCTNSMYPPIHQCQNGLPLFYCXTGWLRCYTATLPSDYSWGDIRCLSSLEKVAESLELPCKYYSLGCPEIFPYYSKLKHESQCNFRPYSCPYAGSECSVVGDIPFLVSHLRDDHKVDMHSGCTFNHRYVKSNPREVENATWMLTVFHCFGQYFCLHFEAFQLGMAPVYMAFLRFMGDENDARNYSYSLEVGANGRKMIWEGTPRSIRDSHRKVRDSHDGLIIQRNMALFFSGGERKELKLRVTGRIWKEQQNPDSGACIPNLFS

SEQ ID NO: 14625 - protein, 380 aa, Aspergillus nidulans
MVATHIEYTKENPLNREPPVRELVSSFITPSSTSYDRNHGPIPHLSADTHTIEVDGLVKTPLRLSVHQLATEFPQHEVLCALECAGNRRHTMRTMLKEVDGIDWGDAAIMNCKWRGPRLRDVLHRAGVDQCKGRPGLHVAFSSFQVQCEEDEWFGGSVELERGLDEEADVILALEMNDAPLEPRHGFPVRVVLPGIAGARWVKWLDRITVQDQESTNFYQRRDYKVLPEEAVNRDAAEPFWDQTPAISEISINSVVAVPEDNETVYLSDVGKLEVKGYAVPQGSGGPVVKVQVSGDGGRTWIDAEIGKSESAGADGRVRKWCWVLWRVEVEVETGEGKEVISRAIDAQGNMQAEHSQWNLRGVGYSGYGRAKNLTVRYRE

SEQ ID NO: 14626 - protein, 709 aa, Streptococcus agalactiae
MSKQVFEMIFAGKKLVVETGQVAKQANGSVVVRYGDSTVLTAAVMSKKMSTGDFFPLQVNYEEKMYAAGKFPGGFNKREGRPSTDATLTARLIDRPIRPMFAEGFRNEVQVINTVLSFDENASAPMAAMFGSSLALSISDIPFNGPIAGVQVAYVDGNFIINPTAQEQEASALELTVAGTKEAINMVESGAKELSEEIMLEALLKGHEAVCELIAFQEEIVTAIGKEKAEVELLQVDPELQAEIIATHNIALQAAVQVEEKKAREAATEAVKEVVIGEYEARYAEHEEYDRIMRDVAEILEQMEHAEVRRLITEDKVRPDGRRVDEIRPLDAVIDFLPQVHGSGLFTRGQTQALSVLTLAPMGEAQIIDGLTPEYKKRFMHHYNFPQYSVGETGRYGAAGRREIGHGALGERALEQVLPSLEEFPYAIRLVAEVLESNGSSSQASICAGTLALMAGGVPIKAPVAGIAMGLISDGTNYTVLTDIQGLEDHFGDMDFKVAGTREGITALQMDIKIEGITPQILEEALAQAKKARFEILDVLHGAIAEPRPQLAPTAPKIDMIKIDVDKIKVVIGKGGETIDKIIAETGVKIDIDEEGNVSIFSSDQAAIDRTKDIIASLVREAKVGEVYHAKVVRIEKFGAFVNLFDKTDALVHISEIAWTRTANVADVLEIGEEVDVKVIKIDDKGRVDASMKALLPRPPKADNPKKES

SEQ ID NO: 14627 - protein, 713 aa, Thermus thermophilus
MEGTPNVPQAHRYELTLAGRPLVLETGKYAKQASGSVLVRYADTVVLATAQASETPVEADFLPLTVEFEERHYAVGKIPGSFMRREGRPGEKAILSARMTDRPIRPLFPKGFRHEVQIIVTVLSADQKNPPDILGPIAASAALMLSDIPWEGPIAAVRVGLIGGSFVLNPTLQELEESQLDLVVAGSKEAILMVEAEAGEVDEETLVQALEFAHKEMQPILELQEAMARELAKPKMAWTPPESLPEEEKEALYRLALERGLSQVLQTASKGERSRALAEFAERLIAEALPKGEDGTPDEGKKPLYESAFDEVVRRELRRLVLEEGKRADGRGPKDLRPIWIEVDVLPRAHGSAVFTRGETQVLGTVTLGTGRDEQILDDLGIDETEKFLVHYNFPPFSTGEVRRLRGVSRREVGHGNLAKRALKAVMPKEEDFPYTIRVVGDVLESNGSSSMATVCAGCLALMDAGVPIRAPVAGVAMGLVWEENRAVILTDILGLEDALGDMDFKVAGTRKGVTALQMDNKVGGLPREVLKEALLQAREARLKILDLMETVLPAPRPELKPFAPRILSLKVPVEKIGLVIGPGGKNVRALEELGVEVDIEEDGTVRIYSSDLNAALEAKKRIEDLTREAKVGEIYEGTVTRITPFGAFISLFPGTEGLLHISQIAPGRVERVEDHLKVGDVIKVKVHRIDERGKIDLIRPELEGKIPPRRRK

SEQ ID NO: 14628 - protein, 408 aa, Unknown
  Pseudomonas sp. B4
MIDTIAIIGAGLAGSTAARALRAQGYEGRIHLLGDESHQAYDRTTLSKTVLAGEQPEPPAILDSAWYASAHVDVQLGRRVSCLDLANRQIQFESGAPLAYDRLLLATGARARRMAIRGGDLAGIHTLRDLADSQALRQALQPGQSLVIVGGGLIGCEVATTARKLSVHVTILEAGDELLVRVLGHRTGAWCRAELERMGVRVERNAQAARFEGQGQVRAVICADGRRGPADVVLVSIGAEPADELARAAGIACARGVLVDATGATSCPEVFAAGDVAAWPLRQGGQRSLETYLNSQMEAEIAASAMLSQPVPAPQVPTSWTEIAGHRIQMIGDAEGPGEIVVRGDAQSGQPIVLLRLLDGCVEAATAINATREFSVATRLVGTRVSVSAEQLQDVGSNLRDLLKAKPN

SEQ ID NO: 14629 - protein, 521 aa, Unknown
  Oceanospirillum sp. MED92
MLDANVKKQLDAYLQNIVTPVEVTVSLNDSEKSTQLEQLAKEIAELSDKVSLIHGPVASGRVPAMAVAPASEAPRVEFAGIPMGHEFTSLVLALLQAGGHPAKEEAALLEQIKRLDNPLKVETYISLSCQNCPEVVQAFNLMAVLNPNIQHSMIDGALFQDEIESRKVMAVPAVYVNGELFGQGRMSLTEIVDKLDSGSAEDKVAELNDKELYDVLVVGGGPAGASAAIYAARKGIRTGIVAERFGGQVLDTMAIENFISVQATEGPKLVANLEQHVLNYDVELVQNQRAAQIKRNELIEIELESGAVLKSRSVILSTGARWREMNVPGEQAYKGRGVAYCPHCDGPLFKGKSVAVIGGGNSGIEAAIDLAGIVEHVTVLEFADSLRADEVLQRKARSLPNVKIIMNAMTTEVIGDGERVTGLEYQDRSSGDQHTLALAGVFVQIGLIPNTEWLEGSMELSQQGEVVINERGETSLPGVFAAGDMTTVPYKQIIIAMGAGSTAALSAFDYLIRESVEEEAA

SEQ ID NO: 14630 - protein, 256 aa, Austrodanthonia laevis
CELDNIMRLTGITGIVNGMDVSEWDPVKDKYITVKYDATTAVAAKALNKEALQAEVGLPVDQKVPLVAFIGRLEEQKGPDVMAAAIRELMEEDVQIILLGTGKKKFERMLTAAEEKYPGKVRAVVKFNAALAHHIMAGADLLAVTSRFEPCGLIQLQGMRYGTPCACASTGGLVDTVVEGKTGFHMGRLSVDCKVVEPADVQKVVKTLKRAIKVVGTPAYEEMIRNCMALDLSWKVPAKNWENVLLSMGVAGSEPG

SEQ ID NO: 14631 - protein, 465 aa, Gibberella zeae
MDDHSKAVFTHRRSSVPLDIIIVGAGLSGLAAAVSCSLSGHKVTIFESATALQEVGAGLQVTPNASRLLHQWDLPQRFWDSVAEPTYLAVHRYSGQLLALEEDFDKKIRKQYGAPFVDVHRVDLQLSLLERAQELGAKLKLSQKVIDIDFNTPKITTQDGTEAKADLIIAADGLWSRCRSAFLGTKDMPKPTGDLAYRVVLNLDDIKDPELIDWVKHCSCHFWIGPGAHAVGYSLRGGNMYNIVLLVPDDLPPGASRLPGSVDQMKALFEGWDPILLRFLDLVTEVDRWKLMHHDEMQHWINDQSNFVFIGDACHPMLPYLAQGANSAIEDGAVLGLLLGAVEARNQIPEALKLYEKMRKSRGEAIVRETFKQRESFHMVDGPQQVKRDEIFLSQLGKKELKAPFPSRWTCPEVQPWLYGYDAYKEVHDALAKNSFTRFSVVAQPASPVVTSRSWLSRLLTYIHS

SEQ ID NO: 14632 - protein, 256 aa, Centropodia glauca
CELDNIMRLTGITGIVNGVDVSEWNPSKDKYITVKYDATTAVAAKALDKEALQAEVGLPVDRKIPLVAFVGRLEEQKGPDVMAAAIPEIMEEDVQIILLGTGKKKFERLFKSAEEKYPNKVRAVVKFNAPLAHHIMAGADLLAVTSRFEPCGLIQLQGMRYGTPCACTSTGGLVDTVVEGKTGFHMGRLSVDCNVVEPADVAKVATTLKRAIKVVGTPAYEEMVKNCMALDLSWKGPAKNWETVLLSMGVAGSEPG

SEQ ID NO: 14633 - protein, 375 aa, Nicotiana tabacum
MEVISTNTNGSTIFKNGAIPMNGHQNGTSEHLNGYQNGTSKHQNGHQNGTFEHRNGHQNGTSEQQNGTISHDNGNELLGSSDSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTAPTYPTGVIGYMLCSTEGPEVDFKNPVNPIDKETTQVKSKLGPLKFYNSDIHKAAFILPSFARSMIES

SEQ ID NO: 14634 - protein, 161 aa, Mycobacterium smegmatis
MSLKNINLTTLDGKQTTLGELAPGAALVVNVASKCGLTPQYSALEKLAQEYGDRGLTVIGVPCNQFMGQEPGTAEEIQTFCSTTYGVTFPLLAKTDVNGAERHPLYAALTETPDAGGEAGDIQWNFEKFLLAADGTVVNRFRPRTEPDAPEVIEAIEKVVS

SEQ ID NO: 14635 - protein, 142 aa, Burkholderia vietnamiensis
MNTPAHSAHSLHAAHAPPSPFDRLGGAAALARIVDAFYRQMDTRPDAAGIRAMHGADLGPVKTVLVTYLCEWLGGPRHYSAQRGHPRLRMRHRAFAIGMAERDAWLACMRAALDECGVEPALRDELMQALFKLADWLRNTGR

SEQ ID NO: 14636 - protein, 256 aa, Karroochloa purpurea
CELDNIMRLTGITGIVNGMDVSEWDPVKDKYITVKYDATTAVAAKALNKEALQAEVGLPVDRKVPLVAFIGRLEEQKGPDVMAAAIPELMEEDVQIILLGTGKKKFERMLTAAEEKYPGKVRAVVKFNAPLAHHIMAGADLLAVTSRFEPCGLIQLQGMRYGTPCACASTGGLVDTVVEGKTGFHMGRLSVDCKIVEPADVQKVTKTLKRAIKVVGTPAYEEMIRNCMALDLSWKVPAKNWENVLLSMGVAGSEPG

SEQ ID NO: 14637 - protein, 256 aa, Merxmuellera macowanii
CELDNIMRLTGITGIVNGMDVSEWDPSKDKYITLKYDATTAVAAKALNKEALQAEVGLPVDRKIPLVAFIGRLEEQKGPDVMAAAIPQLMEEDVQIVLLGTGKKKFERMLMSAEEKYPGKVRAVVKFNAALAHHIMAGADLLAVTSRFEPCGLIQLQGMRYGTPCACASTGGLVDTVVEGKIGFHMGRLSVDCKVVEPADVQKVATTLKRAIKVVGTPAYEEMVRNCMAQDLSWKGPAKNWENVLLSMGVAGSEPG

SEQ ID NO: 14638 - protein, 620 aa, Perilla frutescens
MATANQKGVTDNLRNQLALAVRSIQWSYAVFWSFSAKQSGSLEWGEGYYNGDIKTRKTVQAVELNSDPLGLQRSDQLRELFESLSLGETSPQPKRPTAALSPEDLTDTEWYFLVCMSFVFNVGQGLPGRSFSKNDTIWLRNAHLADTKLFSRSLLAKSASLQTVVCFPHLGGVVELGTTELVAEDRNLIQHIKTSFLESSSDTVINPNHDLVYQVLDHANDPENNLDDVEVCSPDTSSDDFADNVLIEGSSLADGADGEASQLQNWQFKDDAISNGLNNSTSSSDCVSQTQGNPVTVVQQLDGKKTSDNCMPVNQECNQQKSPPGFNGSDVHYQSVLSSLLKSSHQLMLGPNRNGKQESSFISWKDRKLSSRLPQILSPQRLLKKVLFEVARMHENARIESAKQKDKCDDHSGQEADEVDRNHVLSERKRREKISERFSILVSLVPSGGKVDKVSILDHTIEYLRELERKVKDLESYKEATERESTTQSKAHDSIERTSDNYGHSKFGSITKLLGNKRKSCDTEKMAGENKRGRSSSSTDSITISITDKDVLIEMRCSWRQCVLLEVMEALTQLNLDSQSVQSSNTDGILSLSINAKSKGVKGASAGAIKQALQRIIKKC

SEQ ID NO: 14639 - protein, 374 aa, Prochlorococcus marinus
MADFYQILGVSRDADADTLKRAYRKLARQYHPDVNKEPGAEDKFKEIGKAYEALADPETRARYDQFGEAGLGGAAGMPDMGDMGGFADLFETFFNGFGGQNPQGGRTQRRGPQQGDDLRYDLNVDFKDAIFGQQREIKIPHLETCEVCRGTGAKPGTGPKTCSTCGGSGQVRRATRTPFGNFTQVAECPSCNGAGQIIADPCVSCGGNGVKQVRKKLRINIPAGVDTGTKLRVSGEGNVGLKGGPPGDLYVFIKVKNDSKLKRDGVTIYSEIDVSYLQAILGDTVKVTTVDGNVNLKIPCGTQPNTTLSLENKGVPRLGNPVARGNHEVLVKVKLPTRVTDEERKLLEGLASQYSDKNINSSSGLFSKLFGKES

SEQ ID NO: 14640 - protein, 256 aa, Merxmuellera rangei
CELDNIMRLTGITGIVNGMDVSEWDPTKDKYITVKYDAATAVAAKALNKEALQAAVGLPVDREIPLLAFVGRLEEQKGPDVMAAAIPEIMEEDVQIVLLGTGKKKFERMFKSAEEKYPDKVRAVVKFNAPLAHHIMAGADMLAVTSRFEPCGLIQLQGMRYGTPCACASTGGLVDTVVEGKTGFHMGRLSVDCNVVEPADVQKVATTLKRAIKVVGTPAYEEMVRNCMALDLSWKGPAKNWETVLLSMGVAGSEPG

SEQ ID NO: 14641 - protein, 502 aa, Pyrococcus abyssi
MYRQAKWDEPLIFELSRPGRVGYTLPKPIEDVDVEIPEKLKRKSPLNLPEVSEPEVVKHYTRLSEMNYGVDSGIYPLGSCTMKYNPKINEELAGHPKVAYIHPYQDERTVQGALRIMWELEQWLKEITGMDRFTLQPAAGANGEFTGVMIIKAYHLDRGETQRNEMLVPDSAHGTNPASAAMAGFKVIEIPSNENGTVDLEALENAVSERTAGLMLTNPNTLGIFEDEIEEIAKIVHKAGGLLYYDGANLNGILGKVRPGDMGFDIVHLNLHKTFSTPHGGGGPGAGPVGVKEFLKDYLPVPLVSYDEENDRYYLDYDVPKSIGKVKELFGNFAVLVRALTYLKVMGKDGLREVSEVAVLNANYLARKLKGTRGYELPHKELRKHEVVFSAEPMKRETGVRTLDVAKRLLDFGMHAPTIYFPLIVHEALMIEPTETVSKEELDAYVEAMKKISEEAYTNPEVVKSAPHNTAVRRVDDVLASKKPIITWKMYKELKEKGEVDY

SEQ ID NO: 14642 - protein, 189 aa, Brassica napus
LRVLLVKHLKNSDVGSLGRIVLPKREAEGNLPELSDKEGMVLQMRDVDSVQSWSFKYKYWSNNKSRMYVLENTGEFVKKNGVLMGDYLTIYEDESKNLYFSIRKHPHKQNDGREDESMEVIEMNFYEDIMFDYIPNGEDDSIAMLLGNLNEHYPYPNDLMDLTVDLDQHQQATSSSPPADHMSSNDFLW

SEQ ID NO: 14643 - protein, 449 aa, Pyrococcus abyssi
MAKHYIPNSAHKEEMLKEIGLSSIDELFADIPGKFIRDELNLPEGKSEYEVFLEMNEILGKNKTVLEMPTFLGAGTYFHYIPAHVKYLIERSEFLTAYTPYQPEISQGMLQALFEYQSLIAELVGLPVVNASMYDWGTAMAEAALMTVRLHRGKRKKFIVPRHTHPERLQVLETYAKGPGVEIETVKWNERGQVDIEDLKEKVKDAAGVYVEIPNFFGLLEEEVREIGEIAHEAGAYFVVGVDPTILGIVEAPGELGADIVVGEASYFGNPMNFGGPRAGIFAVRNDMKLIRQMPGRLIGMTKDAEGKRAFVMTLQTREQHIRRAKATSNICSNEALVAVAAAIHIASLGPRGIRELGEVILKNTAYLKKRLSEVAEIPFDGVNFKDVLVRFEKPYKEIHEELLKRNIHGGYYVGKHFPELGESALFAATETTRKEWVDALISALREVI

SEQ ID NO: 14644 - protein, 99 aa, Crocosphaera watsonii
MATYKVTLINEAEGINTTLEVPEDEYILDVAEEQGIELPYSCRAGACSSCAGKITAGGVDQGDQSFLDDDQIEAGYVLTCVAYPTSDCTIETHQEEALY

SEQ ID NO: 14645 - protein, 327 aa, Unknown
  Rhodococcus sp. RHA1
MTTPSTVHELIIVGSGPAGYTAAVYAARAELEPLQFEGTQFGGALMTTTEVENFPGFREGIMGPDLMDQMREQAKRFGTDIRTEDVEELDLTGPIKKVVVNGETYQAHAVVLAMGAAARYLGIPGEEKLLGRGVSACATCDGFFFKDQDIVVVGGGDSAMEEATFLTRFARSVTVVHRREEFRASRIMLERAKANAKIRFVTNAAPVEVLGENSVTGLVIRDTVTGETSTLDVTGMFVAIGHDPRSELVKGQVDLDDAGYVLVKTPTTATSVDGVFAAGDLVDHIYQQAITAAGTGCSAAMDAERWLAERGDITANTVAAAGLPVDA

SEQ ID NO: 14646 - protein, 328 aa, Unknown
  Synechococcus sp. CC9605
MSRIYDDNSQAIGNTPLVKLNNVTKNCKATVLAKVEGRNPAYSVKCRIGANMIWDAEKSGKLTKGKVIVEPTSGNTGIALAFTAAARGYKLILTMPESMSIERRRVMAVLGAELILTEAAKGMPGAIAKAKEISESDPAKYFMPGQFDNPANPEIHFKTTGPEIWNDCDGAIDVLVAGVGTGGTITGVSRYIKNEAGKAIESVAVEPTNSPVITQTMNGEAVKPGPHKIQGIGAGFIPKNLDLSVVDKVEQVTNEESVAMALRLAQEEGLLVGISCGAAAAAAIRLAEKDEYAGKTIVVVLPDLAERYLSSVMFAEVPTGIIEQPVAV

SEQ ID NO: 14647 - protein, 430 aa, Canavalia lineata
MAQILAPSTQWQMRITKTSPNASPVTSNMWSSLLMKQNKKATSSAKFRVLAIKSENGTINRLENLLDLDITPYTDKIIAEYIWVGGTGIDVRSKSRTIARPVEHPSELPKWNYDGSSTGQAPGDDSEVILYPQAIFKDPFRGGNNILVICDAYTPAGEPIPTNKRHRAAEIFSNPKVQAEVPWYGIEQEYTLLQTNVNWPLGWPVGGYPGPQGPYYCSAGADKSFGRDISDAHYKACLYAGINISGTNGEVMPGQWEFQVGPSVGIEAGDHIWAARYILERITEQAGVVLSLDPKPIQGDWNGAGCHTNYSTKSMREEGGFEVIKKAILNLSLRHSDHIRAYGEGNERRLTGKHETADINTFSWGVANRGCSIRVGRDTEKNGKGYLEDRRPASNMDPYVVTSLLAETTLLWEPTLEAEALAAQKIALKV

SEQ ID NO: 14648 - protein, 512 aa, Hieracium pilosella
MTLLSLIIYLCITGVTAYVLVNLRTRRANRLPPGPTPWPIVGNLPHLGTIPHHSLADLATRYGPLMHLRLGFVDVVVAASASVAAQFLKTHDANFASRPPNSGAKHMAYNYQDLVFAPYGPRWRMLRKICSVHLFSAKSLDDFRHVRQEEVAILTRALVGAGKSTVKLGQLLHVCTTNALVRVMLGRRVFGDGSGGGDPKADEFKNMVIEMMVLAGEFNLGDFIPVLDLLDLQGVTKKMKKLHTRFDSFLNSILEEHRTSSGGASGHVDLLSTLISLKDEADGEGGKLTDTEIKALLLNLFVAGTDTSSSTVEWAIAELIRNPQLLKQAQQELDTVVGQGRLVNESDLSQLTFLQAIVKETFRLHPSTPLSLPRIASESCEINGYNIPKGSTLLVNVWAIARDPKMWTEPLEFRPSRFLPDGEKPNADVKGNDFEVIPFGAGRRICAGMSLGLRMVQLLTATLIQAFDWELANGLEPRNLNMEEAYGLTLQRAQPLMVHPRPRLAPHVYGTG

SEQ ID NO: 14649 - protein, 98 aa, Cytophaga hutchinsonii
MASFKELINSDKPVLVDFHATWCGPCKQLAPVIEKVAGTFNERLKVVKVDVDKNTAAAQAYQVKGVPTMILFKQGKIVWRSSGYMDEGKLSKTLQAFI

SEQ ID NO: 14650 - protein, 428 aa, Collimonas fungivorans
MTIKHEVPSYLTQHGIGPWGDYLEQIDRVTPYLGNLARWVETMKRPKRMLIVDVPIERDDGTIAHFEGYRVQHNTSRGPGKGGVRFHQDVTLSEVMALSAWMTVKNAAVNVPYGGAKGGIRVDPKTLSQGELQRMTRRYTSEIGIIIGPNKDIPAPDVNTNEQIMAWMMDTYSMNQGSTASGVVTGKPISLGGSLGRREATGRGVFVVGCEAAVKRGLDIHGAKIAVQGFGNVGGIAARLFSEAGAKVVAVQDHISTVVRSSGLDVAALQAHVNETGSVAGFKGGEEISDRAQFWAVDCDILVPAALEQQITVENAPTIRAKIILEGANGPTSPAADDILHEKGVLVVPDVIANAGGVTVSYFEWVQDFSSFFWTEDEINLRLTRIMREAFTAVWQLAEEKKVSLRTAAFIVACTRVLQAREMRGLYP

SEQ ID NO: 14651 - protein, 502 aa, Alkaliphilus metalliredigenes
MSKGYVYLVGAGPGDEELITVKGLRCIQEADVILYDRLANPALLKNKRDEAECIDVGKSPKRHAYTQEEINELLVLQAHKGKTVTRLKGGDPYVFGRGGEEALALRKARIPFEVVPGITSAIAVPNYGGIPVTHRNVSTSFHVITGHEDPLKEKSSVNYEALAKLEGTLVFLMGVGNLEEIVNQLRRYGKPKETPIALVHQGTTAKQRTVTGTLESIVTVVKEKKITSPSVIVIGEVVRLQDELNWFESLPLHGQRILVTRTREQASQLSTKLKALGGDVVEYPTIEIRPAQDIEGVNAKLKRIHQGDYIIFTSVNGVKAFFERLKALKMDVREMGPGKLVAIGPATAKALEEKGLLVEVIPETYVAEGIIDCLKESIKEGDKVFLPRANIARKALNEGLEALGAQVEEIEIYETVLPVQGEQHLRELLVEGIDWITFTSSSTVQNFMDLLGKEDRHLLESVKIASIGPITGKTAKKLGLPVDVQAKEYTIAGLVQAMMEVQ

SEQ ID NO: 14652 - protein, 1478 aa, Saccharomyces cerevisiae
MPFLRKIAGTAHTHSRSDSNSSVKFGHQPTSSVASTKSSSKSPRATSRKSIYDDIRSQIPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESPLSPTKSGPSKTDEKIFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRSTPKPRVITMTEVSNTNPTEELNYWNIKEVLSHEENAPKMVFKTSPKLELNLPDKGSKLNIPTPITENESKSSFQVLRKDEGTEIDFNHRREAPYTKPEVAPKRESPKPPANTSPQRTLSTSKQNKPIRLVRASTKISRSKRSKPLPPQLLSSPIEASSSSPDSLTSSYTPASTHVLIPQPYKGANDVMRRLKTDQDSTSNSPSLKMKQKVNRSNSNVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 14653 - protein, 432 aa, Crataegus crus-galli
MAQILAPTSQWRMKVTRSSATASPMTAKMWGSLVLKQNKKGPARSSTKFRVLATKSEGYTINRLEGLLNLDLTPFTDKIIAEYIWIGGSGVDVRSKSRTISKPVEDPSELPKWNYDGSSTGQAPGEDSEVILYPQAIFKDPFRGGNNILVICDAYTPQGEPIPTNKRARAAEIFKNKKVIDEVPWYGIEQEYTLLQTDVKWPLGWPIGGYPGPQGPYYCGAGADKSFGRDISDAHYKACLYAGINISGTNGEVMPGQWEYQVGPSVGIEAGDHIWASRYILERITEQAGVVLTLDPKPIEGDWNGAGCHTNYSTKSMREDGGFEVIKKAILNLSLRHVEHISAYGEGNERRLTGKHETASINTFSWGVANRGCSIRVGRETEKQGKGYLEDRRPASNMDPYIVTSLLAETTLLWEPTLEAEALAAQKLALNV

SEQ ID NO: 14654 - protein, 637 aa, Glycine max
MLLPTSGVGMNSAMDDMNLIQQTQRHHLVVREIGEEIDLEIGAGEDDPSFGSATLIGAPMRESSVEEHGESKQMGMISQLPNDAQDMSKTQQGKRKKKVVKRWREEWADTYKWAYVDVKDGTPRIFCSVCREYGRKHRRNPYGNEGSRNMQMSALEEHNNSLLHKEALRLQMASKDKIVVDKPVYVKVAMSKTAGSILEATLKRDPHEVEFIQAVQEAVQALERVIAKNSRYINIMERLLEPERMIVFRVSWVDDRGGTCVNRGFRVQFNQSMGPCRGGIRFHPSMNLSVAKFLGFEQTLKNALSPYKLGGAAGGSDFDPKGKSDNEIMRFCQSFMSEMYRYLGPDKDLPSEEMGVGTREMGYLFGQYRRLAGHFQGSFTGPRIFWSGSSLRPEATGYGLVFFAQLMLADMNKELKGLRCAVSGSGKIAMHVLEKLIAYGALPISVSDSRGYLVDEDGFDYMKISFLRDIKAQQRSLRDYSKTYARSKYYDEAKPWSERCDVAFACTSQNEIDQSDAINLVNSGCRILVEGSNMPCTPEAVQILRKASVLIAPAMAAGAGGVVAGELELNHECSLMHWSPEDFESKLQEAMKQTYQRAMKAATDFGYQKESPEALVHGAVISAFLTIAQAMTDQGSI

SEQ ID NO: 14655 - protein, 195 aa, Brassica napus
MASIQFGSTCVAQWSIRPHFAVRVYHPSSGLQSSTRQQNSTRSRINCLGASRSSMFSHGSLPLLSMPGMSRNMQPRRGSRFTVRADADYYSVLGVSKNATKSEIKSAYRKLARNYHPDVNKEPGAEEKFKEISNAYEVLSDDEKKSLYDRFGEAGVKGAGGMGGMGDFSNPFDLFESLFEGMGGMGGGGGMGRGS

SEQ ID NO: 14656 - protein, 437 aa, Symbiobacterium thermophilum
MKWVTVDRLPQYEGQTVELRGWVQNYRSSGKIQFIIFRDGTGVCQAVLFIKDVPPEVFEAGKRLTQESSIIIRGSVRKDDRAPGGYEIGVQDLEIVQIAEEYPITKKEHGTEFLMDHRHLWIRSNRQVAILRIRNEITMAIHQFLQENGFVLTESPILMGTAAEGGATLFETTYVNDEPAYLSQSGQLHVEATAMALGRVYTFGPTFRAEKSKTRRHLIEFWMVEPEAAYFTHEDNMRLQEEMVTYVVRRVLERRSKELQLIGRDTTLLEKVEPPFPRITYTEAVEMLKKLHKPGDEWEPIEWGEDFGAPHETVLTQQFEKPVFVEKFPVKVKAFYMQPDPENPDVVLGADLLAPEGYGEIIGGSQRIHDPELLKRRFEEHGLDMNTYGWYYDLRRFGSVPHSGFGLGIERTVAWICGLEHVRETIPFPRLLNRLHP

SEQ ID NO: 14657 - protein, 238 aa, Phaseolus vulgaris
LVLDGVIQLTERDECAYQEMITHLPLCSIPNPKKVLVIGGGDGGVLREIARHSSVEKIDICEIDGMVVDVSKQYFPDVAVGYEDPRVTLTVGDGVAFLKNVPEGTYDAVIVDSSDPIGPAQELFEKPFFGSVAKALRPGGVVCTQAESIWLHMDIIEDIVSNCRHIFKGSVNYAWTTVPTYPSGMIGFMLCSTEGPPVDFKHPVNPIDENECQKSARPLKFYNSEIHTAAFCLPSFAK

SEQ ID NO: 14658 - protein, 464 aa, Ostreococcus tauri
YATFLAGEKSKGQSCAFGGANVDGGGDGVDSTQTPSIGARKIGPDPSAGTNVELESLNEWLQAQDASGSKDGFLTFLHGIVCRESGQHGHAKALLAEACRKYPLNWSAWQALIPLLTSEGEEQALDLPREHWVYRWFIGVFQLEMQKNKESLETFVAMGREFPQSKLLLGHMAEAHYNLREFDEAQEIYKDIRDIDPYRIDGMDNYSNVLYVKDSFAELSHLAHHMVGTDKYTPETCCVIGNYYSLKSMHAKAVVYFKRALKLNPRYLSAWTLMGHEYVEMKNPAAAIDAYRHAVDINPRDYRAWYGLGQTYEILQMPYYALYYYQQAVKLRPSDPRMWCAMGQCYESDQLRMFTSAIRCYQRAVANDEREGIALSKLATLHREKNEKAAAHYYLLNLKRLDEESSGSVDSNEKIDALEFLAQFYKKEGRYDEAEQACVRLLDAPGAAKHAAKALLREIHSQRF

SEQ ID NO: 14659 - protein, 198 aa, Unknown
  delta proteobacterium MLMS-1
MTTASRRAELKRQTRETEISLALNLDGQGQTTIKTGVGFMDHMLTLLAVHGFFDLTINASGDTEVDDHHTVEDLGIVLGQGCKQALTATAGIRRYGAAAVPMDETLVRVTLDISNRPYLHYGVELPDAKVGNFDTALAKEFLRAFAQHGGITLHIELAHGDNSHHIIEATFKALGRALDQATTLDQRLTGPLSSKGSL

SEQ ID NO: 14660 - protein, 307 aa, Triticum aestivum
  misc_feature (206)..(206): Xaa can be any naturally occurring amino acid
  misc_feature (214)..(214): Xaa can be any naturally occurring amino acid
  misc_feature (227)..(227): Xaa can be any naturally occurring amino acid
  misc_feature (245)..(245): Xaa can be any naturally occurring amino acid
  misc_feature (254)..(254): Xaa can be any naturally occurring amino acid
  misc_feature (270)..(270): Xaa can be any naturally occurring amino acid
  misc_feature (279)..(279): Xaa can be any naturally occurring amino acid
  misc_feature (299)..(299): Xaa can be any naturally occurring amino acid
  misc_feature (302)..(302): Xaa can be any naturally occurring amino acid
MHPTRWELSHMVDLQAAALVISVVAAEVISPEEAVEWVKKDRRRLLHVVYRVGDLDKTIKFYTECLGMKLLRRRDIPEERYTNAFLGYGPEDSHFVAELTYNYGVESYDIGSGFGHFGIAVEDVEKTVELIKAKGGTVTREPGPVKGGKSVIAFIEDPDGYKFELIERGPTPEPLCQVMLRVGDLDRAISFYEKAFGMELLRRRDXPQYKYTIXMMGYGPEDKHAVXELTYNYGVKEYDKGNAYXQIAIGTDDXYKTAEVVRQNGGQITXEPGPLPGIXTKITACTDPDGWKSVFVDNXDFXKELEE

SEQ ID NO: 14661 - protein, 70 aa, Glycine max
ATYSYYFWDYCHMTPPGSYLTYKDTYISPTGGSGVSTVAYEQVKMRKIVSHGVLFSTFHVDVIKDLPEDL

SEQ ID NO: 14662 - protein, 102 aa, Brassica napus
  misc_feature (89)..(89): Xaa can be any naturally occurring amino acid
VQINCVDAVKERVAMYKSNDQKTPDEEEMLENQFDILCCLLMQLEKKERFVNADGVDLMISIMNQNKYAYGSAIRALDFAMTNYHPACXRYVDVMRLRTTFA

SEQ ID NO: 14663 - protein, 473 aa, Brassica napus
MDYLRAFHFLVLILSAISLSEAGSIGVNYGRISDELPSAFKVVQLLKSQGIDRVKIFDADPAVLKALSGSGIRVTVDLPNEMLFSAAKRPSFAATWVKRNVAAYHPTTQIESIAVGNEVFVDPHNTTKYLIPAMRNIHKALVSYNLHSSIKISSPLALSALQNSYPSSSGSFRPELVDLVIKPMLDFLRETGSRLMINVYPFFAYEGNSDVIPLDYALLKENPGMVDSGNGLRYFNLFDAQIDAVFAAMSALKYDDIEIIVTETGWPSKGDENEVGASVANAASYNGNLIRRVLTGGGTPLRPKADLTVYLFALFNENKKFGATSERNYGLFFPDEKKVYDIPFTQEGLKHYRDGGHNTPATGDQQVTPPNNGGGVSKSLTGSTWCVANGDAGKDRLQGGLDYACGDGGADCRPIQRGAPCYSPDTLEAHASFAFNSYYQKKGRAGGSCYFGGAAYVVSQPPKYGRCEFPTGY

SEQ ID NO: 14664 - protein, 647 aa, Ipomoea nil
MKVAVNTFLLFLCSTSSIYAAFALNSDGAALLSLTRHWTSIPSDITQSWNASDSTPCSWLGVECDRRQFVDTLNLSSYGISGEFGPEISHLKHLKKVVLSGNGFFGSIPSQLGNCSLLEHIDLSSNSFTGSLTELTKLSLGENSFSGGIPTSLFQSNKLLNLQLGGNLLAGDIPPVGALQALRSLNLSSNKLNGQLPIDLGKLKMLEELDVSHNNLSGTLRVLSTIQSLTFINISHNLFSGPVPPSLTKFLNSSPTSFSGNSDLCINCPADGLACPESSILRPCNMQSNTGKGGLSTLGIAMIVLGALLFIICLFLFSAFLFLHCKKSVQEIAISAQEGDGSLLNKVLEATENLNDKYVIGKGAHGTIYKATLSPDKVYAVKKLVFTGIKNGSVSMVREIETIGKVRHRNLIKLEEFWLRKEYGLILYTYMENGSLHDILHETNPPKPLDWSTRHNIAVGTAHGLAYLHFDCDPAIVHRDIKPMNILLDSDLEPHISDFGIAKLLDQSATSIPSNTVQGTIGYMAPENAFTTVKSRESDVYSYGVVLLELITRKKALDPSFNGETDIVGWVRSVWTQTGEIQKIVDPSLLDELIDSSVMEQVTEALSLALRCAEKEVDKRPTMRDVVKQLTRWSIRSYSSSVRNKSK

SEQ ID NO: 14665 - protein, 61 aa, Cucumis melo
DTLLDADLESDALGWQYISGTLPDSREFDRIDNPQLEGYKFDPNGEYVRRWLPELSRLPTE

SEQ ID NO: 14666 - protein, 99 aa, Crocosphaera watsonii
MVTYQVTLINEAEGINVTIEVPEDEYILDVAEDQGIDLPYSCRAGACSACAGKVTSGSVDQGDQSFLDDEQIEAGYILTCVAYPTSDCTIETNHEESLY

SEQ ID NO: 14667 - protein, 107 aa, Unknown
  Rhodococcus sp. RHA1
MSNTVTITDDSFQQDVISSDKPVLVDFWATWCGPCKMIAPVLEEIAGEHSEKLTIAKLDIDANPGAARDFQVMSIPTLILFKDGKPINTIVGTKGKAALLKELADVL

SEQ ID NO: 14668 - protein, 234 aa, Prochlorococcus marinus
MAVVSLSEMMEAGAHFGHQTRRWNPKMSKYIYCARNGVHIIDLVKTALCMNNAYKWTRNAAKSGKRFLFVGTKKQASDVVAQEATRCGAAYVNQRWLGGMLTNWTTMKARIERLKDLERMESSGSIAMRPKKEAAVLRRELERLQKYLGGLKGMRRLPDVVVLVDQRRESNAVLEARKLDISLVSMLDTNCDPDLCEVPIPCNDDAVRSVQLILGRLADAINEGRKGSNAERKN

SEQ ID NO: 14669 - protein, 298 aa, Blastopirellula marina
MTTPAKVPDKVNVALVQMTCSTVKQENVDKAVARIAEAAQLGANIVCLQELFAGQYPCQEEDHLKFQEAEPIPGATSQAIQAAAAQHGVVVVASLFEKRAEGLYHNTAAIFDADGTQLGIYRKMHIPDDPHYYEKFYFTPGDLGFRSFQTKYGRIGVCICWDQWFPEAARLTALTGAQMLFYPTAIGWLVDEKEEYGPAQVSAWETMMRSHSIANGVFVCAPNRVGLEGTIEFWGHSFVSDPNGNLLKVGSHDQEEILLVECNLAQIDFARTHWPFLRDRRVDAYSGLTKLYLDEGAH

SEQ ID NO: 14670 - protein, 372 aa, Arabidopsis thaliana
MGKREKKPNRRRHKGEYSNDAEDFYDQHPPAVASVDEEDEENSDEEEEENDGNESSDLPSKFLLYQQSVQSPKGDISYLQKFFLMYVGGRQPFHFQEDFCGTALLSAEWLKTDTRRTAIGLDFDLEALEWCMDNNISKLGSDVYSRMSLFHGNVLTPLEAKQVKSKSHELIQNISLDDGDDNEDLADPSVVESLEKDGPDSLPKRDIVCAFNFSCCCLHKRSELVSYFKNARDALSKKGGIFVMDLYGGASAEGQLKLQRKFPNFTYTWEQAEFDILSRKTRISLHYHLQKQNRKIRHAFSYSWRLWSLPEIKDCMEEAGFSSVHFWLREMPDASEMRRTDGFGAGRDIKYEQVKSFQQCDSWNAYIVAVSL

SEQ ID NO: 14671 - protein, 447 aa, Arabidopsis thaliana
MPTFSAIALDRMLEPGASTSVESVPSTTNLFYSKPPISKLEKGKGKLPNERTVTRPLMSPALYATPDAIPLPNSPSSFPPSPYIINHKSRGPPRLLKSSSEANVVSSSHQKTLEEETITAETDVKVSPRRRSTSFSFPITEVTEDDYSNGVHARTVGNYNFDGIVDGPVGNWSPLDGKSGNGKSELDNAANGLERVNGLSEPVPIKTDKESESEDFYDPGESASFTSNTDVEGDAGDESSQRLATPVGEFYDAWDELSTDSGMQSSVNNIESELSEIRLSLLMEIEKRKQTEEALEQMQIHWQRLREQMAQVGLFVPIDPTASTNNMNLSEELRCQLEIARFVSDSLGRGMAKAEVEMEMESMLETKNFEITRLSDRLHYYEAVNREMSQRNQEAIEVARRERQKRKKRQRWIWGSIAATITLGSAALAWSYIPAAKPSSEVSLKDE

SEQ ID NO: 14672 - protein, 736 aa, Planktothrix agardhii
MNQIKIKSENPNKLFINIGQQQGEIVYTGRKVAQQSQKNWDEFVTTLLEGKGNPQIGKVYQDLSLAVEQYNQECQNPVAFEVVYHYFIAKIIRLINLNPTDFPHQWYLACQTEDIPHPGDFITLKLFQEPLVIVHQEDGTIGCFLNVCTHRQSPVFEGKGCASSNKKVLCPYHGWAFDLDGNCQNAPGASRGEFGSNFDHNLYRLQEIEVKQDGEYIFVKLLSKHPEEVEIKKDYDSENIGVAIVNLLDQVSPGYAEGKSASLPEAIRLWLKIGYLEKELTFLVASLNHSSGIIPEDVNSSQETELLIESLVRELKQAILMVENQELTLKFGEILERIGLPQEREKPTKFNPFEDSELGGENDSEDELAQLNTEPLPIWIYGDTALFTLEIDHLIAPTWQFICHINEVPQAGNFTWLDIIGDRAYVLRTKEGELFAGRLKHIDERNNCPNFSLPNYGLEPIDIDIFYGFVFIRFSWEGARLKELWYQADLLKPYNLEAMQPINGIGRYDINVEVDYKLLWENFLEDYHFPMMHKGLTRRFKLSSDCEGINGMIIPMKDPPSPHLNPTERKYYDCAKSLGRHSWEHETKLQEIAAQTQSLPETLCYSAFCSMSSQEDMPMPFSLSIFPEHIQTFSIVPGGARESRFHVRSYAHPVDPNFPHSQTIKDAQLANIQLLIESLHEDIRVNYITQDSVSSKLFEKKGIFSIAELDVAKFQQAIRLKLPMTKFQNRTFLVNH

SEQ ID NO: 14673 - protein, 372 aa, Oryza sativa
MSMVVQQEQEVVFDAAVLSGQTEIPSQFIWPAEESPGSVAVEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRLFQAFSDWLNHHRHLQPTIYS

SEQ ID NO: 14674 - protein, 523 aa, Unknown
  Polaromonas sp. JS666
MLDASTKAQLKSYLERATQPIEIIASLDDGKASGELLSLLKDVAESSPLVTLTESRDDPHRKPSFSVNRPGENHGPRFAGLPMGHEFTSLILALLQVGGYPPRVEQAVLEQIRALDGDFEFEIYVSLTCHNCPDVVQALNLMAVQNPRIRTTMIEGGTFQDEVKERQVMAVPTVFLNGTEFGQGRMSLEEILAKIDTSGVEHEAAKIAAKDPFDVLIVGGGPAGAAAAVYAARKGIRTGVASERFGGQVLDTMGIENFISIKETEGPKFAHALEEHVRNYDVDIMNLQRAKALVPNTGPGKDLIEIQLESGASLKSRSIVISTGARWRNINVPGEREYKNKGVAYCPHCDGPLFKGKRVAVIGGGNSGVEAAIDLAGIVGHVTLIEFDTALRADAVLQRKLTSLKNVTVFTHAQTTEITGDQKVNGLIYKERASGELKKVELEGVFIQIGLVPNTDWLKGVVELSRHGEIVVDAKGQTSVPGVFAAGDVTTVPFKQIIIAAGEGAKAALSAFDHLIRTSAPAA

SEQ ID NO: 14675 - protein, 78 aa, Cicer arietinum
STHIEPLGLGQGLSMGVLNLAIVVPQIVVSLGSGPWDQIFGGGNSPAFAVAAVAALMSGLLALLAIPRTGTQKPRSRV

SEQ ID NO: 14676 - protein, 331 aa, Pseudomonas fluorescens
MIKQQLARFNRLDLLRSTTALEKLERLSAWIGRDVYVKRDDSTPLAMGGNKLRKLEYLAADALAQGADTLITAGAIQSNHVRQTAALAAKLGLGCVALLENPTGTQDPNYLGNGNRLLLDLFDAKVELVENLDQADEQLHALAARLRSNGKKPYLVPIGGSNALGALGYVRAGLELAQQIEDSGLEFAAVVLASGSAGTHSGLALALSEVLPQLPVIGVTVSRSEEDQRPKVQGLAERTAELLGVKLPDAFNVQLWDEYFAPRYGEPNAGTLAAVKLLASQEGLLLDPVYTGKAMAGLLDGVGRQRFDDGPLIFLHTGGAPALFAYAGAFS

SEQ ID NO: 14677 - protein, 303 aa, Alkaliphilus metalliredigenes
MIYKNITQTIGNTPVVKLNNLVDENMADVYVKLEMFNPGGSVKDRISISMIEEAEKKGLIKPGDTIVEPTSGNTGIGLGLVAASKGYKLVLTMPESMSLERRKLLKAYGAELELTKAHLGMKGAIDKANELVEENGYVMLQQFNNLANPEIHRNTTAKEILNDFGNDLDAFVVGIGTGGTITGVGEVLKKKIDKITVVAVEPEDSPVLSGGNPGPHMIQGIGAGFVPEVLNVKIFDEVIKVQNEEALETARQLAKQEGLMVGISSGAAVFAAIKVAQKLGKGKKVLTIAPDTGERYISTALFE

SEQ ID NO: 14678 - protein, 117 aa, Oryza sativa
  misc_feature (4)..(6): Xaa can be any naturally occurring amino acid
  misc_feature (12)..(12): Xaa can be any naturally occurring amino acid
  misc_feature (22)..(22): Xaa can be any naturally occurring amino acid
  misc_feature (25)..(25): Xaa can be any naturally occurring amino acid
  misc_feature (30)..(31): Xaa can be any naturally occurring amino acid
  misc_feature (33)..(34): Xaa can be any naturally occurring amino acid
  misc_feature (39)..(39): Xaa can be any naturally occurring amino acid
  misc_feature (41)..(41): Xaa can be any naturally occurring amino acid
  misc_feature (43)..(43): Xaa can be any naturally occurring amino acid
  misc_feature (55)..(55): Xaa can be any naturally occurring amino acid
  misc_feature (60)..(60): Xaa can be any naturally occurring amino acid
  misc_feature (65)..(66): Xaa can be any naturally occurring amino acid
  misc_feature (70)..(70): Xaa can be any naturally occurring amino acid
  misc_feature (72)..(72): Xaa can be any naturally occurring amino acid
  misc_feature (75)..(75): Xaa can be any naturally occurring amino acid
  misc_feature (81)..(81): Xaa can be any naturally occurring amino acid
  misc_feature (85)..(85): Xaa can be any naturally occurring amino acid
  misc_feature (102)..(102): Xaa can be any naturally occurring amino acid
AWTXXXPTLSLXAPILTWPLGXPPXKATKXXTXXCNYSXEXAXPAAAVKGTGASXLAMAXTAAPXXALVXQXMSXEGTGLXLRLXNNLLGWILLRVFGLIWXLYTIYTSNLQGGPGT

SEQ ID NO: 14679 - protein, 527 aa, Glycine max
MGQCVITMEPFSSTKQNHNNNNTLTKPSLHVESPPLEPSPLRKIIVVASIAAGVQFGWALQLSLLTPYVQLLGIPHTWAAYIWLCGPISGMLVQPIVGYHSDRCTSRFGRRRPFIAAGSFAVAIAVFLIGYAADLGHSFGDDLSKKVRPRAIGIFVVGFWILDVANNMLQGPCRALLGDLCAGNHQKTRNANAFFSFFMAVGNVLGYAAGAYSKLYHVFPFTKTTACDVYCANLKSCFFLSIALLTTLATAALVYVKEVPLSPEKAVIDSDDNGGMPCFGQLFGAFRELKRPMWILLLVTCLNWIAWFPFLLFDTDWMGREVYEGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPQMVVSVISGPWDALFGGGNLPAFVVGAVAAAASGILSIILLPSPPPDLAKAATAAGGGFH

SEQ ID NO: 14680 - protein, 317 aa, Vigna radiata
MANFPVVDMGKLNTEERGTAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKGYLKKVFYGSKGPNFGTKVSNYPPCPTPDLIKGLRAHTDAGGIILLFQDDKVSGLQLLKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 14681 - protein, 538 aa, Phragmites australis
MGLGVVAHLVRLGVLSSTSDHASVVSINLFVALLCACIVLGHLLEENRWVNESITALIVGLCTGVVILLTTKGKSSHILVFSEDLFFIYLLPPIIFNAGFQVKKKQFFRNFMTITLFGAVGTMISFFTISFGAIAIFGRMNIGTLDVGDFLAIGAIFSATASVCTLQVLNQDETPLLYSLVFGEGVVNDATSVVLFNALENFDLNKIDVAVVLKFLGNVCYLFVSSTFLGVFTGLLCAYIIKKLYIGRHSTDREVALMMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTPFEKITWRQQIVIWWAGLMRGAVSIALAYNKFTRSGHTQLHGNAIMITSTITVVLFSTMVFGMMTKPLIRFLLPASSSTVTSEPSSPKSLHSPLLTSLQGSDLETATHIVRPSSLRMLLSKPTHTVHYYWRKFDDALMRPMFGGRGFVPFSPGSPIEQSVHGAR

SEQ ID NO: 14682 - protein, 468 aa, Debaryomyces hansenii
MMGSSKSCVTFHRSIVRGAFLRRQAYSTAAVEERSLEQMSQRELREKAVAEALAREEEAAAKAKALRELKNQTRDLLSTLNKIPSTLVNSRLQKLQGELDGISNQEKVKQLDQELEEFMFEKMNLPQYEIQNRPWAVGPKQTISSGEQGKDDDASTQIKSTTSNSYTSQFPNLKPTPDYKPYSTQELYLRQLAHSRQSGSLGSELSNIYKPRDEVRKPRSISETTISTLMAAGCHLGHAKAMWRPSTQPYIYGEYNGIHLIDLNETLSALNRATQVIKGVAAKGGVILYVGTTKNWEQHRALEEAAKRTRGYYVSKRWVPGTITNFTEVTKQIGGSSRIEVDMMDQPTDRKLGEETSGNLIKPDLIVLLNPVENRNCINECIKQRIPTIGLCDTDMEPSLLTYPIPCNDDSMRASSLMTGILSKSAEEGLNERLNLSKEYKTAQSKFGNKLAQKTARIVNSSTRSATA

SEQ ID NO: 14683 - protein, 453 aa, Unknown
  Candidatus Kuenenia stuttgartiensis
MKILLISVNNEMKPYPVAPLGIAYIATILKNKGHSVYVLDLCFAEDDYVAIEESLRKFSPDLLGLSIRNIDNLTFRKSVYYLPRVKEIVRLIKRLTSAQIIVGGSGFSLFPEEVLRYLQLEMGIVGEGEISLPQYIDVIIHGGEINDIPNLCYIKDGKYTRNNTLCSVEPFTPKRDLLNNNKYMELGGMANIQSKRGCPFHCTYCTYPSLNGNTVRLREPLEIVDEIKELNSEYGVDYVFFVDDIFNCPEKHTVALCEEIIRHELKIDWACFATPKGMTKELALLMSDAGCKGIEFGTDAGSRKTLKAIGKSFTIEDIAFATECCNSINLPNAHYIIVGGPDEDDSTLSETFSLFNKIEPTAVIVFVGIRIYPNTLLYYKAIEDKIIEKDQNILEPVFYISPKIDRDVLLQKIYDYAQQSHNWIVPGLDIRCDTDMLTVMRKIGKRGPLWDMI

SEQ ID NO: 14684 - protein, 112 aa, Moorella thermoacetica
MYKIEAIIRPEKFEAVKEALGRYGVHGMTVTHTLGCGQQKGKTEVYRGTAYTIALLPKVKVEIVLEDRYVDDVVAIIAREARTGNIGDGKIFICPVQDAIRIRTGERGAEAI

SEQ ID NO: 14685 - protein, 250 aa, Oryza sativa
MEPSSQPQPAIGVVAGGSQVYPAYRPAATVPTAPAVIPAGSQPAPSFPANPDQLSAQHQLVYQQAQQFHQQLQQQQQRQLQQFWAERLVDIEQTTDFKNHSLPLARIKKIMKADEDVRMISAEAPVIFAKACEIFILELTLRSWMHTEENKRRTLQKNDIAAAITRTDMYDFLVDIVPRDDLKEEGVGLPRAGLPPLGVPADSYPYGYYVPQQQVPGAGIAYGGQQGHPGYLWQDPQEQQEEPPAEQQSD

SEQ ID NO: 14686 - protein, 522 aa, Unknown
  Erythrobacter sp. NAP1
MNAPNKSGWKPEMTVAEDGLHNGPETTTGNRALMLEEPLIFEIGHTETTGVDLPEIDPEAPSRLGSLTRSEPIGLVGLTEPETVRHYTRLSRQNYGIDLGFFPLGSCTMKHNPRLNEKMARLPGYADIHPLAPQNSVQGALEVIYELGDWLKTLTGMPAVAMSPKAGAHGELCGILAIRAAHEARGDAREVVLVPESAHGTNPATAAFAGYRVEDIPATEEGRVDVAKLKERLGPDVAAVMITNPNTCGLFEKDFREIADAVHEAGGYVYCDGANFNAIVGRVRPGDLGVDAMHINLHKTFSTPHGGGGPGSGPVVFSEALEPFAPLPFVRKHEDGTYELVEEEAREESRGQTFGRMTAFHGQMGMFTRALTYMLSHGADGLKQVAEDAVLNANYILRNLEGSLYAPFADSGPCMHEALFGDKGFENGLTTLDLAKGLIDEGYHPMTVYFPLVVHGAMLIEPTETESKAAIDQFITAIRSVAERAKAGDETLKQAPYYAPRRRLDETAAARKPKLSWQEPEG

SEQ ID NO: 14687 - protein, 458 aa, Unknown
  Erythrobacter sp. NAP1
MRYLPLTDTDRTEMLAKIGADSIDDLFVDVPEVARLDGPIRDLPMHASEMAVERHMKARAAKNLAAGDAPFFLGAGAYRHHIPASVDHIIQRGEFLTAYTPYQPEIAQGTLQMLFEFQSQVARLYGCAVANASLYDGSTACWEAVAMATRVTRKKRAVLSGALHPHYSEVVRTMAHFTGDVIADSAPAIQPEPDLDGLTARIDEDTACVVVQYPDILGRISDLTPVAEAAHAVGALLVVVNTEPVALGAIKAPGEMGADIVVGEGQSIGVGLQFGGPYLGLFAVRDPNHVRQMPGRLCGETTDAEGKRGFVLTLSTREQHIRREKATSNICTNSGLCALAFSVHMTLLGEKGLRELAAENHRLACLAADRLEKVPGVKLLNNAFFNEFTLMLDGKPAREIVRDLADRGVLGGVSLGRLYPGVEALEHALLVAVTETTTEEDIETLARELEASVKEVAQ

SEQ ID NO: 14688 - protein, 315 aa, Methanosarcina acetivorans
MNSFLFSGGNMYDLIIIGGGPAGLAAGIYAVRFGLDTLVLEKSEISGQISMSDIVENYPGFPSISGLELMEKYRTHAQEVGVKTKITEVLSVRTEGAKKIVSTDSGDLEAKTLIIATGANPKHLGVPGEKEFISKGVSYCAICDGPFFKNKTVVVVGGGNSAVTDALLLSKVAQNVYLIHRRDRLKAAKVLQDRALATPNIEFILNTLVQEIAGSREGVKKVEKVILQDLNSKESRELSTNGVFIYVGIQPNTEFVNVEKNNEGFIITNRWMETSEKGIYAAGDCRDTPIWQLVAAVRDGAIAATAANEYIESLK

SEQ ID NO: 14689 - protein, 190 aa, Arabidopsis thaliana
MSSFTTTNTPPPYLLRKIYHRRVNQPFSVVCCTGEPQQDIFTRRRTLTSLITFTVIGGATSSALAQEKWGTRSFIKEKYFMPGLSPEDAAARIKQTAEGLRDMREMLDHMSWRYVIFYIRLKQAYLSQDLTNAMNILPESRRNDYVQAANELVENMSELDFYVRTPKVYESYLYYEKTLKSIDNVVEFLA

SEQ ID NO: 14690 - protein, 99 aa, Prochlorococcus marinus
MASYKVTLVSESEGLNQTIEVPDDQYILDAAEEQGIDLPYSCRAGACSTCAGKITSGSVDQSDQSFLDDDQLEAGFVLTCVAYPTSDVTITTHAEEELY

SEQ ID NO: 14691 - protein, 559 aa, Unknown
  marine gamma proteobacterium HTCC2143
MSESFADLFEESLGTIDMKPGSIVTGVVIDIDSDWVTVHAGLKSEGVIPRIEFLTESGELKLEIGDEVQVALEAVEDGWGATKLSREKAKRAEAWKVLEAAYAAEESVVGIINGKVKGGFTVDVNSIRAFLPGSLVDVRPVRETTHLEGKELEFKVIKLDQKRNNVVVSRRAVMETANSAERDELLATLQEGQSVKGIVKNLTDYGAFVDLGGVDGLLHITDMAWKRIKHPSEIVNVGDEIDVKVLKFDRERNRVSLGLKQLGEDPWVSITGRYPEGARVKATITNLTDYGCFAEIEEGVEGLVHVSEMDWTNKNIHPSKVVNLGDEVEVMILDIDEERRRISLGIKQCMENPWDAFGRQFNKGDKISGGIKSITDFGIFIGLDGAIDGLVHLSDISWNETGEDAVRKYKKGDEIETVILSVDPERERISLGIKQLEDDPFNNYATANDKNSIVMGTVKEVDAKAAVITLAEDIEGTLKASEISRDKVEDARNALKEGDEVEVKIISIDRKNRTIALSIKAKDMADEKEAVKAHKVAETESAAPATIGDLIKAQMEGKE

SEQ ID NO: 14692 - protein, 85 aa, Triticum aestivum
MSSRRGRITDEEINELISKLQALVPESSRRRSASRSSASKLLKETCGYIKSLHQEVEDLSDRLSELMSTLDETSPQAEIIRGLLR

SEQ ID NO: 14693 - protein, 522 aa, Neisseria gonorrhoeae
MKHRTFFSLCAKFGCLLALGACSPKIVDAGTATVPHTLSTLKTADNRPASVYLKKDKPTLIKFWASWCPLCLSELGQAEKWAQDAKFSSANLITVASPGFLHEKKDGEFQKWYAGLNYPKLPVVTDNGGTIAQNLNISVYPSWALIGKDGDVQRIVKGSINEAQALALIRNPNADLGSLKHSFYKPDTQKKDSAIMNTRTIYLAGGCFWGLEAYFQRIDGVVDAVSGYANGNTENPSYEDVSYRHTGHAETVKVTYDADKLSLDDILQYYFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKAAPQGKGFDAATYKKPSDAELKRTLTEEQYQVTQNSATEYAFSHEYDHLFKPGIYVDVVSGEPLFSSADKYDSGCGWPSFTRPIDAKSVTEHDDFSFNMRRTEVRSRAADSHLGHVFPDGPRDKGGLRYCINGASLKFIPLEQMDAAGYGALKGEVK

SEQ ID NO: 14694 - protein, 142 aa, Ustilago maydis
MPPKPAEKKPSSTAGKAPASSAGKAPAEAAKKTSKAPAKSGEKKKATKVRKETYSTYIYRVLKQVHPDTGISNKAMAILNSFVQDIFERIATEASKLASYNKKSTISSREIQTAVRLILPGELSKHAISEGTKSVTKFSSSK

SEQ ID NO: 14695 - protein, 962 aa, Unknown
  marine gamma proteobacterium HTCC2143
MLNTYASLTELEAADEFIQRHIGPDESQQQEMLDLLGVSSLDELITSTVPANILRAKPMNIADPKTEANALAELHLLAQQNQVMDNYIGQGYHPTLTPNVILRNVLQNPGWYTAYTPYQPEIAQGRLEGLLNYQQMIMDLTGMELANASMLDEGTAAAEAMALLKRVNKKNRSNQFFVANDTHPQTIAVLKTRAATYGFELVIGEVSELNGADVFGALLQYPGTYGHITDLETVIAQAQQQNTLVVVAADIMSLVILKPPGEMGADVVVGNSQRFGVPMGFGGPHAAFFAIKDKYKRSIPGRLIGVSIDRHGNQALRMAMQTREQHIRREKATSNICTAQALLAIMASFYGVYHGPQGLKTIANRIHRLTNILAHGLEKLGLATVNTHWFDTLTIDVAEQQPAILARAIENNINLRKVGDSKIAISLDETTTRAHVDILWRVISGMDIGLSIESIDVETINHSPIPEHYRRNSVFMTHPVFNQHHSETEMLRYMKRLESKDIALNHSMIALGSCTMKLNATAEMIPVTWPQFANMHPFAPQNQAKGYLAMFKQLEEMLIEATGYDAISLQPNSGAQGEYAGLLTIMKYHQSRGDFNRDLCLIPSSAHGTNPASAAVAGMRIVIVECDDSGNVDMDDLKTKAAHHADELAAIMITYPSTHGVFEESITEICDTIHDHGGQVYVDGANLNALVGIAAPGKFGADVSHINLHKTFCIPHGGGGPGMGPIGVGKHLAPFLPNNPAQPIDGLDINNDTVSSASWGSAAILPISWMYIAMMGEQGLKKATQVAILNANYIAQKLSKHYPILYTGRNNRIAHECILDMRTIKESSGISEEDVAKRLMDFGFHAPTMSFPVPGTLMVEPTESEPKEELDRFIEAMIAIRKEIAQVETGELDEEDNPLKNAPHTSMEATSSDWVHSYSREQAIFPIGSDNKYWPPVARIDNVFGDRNLICSCPDIDSYRED

SEQ ID NO: 14696 - protein, 507 aa, Staphylococcus epidermidis
MLNADLKQQLQQLLELMEGDVEFVASLGSDDKSNELKELLNEMAEMSAHITITEKSLKRTPSFSVNRPGEETGITFAGIPLGHEFNSLVLAILQVSGRAPKEKQSIIDQIKGLEGPFHFETFVSLTCQKCPDVVQALNLMSVINPNITHTMIDGAVFREESENIMAVPAVFLDGQEFGNGRMTVQDILTKLGSTQDASEFNDKDPYDVLIVGGGPASGSAAIYTARKGLRTGIVADRIGGQVNDTAGIENFITVKETTGSEFSSNLAEHIAQYDIDTMTGIRATNIEKTDSAIRVTLENDAVLESKTVIISTGASWRKLNIPGEDRLINKGVAFCPHCDGPLFENKDVAVIGGGNSGVEAAIDLAGIVKHVTLFEYASELKADSVLQERLRSLPNVDIKTSAKTTEVIGDDYVTGISYEDMTTGESQVVNLDGIFVQIGLVPNTSWLQNAVELNERGEVMINRDNATNVPGIFAAGDVTDQKNKQIIISMGAGANAALNAFDYIIRN

SEQ ID NO: 14697 - protein, 71 aa, Rickettsia typhi
MSKDDLIQFTGTVLELLPNATFRVKLENDHVIIAHTSGRMRKNRIRILLGDKVTVEMTPYDLTKGRVIHRH

SEQ ID NO: 14698 - protein, 1028 aa, Streptomyces coelicolor
MTVTRRSVLIASTAAPAAGMALAAPSARAADATGGSAGRSTLALRDGWRFRLTDPDGAAEDDTDAADPAHDDSAWREVAVPHDWSIEQTPTTEHGTTSGTGFLPGGLGWYRLAFTLPPALAGKRISVEFDGVYMDSRVHCNGREVGHHPYGYTGFALDLTDLVHTDGRTENVLAVRVRNQLPSSRWYSGSGIYREARLVVTEPVHVRRWGTYVTTPRVSGESAVVRVRTSVVNATGTAREVEIRSAVKDADGRTVARTASTVDVTDAASETHELTVARPRLWDFASPHRYTLHTELRVGGRTVDTYRTPFGIRTFHVDPEEGFHLNGRYAKIKGVDLHHDLGALGAAVSADAVRRQMTLMKSMGVNAFRTSHNPPSPEMIEVCEEMGIIMLVEAFDCWRTGKNRYDYGRFFDEWCERDATEMVLAARNSPAVVMWSIGNEVPDSTATAGLAMADRIIEAIRAADDTRPLVIGSDKYRRLPAKGSAADLMLAKLDGLGLNYNTAKSVDDLHAVYPHLFLFESESSSETSTRGTYQEPEHLNTGENHTPGGRATSSYDNNLASWTMSGEYGHKKDRDRKWFAGQFLWSGIDYIGEPTPYDVFPVKASFFGAVDTAGFPKDMYHLFRSQWTDEPMVHLLPTTWNHREGDTVEVWAYTNVDTVELYLNGKSLGTRRFDRKKTVDGRAYLETTEATGDDKTFTDGPYPGSYTSPNGSAGKLHLTWTVPFEAGELKAVARRGGRTVATDVLRTAQAAHALRLTPDRESVDADGRSLVFVTAEVVDQHGVVVPGAEHLISFDVAGGSLAGLDNGRQESAERYQASTRTAFHGKALAIVRSGTRPGTVRVTARADGLRTGTAAVRARRAPDPAITPAPEFRPEHPAPVEHPHADASYSGRTDSLPAAVLDGAPATGWSNGFHKAATALLPAFDGARAEDWISVDHGRTRTYDRVEVSFTVDDGHSLPATLAVDVWDGRAWRAATEVRTEWATASDGPTVIGFRPLRGSRIRLTLTSRHPGEARGAVRVSRLEAPAA

SEQ ID NO: 14699 - protein, 178 aa, Bacillus cereus
MSEKTYELATFAGGCFWCMVKPFDELPGIHKVRSGYAGGHVENPTYEQVKAGTSGHLEVVQITFDPSIFPYKKLLDLYWPQIDPTDDGGQFFDRGPSYRTAIFYHNETQKELAEKSKQALAESGMFKEPIVTEIRPAAPFYEAEEYHQHFYKKNPEKYATEQKESGREDFIKENWQKK

SEQ ID NO: 14700 - protein, 300 aa, Unknown
  Polaromonas sp. JS666
MNYPTIEDAIGKTPLVALQRIAAAENTERNNVILGKLEGNNPAGSVKDRPALSMIKRAEERGDIKPGDILIEATSGNTGIALAMAAAIKGYRMVLIMPEDLSIERAQTMKAFGAELVLTPKSGGMEHARDLAEQMQNEGKGRVLDQFANQDNPRIHYETTGPEIWTDTSGKVTHFVSAMGTTGTITGVSRYLKEKNPAIRVIGAQPSEGSRIPGIRKWQQEYLPKIYDPSHVDELVLVSQSDAEDMCRRLAREEGIFAGISSAGACWVAQEIAKTVKDAVIVFVVCDRGDRYLSTGVFPA

SEQ ID NO: 14701 - protein, 337 aa, Streptococcus thermophilus
MKQKRARLIYNPTSGQEIMKKNVAEVLDILEGAGFETSAFQTTPDENSAKNEATRAAEAGFDLVIAAGGDGTINEVVSGIAPLDKRPQMAVIPTGTTNDFARALKIPRGNPVEAAKVIAKNQTLQMDIGRAYDDKYFINIAAAGSFTELTYSVPSRLKTVLGYLAYLVKGAELLPQVKKVPVRITHDQGVFEGELSMIFVALTNSVGGFEMIAPDAKLDDGQFTLIMVKTANLFELVDLIRQVLQGGKHIYDKRVAYIKTSSLDIEPLGEDRMMINLDGEYGGDAPINLQNLKNHIEFYANIDEISDDAITLPDTDKLALEAIVQKFSTEAEKIEND

SEQ ID NO: 14702 - protein, 424 aa, Xylella fastidiosa
MFFSGVAMFPRDARLDMYDPELAKAIAAEVMRQEDHVELIASENYCSTLVMQVQGSQLTNKYAEGYSGKRYYGGCECVDIAEQLAIERAKQLFGADYANVQPHSGSQANQAVYFALLQPGDTILGMSLAHGGHLTHGANVNVSGKLFNAVQYGVNGQGLIDYEAVESLALEHRPKMVVAGFSAYSQKIDWARFRAIADQVGAYLLVDMAHVAGLVAACVYPNPLPHAHVVTSTTHKTLRGPRGGIIVAQAPQEALVKKLQSIVFPGIQGGPLMHVIAAKAVAFKEALEPAFKVYQQQVVKNAKAMAETLMLRGYKIVSGGTENHLMLVDMIGRDVSGKDAEGALGQAHITVNKNAVPDDPRSPFVTSGLRLGTPAVTTRGYQEQDCVDLAHWIADVLDAPADATVIAAVREKVAAQCRKYPVYR

SEQ ID NO: 14703 - protein, 429 aa, Spiraea nipponica
MAHILAPTTQWQTRITKNATSASPMTAKMWGSLLLKQNKKGPTKTSTKFRVLAVKSEGYTINRLEGLLNLDLTPFTDKIIAEYIWIGGTGVDVRSKSRTISKPVEHPSELPKWNYDGSSTGQAPGEDSEVILYPQAIFKDPFRGGNNILVICDAYTPQGEPIPTNKRAKAAEIFAKQKVIDEVPWYGIEQEYTLLQTDVKWPLGWPVGGYPGPQGPYYCGAGADKSFGRDISDAHYKACLYAGINISGTNGEVMPGQWEYQVGPSVGIEAGDHIWASRYILERITEQAGVVLTLDPKPIEGDWNGAGCHTNYSTKSMREEGGFEVIKKAIHKLSLRHKEHISAYGEGNERRLTGKHETASINTFSWGVANRGCSIRVGRETEKQGKGYLEDRRPASNMDPYIVTGLLAETTLLWEEAEALAATKLEQNV

SEQ ID NO: 14704 - protein, 138 aa, Glycine max
  misc_feature (122)..(122): Xaa can be any naturally occurring amino acid
ALSMISSPADTTINRAGAGLDAPFTGLKYMAGFPTRKTNNDLTSIASNGGRVQCMHVWPPVGKKKYETLSYLPDLDDAHIGKRQSNTLLRNGWIPCLEYALDHGFMYREHNMSPGYYDGRYXTMRKLPMLDCTVASKE

SEQ ID NO: 14705 - protein, 224 aa, Gazania splendens
GYPGPQGPYYCGAGADKSFGRDISDAHYKACLYAGINISGTNGEVMPGQWEFQVGPSVGIEAGDHIWCARYLLERITEQAGVVLTLDPKPIDGDWNGAGCHTNYSTLAMREDGGFEVIKKAILNLSLRHMEHISAYGEGNERRLTGKHETASINTFSWGVANRGCSIRVGRDTEKAGKGYLEDRRPASNMDPYTVTGLLAETTLLWEPTLEAEALAAQKLALNV

SEQ ID NO: 14706 - protein, 185 aa, Unknown
  Marinobacter sp. ELB17
MIDTVAEMKQVMAEADCLVPNQQVQAAITALASAITERLEGSNPLVFCVMNGGLITTGQLLTQLNFPVQAEYLHATRYRQETTGGILEWKLRPEVDMNDRIILIVDDILDEGTTLCAIADYCRAHGAAEVLTAVLVDKQHDRKCRPGLKADFTGMDVEDRFLFGFGMDYKGYWRNAPGIYAVKGL

SEQ ID NO: 14707 - protein, 177 aa, Triticum aestivum
YICDVERRGEWDVLAEGARVQEDASLATAQFPLTGVSILRPTGRGRGGSSCNKKLILQQACGDAPCIVVAYAPIDTADLKDVMHGGRRASLSLLPSGFSILPDGVGDIQTDPLDANPSAVDPIDHQRSCGSLVSVLRQTHLIGGNLTAQTVDNFGNNVSGSIMKIKDAVHAKRVMTV

SEQ ID NO: 14708 - protein, 434 aa, Debaryomyces hansenii
MVAPAYVEDTYVDHELSANLDSTFAFEGPEKLLEIWFFKSENDIPKKSEGLRSIPLEKWVRVLDLVSCKILSMKSSKFMDAYLLSESSLFVFPHKLILKTCGTTTTLACLESLFETVNQYVEGIDFNDFNVYKIFYSRRSFMFPDKQKHVHRNWKQEVTLLNKYFQNGKSYIVGDFTGDDHWYLYMGGRDSVPSDENANDNVRDQTFEILMTELNPEKAENFIADRKPGAESLIKESSEEEEHDLGHDMGMQTMCKSKLDSIFDGSNKKLKSHHLPSPSLSDSMELDSDECLKETPTINSDKFKFIHDAFAFSPCGYSSNSISSNNGGYYYTLHITPESGWSYASFETNYPFTKDSNESIVDVLNKVLDIFQPGKFSVTFITESEDTHDKFNFHDLSNCAEDLSEQGYQKQERVLYDLKFGYKLLYLNFTKDKT

SEQ ID NO: 14709 - protein, 325 aa, Triticum aestivum
MGEASPSIAKDVTELIGNTPLVYLNKVTDGCVGRVAAKLESMEPCSSVKDRIGYSMITDAEEKGLIIPGVSVLIEPTSGNTGIGLAFMAAAKGYKLILTMPASMSMERRIILKAFGAELVLTDPLLGMKGAVKKAEEIQAKTPNSYILQQFENPANPKIHYETTGPEIWKATAGKIDALVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 14710 - protein, 483 aa, Bacillus anthracis
MIKLIAENVKNFDEYSKMVEKYTLDYTEKITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPPSNPRDKNRNPQNGVEIEQKWQRKQYVSLVD

SEQ ID NO: 14711 - protein, 738 aa, Unknown
  Petunia x hybrida
MDCNCFDPQWPADELLMKYQYLSDFFIALAYFSIPVELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRALGLEECALWMPTRTGLELQLSYTLRHQNPVGFTVPIQLPVINQVFSTNRAVKISPNSPVARLRPAGKYMPGEVVAVRVPLLHLSNFQINDWPELSTKRYALMVLMLPSDSARQWHAHVLELVEVVADQVAVALSHAAILEESMRARDLLMEQNVALDLARREAETAVRARNDFLAVMNHEMRTPMHALIALSSLLQETELTPEQRLMVETILKSSNLLATLINDVLDLSRLEDGSLQLDIGTFNLHALFREVLNLIKPIASVKKLFVTLSLSSDLPEFAIGDEKRIMQVLLNVIGNAVKFSKEGSVSVSAVAAKSESLRDPRAPEFFPVQSENHFYLRVQVKDTGSGISPQDIPKLFNKFAQNQALATKNSGGSGLGLAICKRFVNLMEGHIWIESEGLGKGCTAVFVVKLGIPGRSNESKLPFMPRLPPNHMQMIFQGLKVLVMDDNGFSRMVTKGLLVHLGCDVTTVASGDECLRVLAQEHRVVFMDVSIPGIDCYEVAVRIHEKFNKRHDRPHIVALTANTDRVIKENCMRAGMDGVILKPVSVDKMRSVLSELLEHGVVLQS

SEQ ID NO: 14712 - protein, 738 aa, Unknown
  Petunia x hybrida
MDCNCFDPQWPADELLMKYQYLSDFFIALAYFSIPVELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRALGLEECALWMPTRTGLELQLSYTLRHQNPVGFTVPIQLPVINQVFSTNRAVKISPNSPVARLRPAGKYMPGEVVAVRVPLLHLSNFQINDWPELSTKRYALMVLMLPSDSARQWHAHELELVEVVADQVAVALSHAAILEESMRARDLLMEQNVALDLARREAEMAVRARNDFLAVMNHEMRTPMHAIIALSSLLQETELTPEQRLMVETILKSSNLLATLINDVLDLSRLEDGSLQLDIGTFNLHALFREVLNLIKPIASVKKLFVTLSLSSDLPEFAIGDEKRIMQVLLNVIGNAVKFSKEGSVSVSAVAAKSESLRDPRAPEFFPVQSENHFYLRVQVKDTGSGISPQDIPKLFNKFAQNQALATNNSGGSGLGLAICKRFANLMEGHIWIESEGLGKGSTAVFVVKLGIPGRSNESKLPFMPRLPPNHMQMTFQGLKVLVMDDNGFSRMVTKGLLVHLGCDVTTVASGDECLRVLAQEQSVVFMDVSIPGIDCYEVAVRIHEKFNKRHDRPLIVALTASTDRVIKENCMRAGMDGVILKPVSVDKMRSVLSELLEHGVVLQS

SEQ ID NO: 14713 - protein, 753 aa, Unknown
  Petunia x hybrida
MGSLLRMNRLLTSIVDSCNCIDPQLPADDLLMKYQYISDFFIALAYFPIPVELIYFVKKSAVFPYRWVLVQFGAFIVLCGATHLINLWTFSMHTRTVAVVMTTAKVLTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNRAVKISPNAPVARLRPTGKYMPGEVVAVRAPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLLLDIGTFNLHALFREVLSLIKPITSVKKLFATLSLSSDLPEYVIGDEKRLMQILLNVVGNAVKFSKEGSVSISAFVAKSESLRDPRAPEFFAVPSENHFYLRVQVKDTGVGINQQDIPNLFSKFAQSEALTTKNSDGSGLGLAICKRFVNLMEGHIWIESDGLGKGCTAIFIIKLGIPGRPNESKLPLMSKLTANELQMTFHGLKVLVMDDNGVSRMVTKGLLAHLGCDVTTVGSRDECLRVVSQEHKVVFMDVSMQGIDCYEVAVLIHERFGKHHGRPLVVELTGNTDSVTKENCMRVGMDGVILKPVSVDKMRSVLSELLEHGVVLQS

SEQ ID NO: 14714 - protein, 132 aa, Kluyveromyces lactis
MSMQTSLCKEKNIPLSQIIRPIQPVLDHAKIDAMISTFKGTPKASRTMTESQAAERVATLPADQRLPPVDVAAVRYPETGETRYFAFGGCHRLQAYDKLASESQENDIAVRCRLMPMTPKQLKLYVGGSGDA

SEQ ID NO: 14715 - protein, 621 aa, Unknown
  Synechocystis sp. PCC 6803
MVASIPNPKTNFLKTVPSQRQTGAYILMDSLKRHGVKHIFGYPGGAILPIYDELYRFEAAGEIEHILVRHEQGASHAADGYARATGKVGVCFGTSGPGATNLVTGIANAHLDSVPMVVITGQVGRAMIGSDAFQEIDIFGITLPIVKHSYVVRSAADMARIVTEAFHLASTGRPGPVLIDIPKDVGLEECEYIPLDPGDVNLPGYRPTVKGNPRQINAALQLLEQARNPLLYVGGGAIAANAHAQVQEFAERFQLPVTTTLMGIGAFDENHPLSVGMLGMHGTAYANFAVSECDLLIAVGARFDDRVTGKLDEFASRAKVIHIDIDPAEVGKNRAPDVPIVGDVRHVLEQLLQRARELDYPTHPHTTQAWLNRIDHWRTDYPLQVPHYEDTIAPQEVVHEIGRQAPDAYYTTDVGQHQMWAAQFLNNGPRRWISSAGLGTMGFGLPAAMGAKVGVGDEAVICISGDASFQMNLQELGTLAQYDIQVKTIILNNGWQGMVRQWQQTFYEERYSASNMSQGMPDINLLCEAYGIKGITVRKREDLAPAIAEMLAHNGPVVMDVVVKKDENCYPMIAPGMSNAQMLGLPEVPVRDNGPRMVECNHCQTQNFITHRFCSGCGAKL

SEQ ID NO: 14716 - protein, 221 aa, Pseudomonas aeruginosa
MKKIKLVMVGNGMAGVRTLEELLKLNSDFYDITVFGAEPHPNYNRILLSPVLAGEQTFEEIVLNDLNWYAENGIKLLLDRKVVQIDRLRRRVVAADGSEAEYDRLLLATGSLPFILPIPGNRLQGVIGYRDIADTQAMIDCARTHSHAVVIGGGLLGLEAANGLKQRGMDVTVVHLSDWLLERQLDRTAGKLLQGALEARGIRFRLNTQTQELMDNGSGRV

SEQ ID NO: 14717 - protein, 254 aa, Oryza sativa
MGRQPCCEKVGLKKGPWTADEDQKLVTFLLSNGHCCWRLVPKLAGLLRCGKSCRLRWTNYLRPDLKRGLLSEEEEKLVIDLHEQLGNRWSKIAARLPGRTDNEIKNHWNTHIKKKLKKMGLDPVTHRPVMSLAQPDPLKQQQQQQEPSVSGGTGADDKEEEEETPTSAQPQGVACAASSASAVSSSCSSSASASAATPGADVDWPGLFEVDAILDIDWAGLLSACGDDGGCSAIGVDMLFDQCSDVGFDQDVWM

SEQ ID NO: 14718 - protein, 466 aa, Oryza sativa
MAGEGSGGEGGAGAFEDEAEPTVTIGEYIEGIEAEELEADLVLGGDDGKECTYGGGYLKRQAVFSCLTCVPAGVAGVCTACSLACHDGHELGLVSMFIWVRRMSATRVILGVALAVAKLSIAIFCIKYLYDWVMRTQLMLGWFFLLKVVELWTKRKFRCDCGNSKFGSHVCKLCPEKDPENPVNSYNHNFKGSYCTCGRPYPDPEAEKQVEMIQCCICEDWFHEDHIGLNSIEEIPRDEEGEPLYEDFICPKCSPKCYFLKLYPDTIWASNKQSSAPQAETTNSTVMNGNSSLGDIEKSENGALINHLNCEKTSDNENCPKDSVAPEKASLDDSSDGKCKLGMNICSNTPSADSEKKMPFFMSKSWREVICRCETCTDFYAQQGVAYLIDKEDSIEEYEKVAKQKREKKLEQQEGVEANFLNSLDHVQKIEILSGINDMKNELQSFLSISQINGDTSHVSVSGFEF

SEQ ID NO: 14719 - protein, 472 aa, Prochlorococcus marinus
MSKAHFGLIGLGVMGENLVLNAERNGFSSVVFNRTYSKTEEFLQGRGLGKSIEGAETLQEFVNKLERPRRILMMVKAGPATDAVIDNISGYLEEGDLLIDGGNSQFKDTERRVNTLESKSFGYIGMGVSGGAKGALEGPSMMPGGTKASYDAIESLLTKMAAKVEDGPCVAYVGPGGSGHFVKTVHNGIEYGIEQILAEAYDLMKRVKGMNGQQMSEVFGIWNNTDELASYLVEITEICLNTKDEMTGDDVVEKILDKAGQKGTGLWTVVSALELGVSVPTIYASLNARVMSSLKEQRTEIEKTIPSKDIEDFDLGNISDGMKPLFDAVVLATIASYAQGMDILREASAVYNYGLNMPSIAQIWKGGCIIRSKLLSKIQDAYNKDPDLKNLIFDDWFNNEIATRLDNLAKVVSLSTKAGIPVPCLSSTLDYLNSYRTNRLPQNLVQAMRDCFGSHTYERIDREGSFHTEWMK

SEQ ID NO: 14720 - protein, 438 aa, Thermus thermophilus
MDYTPHTEEEIREMLRRVGAASLEDLFAHLPKEILSPPIDLPEPLPEWKVLEELRRLAAQNLPAHKAFLGGGVRSHHVPPVVQALAARGEFLTAYTPYQPEVSQGVLQATFEYQTMIAELAGLEIANASMYDGATALAEGVLLALRETGRMGVLVSQGVHPEYRAVLRAYLEAVGAKLLTLPLEGGRTPLPEVGEEVGAVVVQNPNFLGALEDLGPFAEAAHGAGALFVAVADPLSLGVLKPPGAYGADIAVGDGQSLGLPMGFGGPHFGFLATKKAFVRQLPGRLVSETVDVEGRRGFILTLQAREQYIRRAKAKSNITTNAQLTALMGAMYLAALGPEGLREVALKSVEMAHKLHALLLEVPGVRPFTPKPFFNEFALALPKDPEAVRRALAERGFHGATPVPREYGENLALFAATELHEEEDLLALREALKEVLA

SEQ ID NO: 14721 - protein, 430 aa, Fulvimarina pelagi
MLETVKRQAEDASITELMHGIGVRARTAARVLATASTEQKNTALEKMADALVGSLGTILAENEVDVARAQEKGSPASFIDRLTLNAARVIAMSEGLRSIAELPDPVGDVMASWTRPNGLDISRVRTPLGVVGVIYESRPNVTADAGALCLKSGNAVILRGGSDSANSSAAIHAALRAGLVEAGLPEHAIQIVPSTDRAAVGEMLAGLSGNIDVIVPRGGKSLVARVQAEARVPVFAHLEGLCHVYIDGSADRDMAVNVVVNSKMRRTGICGAAETLLVDRKAKDTLLAPVLDALAEKGCEIRGTDEVRAIYQGANASTEEDFATEYLDSIISVALVDGVEDAVEFIEAHSSHHTEAIVAEDEAAVETFMNGIDSAILLHNASTQFADGGEFGMGAEIGIATGKMHARGPVGLEQLTSFNYRVRGSGQTRL

SEQ ID NO: 14722 - protein, 473 aa, Thermus thermophilus
MSFPLIFERSRKGRRGLKLVKAVPKAEDLIPKEHLREVPPRLPEVDELTLVRHYTGLSRRQVGVDTTFYPLGSCTMKYNPKLHEEAARLFADLHPYQDPRTAQGALRLMWELGEYLKALTGMDAITLEPAAGAHGELTGILIIRAYHEDRGEGRTRRVVLVPDSAHGSNPATASMAGYQVREIPSGPEGEVDLEALKRELGPHVAALMLTNPNTLGLFERRILEISRLCKEAGVQLYYDGANLNAIMGWARPGDMGFDVVHLNLHKTFTVPHGGGGPGSGPVGVKAHLAPYLPVPLVERGEEGFYLDFDRPKSIGRVRSFYGNFLALVRAWAYIRTLGLEGLKKAAALAVLNARYLKELLKEKGYRVPYDGPSMHEFVAQPPQGFRALDLAKGLLELGFHPPTVYFPLIVKEALMVEPTETEAKETLEAFAEAMGALLKKPKEWLENAPYSTPVRRLDELRANRSPKLTYFDE

SEQ ID NO: 14723 - protein, 475 aa, Pseudomonas aeruginosa
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQVSGQPIEFRMWLYPWLTWAVILFIVAALSIMLIMPEHRHEVFATALLTIFTVCLGLLNARRKPRLGEDYAGKTARV

SEQ ID NO: 14724 - protein, 600 aa, Prochlorococcus marinus
MSEINISLLSENQNLSKFEIADNFTCIRFLDRQKERFELEFNLEKGTSFNTFFIRNNEELLIIHPPEKQYLNSFIEIISNFFNQYKLKKINFISGHINPQIIETIKNVSKRFQDLTITCSNPGFKLISELWNQRNPNLEEFFEIQLPKINIVKKELNLELSNISLELIPIPTARWPGGLIIYERNQEILLSEKIFSAHIASEYWSETNRISTEIDRKHFYDCLMAPMSNQVVSITEKIADYDIKTIAPLHGPAIEYSLKSFFNDYIRWGENLSTNNPKIALIYASAYGNTASIGDALAKGINRTSVEVESINCEFTSNDVLIKSIHNADGYLIGSPTLGGHAPTPIVSALGTLLAEGNRDKPVGIFGSFGWSGEAIDLLESKLKDGGFQFSFDPIRIKFSPNKPKIKELEEIGTHFGRKIIKKAKKKPRKSDTGMITSKTDPKLQALGRVIGSLCVLTASKGKDENNIKGAMLASWVSQASFSPPGLSIAVAKDRSVESLLQIGDSFALNILSEKDFKEPLKRFTKPFSPGEDRFEGINIELTPNEQIIIPNSLAWLEAAVKERMECGDHWVIYAEVLHGNILKSDCLTAVHHRKTGANY

SEQ ID NO: 14725 - protein, 591 aa, Prochlorococcus marinus
MLASAQTSNSKLAQINNKLTVQSQNFADDSCAIRSLDWDRSRFDIEFGLRNGTTYNSFIIKGEKLAIIDTSHAKFEELWFEELLKEVNPQEVDYLITSHTEPDHSGLIGNLLQLNKNITVVGSKLALKFIEDQIHVPFKRLEVKSGEFLNLGTNPNSGLEHNIEFISAPNLHWPDTIFSYDHSTHVLYTCDAFGLHYCSDEFYDTDQKEIYDDFRFYYDCLMGPNARSVLQAIKRIDKLPELKTIAVGHGPLLHNQVNFWKGKYQEWSSNKSKGNDFVSVCYISDYGYCDRLSQAISHGISKADAQVQLIDLRSSDPQELTSLISESKAVVIPTWPVDSDNELKESLGTLFAALKSKQFTAVYDAFGGNDEPIDSLANKLRELGQKEAFSPLRVKNIPDPIVYQQFEEAGTDLGQLINKKKNIASMKSLDSNLDKALGRLSGGLYVVTASQGEGSTFRQSAMVASWVSQASFSPPGITVAVAKDRAIESYMQVGKGFVVNVLREDNYQKMFRHFLKRFAPGADRFADVDIISNIADGGPVLSDSLAFLDCKVSSRLETPDHWIIYGIVENGNVSDLSCKTAVHHRKVANHY

SEQ ID NO: 14726 - protein, 660 aa, Haemophilus somnus
MSKISLGKPYPLGCTECCMEGIAGFNFAIYSSQASAVELCIFNKNSVQETRYSMYCTENIWHIWVAELEYGTEYGFRIHGVDGSLSNPNKLMLDPYAKAVVGKPDLSCVENRAWFLLEDERDNAHLAPKALIESSSFDWEGDILPQTPWSESIIYELHVKGFTQLREDIPQAIRGTYAGLAHQNVIAYLKELGVSAVELLPINYHLDEPHLQKKRLQNYWGYSPLAMFAVESKYWSNQADTTPLTEFKSMVKALHKAGIEVILDVVFNHSVESEKHFPTFSQRGIDDRTYYWQDEAGNYINLTGCGNTLNLSTELGRKWIIDCLCYWVEECHVDGFRFDLASVLGRETPDFNANALLFKEIEQVSILQKVKFIAEPWDIGMGGYQVGNFPSYFAEWNDRFRDDMCRFWLWKSGELGVFAERFAGSSDIYRCLGKLPHNSVNFITAHDGFTLHDLVSYNQKHNWANGEDNRDGRSENYSYNHGMEGYKEGNSLVEEARYLSRSALLLSLLLSNGTPMLLAGDEFGNTQYGNNNAYCQDNETTWLKWQYFEQDLFNLVKQVIALRKQIPSLQRDNWWQESDVSWLNIDAEKMSLDEWHNKGSKALQILLDSKYLFVINAKTSSQKFLLPQGNWEILCYSKVVHLENKQLEMTDLAFGVLQKK

SEQ ID NO: 14727 - protein, 145 aa, Shewanella oneidensis
MNWLKKIFSKHTKVQDDRDPNQSNAYDLIGGDKVIRAIANSFYQKMASSEETRALFAIHRAPIAESEQKLYEFLTGWLGGPQLYQQKYGHPALRARHMHFAVDEAMRDQWLFCMKFAIEKHIKKPEHRAAIYEAISTLADHMRNQ

SEQ ID NO: 14728 - protein, 178 aa, Oryza sativa
MYLLSPRNGDEEDEQEEIQELISDDEPPNLKLASCATAASSSSSSGSDMEKGRGKACGGGSTAPPPPPPSSSGKSGGGGGSNIREAAASGGGGGVWGKYFSVESLLLLVCVTASLVILPLVLPPLPPPPSMLMLVPVAMLVLLLALAFMPTTTSSSSSAGGGGGGGRNGATTGHAPYL

SEQ ID NO: 14729 - protein, 949 aa, Bacteroides fragilis
MKTDLLACRHIGVNKADAEVMLRKIGVASLDELIDKTIPANIRLKAPLALPAPMTEYEFARHIAELAGKNKLFTTYIGMGWYNTITPAVIQRNVFENPVWYTSYTPYQTEVSQGRLEALMNFQTAVCDLTAMPLANCSLLDEATAAAEAVTMMYGLRSRNQQKAGANVVFIDENIFPQTLAVITTRAIPQDIEIRTGKFRDLEFTDDLFACVLQYPNANGNAEDYREFTEKAHTANCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYTVYHGQEGIRNIASRIHSITVFLEKSISKLGFKQVNKQYFDTLRFILPDSVSAQQIRTIALSKEVNLRYFDNGDVGLSIDETTDVAAANILLSIFAIAAGKDFQKVDDIPEATIISEELKRQTPYLTHEVFSKYHTETEMMRYIKRLDRKDISLAQSMISLGSCTMKLNAAAEMLPLSCAEFMCMHPLVPEDQAAGYRELIHNLSEELKVITGFAGVSLQPNSGAAGEYAGLRTIRAYLESIGQGHRNKVLIPASAHGTNPASAIQAGFTTVTCACDEHGNVDMDDLRAKAEENKDDLAALMITYPSTHGIFETEIVEICQIIHACGAQVYMDGANMNAQVGLTNPGFIGADVCHLNLHKTFASPHGGGGPGVGPICVAEHLVPFLPGHGLFGNSQNEVSAAPFGSAGILPITYGYIRMMGAEGLTMATKTAILNANYLAACLKDTYGIVYRGANGFVGHEMILECRKVYEETGISENDIAKRLMDYGYHAPTLSFPVHGTLMIEPTESESLSELDNFVLTMLTIWNEIQEVKNGEADKEDNVLINAPHPEYEVVSDQWEHCYTREKAAYPIESVRENKFWVNVARVDNTLGDRKLLPTCYGCFD

SEQ ID NO: 14730 - protein, 541 aa, Zea mays
MPDRTAPPRRRAAAAAASSRPASVAPAGLPPCPSPSPHAAGLTQSWTSRRREAPRWRGEGAQQSCLASLQIPKALARGAMAERLAASLLPAASPSPSARRATVAAAAAASFPSPCSARAGLRLRSRPPLFSQKAAGRGCGLRVVRCMAASDAAQLKAAREDIKELLKSTYCHPIMVRLGWHDSGTYDKDIKDWPQRGGANGSLRFDAELSHGANAGLINALKLIQPIKDKYPGITYADLFQLASATAIEEAGGPKLPMKYGRVDVTAAEQCPPEGRLPDAGPRDPAEHLREVFYRMGLDDKEIVALSGAHTLGRARPDRSGWGKLETKYTKDGPGEPGGQSWTVEWLKFDNSYFKEMKLFFLNEIQDMKFLSQLPWKEQKEQDLLVLPTDAALFEDPSFKVYAEKYADDQEAFFKDYGEAHAKLSDLGAKFDPPEGFSLDDDTSSSPSDEKTEEPTLVAVGAAVATATADDNNGAAPQPEPFVAAKYSYGKRELSDAMKQKIRAEYEGFGGSPDKPMQSNYFLNIMILIAGLAFLTSLLGN

SEQ ID NO: 14731 - protein, 529 aa, Alkaliphilus metalliredigenes
MKSMHFEDLDIKKDILKALKELGFEVPTPIQVQAIPHLKMGKDIIGQAQTGTGKTAAFGIPMIERVNPKNKAVQILIMAPTRELSVQVADEIQKFSNHVIGVKTLAIYGGQPISTQIKALKRGVQIIVGTPGRILDHINRKTLKLGEVIGVVLDEADQMLDMGFQEDMEAILKETPTERQTAMFSATISREIERIAQKYMKQPEKIMVAQKALTVPQISQYYFEVKPHEKVEALCRILDMDKTDLGIIFCRTKRSVDELTEKLQNRGYSAAAIHGDLKQTQRDRVMKKFRNRTIDLLVATDVAARGIDVNDVEMVMNYDIPEDFEYYVHRIGRTGRAGKEGVAYTLATGKQMRTLKALESYIKGKIVRRKIPTVNDVVEKQKDSIADQIHAVIEKGGLTEYTNFVEKLSDDHNSMDIAAALFKMLTEKSDTELFKVAENISDTEKEYKADMVRLFINIGKSHGVKPKDILGAVAGEAGISGDVVGIIDMYDKFTFVEVPGQFEEQVLDAMDKNRIKGKKINMERANDKR

SEQ ID NO: 14732 - protein, 380 aa, Unknown
  Erythrobacter sp. NAP1
MATQTDYYSLLEVSRDADGSTIKSAYRKLAMKWHPDRNPGNAEAEAKFKACNEAYECLKDPQKRAAYDRFGHEAFTQGMNGGGGPGGGHGPDGFADIGDIFETIFGSAFGGGGMGAQRQRQRRGADLRYDMQVTLDEAFHGKSTEIEIEVSQSCDTCDGSGAAPGTSERTCNLCHGQGSVRAKQGLFVVERPCPTCGGRGQVIEDPCGDCRGEGRVDKAQALQVDIPPGVDTGTRIRLSGKGEAGQRGAPPGDLYIFVHVKEHPLFEREGTTLATRVPISFTTAALGGSVDIPDLDGSTNTVDIPVGIQSGKQLRVRGAGMPVLQGRGRGDLVVEVKVETPTKLSRKQREILEQFRDTETGEECPESRSFFSKIKEAFGG

SEQ ID NO: 14733 - protein, 434 aa, Burkholderia pseudomallei
MSSQSQSPSVAQSIPSYLHADDLGPWGNYLQQVDRVAPYLGSLSRWIETLKRPKRILIVDVPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQIMAWMMDTYSMNQGQTATGVVTGKPISLGGSLGRKEATGRGVFVVGCEAAKKKGLEIEGARIAVQGFGNVGGIAAKLFQEAGAKVIAVQDHTGTIHQPAGVDTVKLLEHVGRTGGVAGFEGAEPMPNDEFWTVETDILIPAALENQITEKNASKIRTKIIVEGANGPTTTAADDILSANGVLVIPDVIANAGGVTVSYFEWVQDFSSFFWTEDEINHRLERVMREAFAGVWAVAEEHNVSVRTAAFIVACKRILMAREMRGLYP

SEQ ID NO: 14734 - protein, 379 aa, Brassica napus
  misc_feature (151)..(151): Xaa can be any naturally occurring amino acid
MALSTPLSQMSVALPIGIDGSSGSMIKVQSVSFTEKSCVPLLRLDTVSRKLSLKKRSTVCMSLQQQARRSKVSVTPLELEDPKETPLNLYRPKEPYTAKIVSVDRIVGPQAPGETCHIVIDHDGKVPYWEGQSYGVIPPGENPKKPGAPHXNVRLYSIASTRYGDSFDGKTASLCVRRAQYYDPETGKEDPSKAGVCSNFLCNAKPGDKVQITGPSGKVMLLPEEDPKATHIMIATGTGVAPFRGYLRRMFMEDVPTFKFDGLAWLFLGVANSDSLLYDEEFSSYLKDYPENFRYDKALSREEKNKKGGKMYVQDKIEEYSDEIFKLLDDGAHIYFCGLKGMMPGIQDTLKRVAEERGESWEQKLSQLRKNKQWHVEVY

SEQ ID NO: 14735 - protein, 1307 aa, Magnaporthe grisea
MADAATLAAVAAIVENIATNSGAPGKNASFRSSTYVQLPGPESDEKKQLERELAALVIRVQQLETRANAAPATIFPDTPNETAHSLFGDDSSSPTSSSSGREPKRLKSASSTTRNGFTTDGRPSKLNAITDEELEGLREHVDGQSRLLDSQRAELDGVNAQLLEQKQLQERALAIIEQERVATLERELWKHQKANEAFQKALREIGSIVTAAARGDLSKRVKINPIEMDPEITTFKRTMNAMMDQLGVFSSEVSRVAREVGTEGILGGQAQIEGVDGTWKELTDNVNVMAQNLTDQVREIASVTTAVAHGDLTQKIESAAKGEILQLQQTINTMVDQLRTFASEVTRVARDVGTEGMLGGQADVEGVKGMWNELTVNVNAMANNLTTQVRDIINVTTAVAKGDLTQKVQAECRGEIFELKNTINSMVDQLQQFAREVTKIAREVGTEGRLGGQATVHDVQGTWRDLTENVNGMAMNLTTQVREIANVTSAVAAGDLSKKIRVEVKGEILDLKNTINTMVDRLGTFAFEVSKVARAVGTDGTLGGQAQVENVEGKWKDLTENVNTMASNLTSQVRGISTVTQAIANGDMSRKIDVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKRKINQMVYNLRDSIQRNTQAREAAELANKTKSEFLANMSHEIRTPMNGIIGMTQLTLDTDLTQYQREMLNIVNNLAMSLLTIIDDILDLSKIEAKRMVIEEIPYTLRGTVFNALKTLAVKANDKFLDLTYRVDSSVPDHVIGDSFRLRQIILNLVGNAIKFTEHGEVSLTIQKGNDVTCLPNEYMIEFVVSDTGIGIPTDKLGLIFDTFQQADGSMTRKFGGTGLGLSISKRLVNLMGGDVWVKSQYGKGSSFYFTCRVRLADVDISLIRKQLKPYKGHQVLFIDKGKTGHGPEVGQMLGQLGLVPIVLESEQNHTLTRVRGKECPYDVIVVDSIDTARRLRGIDDFKYLPIVLLAPTVHVSLKSCLDLGITSYMTMPCKLIDLGNGMVPALENRATPSLSDNTKSFEILLAEDNTVNQRLAVKILEKYNHVVTVVSNGAEALEAVKDNKYDVILMDVQMPVMGGFEATAKIREYERSLGTQRTPIIALTAHAMMGDREKCIEAQMDEYLSKPLQQNHLIQTILKCATLGGALLEQNRERELELARHAEHKGGLSTDPARASSVMRPPLHHRPVTTAESLSGGAESPSLMANDGEDPIQRARSSLSEPGCL

SEQ ID NO: 14736 - protein, 86 aa, Glycine max
IITTTEFKYNNHENLKNQLPHHTFSTVCKCKDIAHNYKQHVQYFDNILDRISTLFLLNTRNNNFIVSCDPINPTYFNILWSSNTSL

SEQ ID NO: 14737 - protein, 949 aa, Deinococcus radiodurans
MTKSLSDLLQTNDFTRRHIGPSEAEQAEMLGVLGVSSLDELTQTTLPAAIQFDGELHTGPGMTEAQALAELKAVAQKNKVFRSYIGMGYAGTDVPPVILRNMLENPGWYTAYTPYQAEISQGRLEMLLNFQQTVQDMTGMPVSNASLLDEATAAAEAMTLAKRQSKNKGSNVFFVADNVHPQTMDVVKTRAEYFGFEVQTGSADAIPEGAFGALVQYPGTHGEVLNLAPIAEKAHTQGAALIVATDLLACALLTPPGEQGADIVVGSAQRFGVPMGFGGPHAAFLACQKGFERSMPGRVIGVSKDVRGNTALRMAMQTREQHIRREKATSNICTAQALLANMAAAYAVWHGPEGIKTIAERVHRLTGILAKALQDAGIKANETFFDTLTFEGQDDLGARAEAKGINFRLDGGKVGISLDETVTPQDLADIIEVVTGKGVDVQKLDAEAVDGIPAPLKRQSDFLTHPVFNTHHSEHGMLRYLKQLENKDYSLTHGMIPLGSCTMKLNATTEMIPVTWPEFGGLHPFAPESQTQGYAEMLAELERWLADITGYDAVSMQPNSGAQGEYAGLLVIRKYHEARGEAHRNICLIPASAHGTNPASAAMMGMQVVVVKTDEQGNIDFDDLKAQAEAHSDHLAALMITYPSTHGVYEENVRDVCDLIHQHGGQVYLDGANMNAMVGVAKPGLIGGDVSHLNLHKTFAIPHGGGGPGMGPIGVKAHLAPFLPNHAVAPTSDSHTGAVSAAPYGSASILPISYLYIKLLGAAGLRQSTQVALLNANYIAKRLSGAFPVLYSGKGGRVAHECILDIRPLKQESGVSEEDIAKRLMDYGFHAPTMSFPVPGTLMIEPTESEPKAELDRFVDAMLNIRREIQDVQDGTISAADSPLKHAPHTLKDLMDSEWTRAYSRETGAFPSAAQKAWKYWPAVNRVDNVYGDRNFVCSCPPIEDYIGA

SEQ ID NO: 14738 - protein, 447 aa, Unknown
  Candidatus Kuenenia stuttgartiensis
MKKLLLVSPLASKSFLGGDFYFRLPYLGLLKVASLTPSDWDVSIIDEKVEPLDLKLDADLVGITAMTPAVNRAYEIADSFRSRGIRVIMGGMHVSKMPDEALQHCDSVIIGEAEQLWDKALDDCKRDELKSIYRHGNEYPSLANFPAPNWKLYEGKRYLPVHFLETTRGCPHNCEFCSVTNSFGGKFRNRPVDEVEKEIQNLKPFEGMFVLKNGVFFVDDNIISNRVHAKELLKRIIPYNLKWTGQASVNIAKNDEILDLCKKSGCMGLIVGFESLSQGNLANMGKTFNTPDTYIDVVKKLHDYGIGVTGAFVFGFDHDDESVFDRTIEFVIKAKIDVCYFSILTPYPGTRVYSQMLHEGRIIDRDWSNYNTNHVVFMPKLMRPEKLLDGFHHALKESFSYTAIFKRLWGNGTYKNFFYPMNFGFRQTVRKTIQNKQDFSYEQGSGS

SEQ ID NO: 14739 - protein, 417 aa, Acinetobacter radioresistens
MFANISIAEFDPELAQAITNEDARQEAHIELIASENYCSPAVMEAQGSKLTNKYAEGYPGKRYYGGCEYVDIIEQLAIDRAKELFGADYANVQPHAGSQANSAVYLALLNPGDTVLGMSLAHGGHLTHGAKVSFSGKTYNAIQYGLNPETGEIDYEEVERLALEHKPRMIVAGFSAYSQIVDWQRFRDIADKIGAYLFVDMAHVAGLVAAGVYPNPVQIADVTTTTTHKTLRGPRSGLILAKANEEIEKKLQSAVFPGNQGGPLVHAVAAKAICFKEAMAPEYKAYQQQVVKNAQAMAEVLIERGYDVVSGGTKNHLFLLSLIKQDITGKDADAWLGAAHITVNKNSVPNDPRSPFVTSGIRIGTPAVTTRGFGEAEVRDLASWIADILDSKGDEAVINTVKAKVEAVCAKFPVYAK

SEQ ID NO: 14740 - protein, 720 aa, Dehalococcoides ethenogenes
MITANSFERTIGGRKLTIESGKMARLADAAVTIRYADTELLVTLCAAKKPREGVDFLPLTIDYEERMYAAGKIPGGFIRREGRPSEQAILAGRLTDRPLRPLLPKEWRNELQIIITVIASDKENDADIWGVVGASTVLTMSQIPYEGPVGASRVGYTNGEFVLNPTFAQLEQSQMDLVVVSTRKAVVMIEAGSKEIPEDLMIKAIEFAHQANQELIDLQDEIRAKLGKEKLPVPVLEIPEEVKAAVAAFVKGRVNEALSHQDKTLRENAVEALQSELVEALAETYAEGDILAAYDKEIKKAIRSTILEKDIRVNGRGIKQLRQLDAETGILPRVHGSALFTRGDTQVMAITTLGSLQEAQQLDGLSAEDTKRFMLHYNFAPFSTGEVKRSGSPGRREIGHGALAERALVPVLPTPEEFPYTIRMVADVVGSSGSTSMGSVCSSSLSLMDAGVPVKKAVAGISIGLITGENDTYCTITDIEGIEDNYGDMDFKVAGTRDGITAIQVDMKVKGISFDVIRDAIYQAKEARYTILEVMDKALAQPKTELSPYAPRMYKISIDPSKIGSVIGSGGKTIRSIIEQTNTTVDIENDGTVVIGATDEASAQKAIKIIEDLTKDVEAGSVYTGKVTRIMTFGAFVEILPGKEGMVHISELADHRVEKVEDVVKVGDEITVKVTEIDSQGRINLSRRVILNPNAVPISRNRDSQPRRSGPFRPQDRSNS

SEQ ID NO: 14741 - protein, 131 aa, Magnetospirillum magnetotacticum
MVVFFLLVGLEIKREALDGQLRTWPARVLPGLAAGAGMALPALVYLAFNAGQVTARGWAIPTAPTSPSTSASGPSRPRVPVSLKIFLSAVAIVDDLGAVVVIALFYAREIEAVMSDPRRLIRLILCLNASG

SEQ ID NO: 14742 - protein, 1417 aa, Yarrowia lipolytica
MGEFHINLIPTYDDAHNLTDDLQSVSSSPYSVTVPKNRLRSRSDLSEVADRSVSTGALERLVPNPNKIRVDRRVVSDTNGDSNANSGPSLTHHLSHANLNTYNNNSSTNNLQTPQKLKSSVSYSSLHRTPNNNNFDTSFQSLQSEQSFHTAPSPDGVLSSSPNETRLKFQKSRDILRQGAPSPLNLTPGNRSVNATSPHPPTPSAYLFENDSSHKNQEQPSKQSPIQYSSPHPIGNAISWKADEPNNWTLDRVLMFLDLYQFGPDWAQTFTERNIVEGRFLELVSYQKLKALGHLSLNNGEVDTSPSRFIHILRKTLNRGTSSGTIDVDALNSSQSSDGTTGRHAATSSPQAFTSPQMGSPVISQNSPVPHHSPAPSEPPPPPPPPTNSAPPPPASNSAPPPPTSTPSAVQAKAHIPNSPSTSSLTSPLVPTTSAPADKITPRPLKTNRPQRPMTAYEGLYRTMKSPVSPSGNFFRRTHHKSSSSESSILGEDGLPKEEERKSRNLFSRLRRRDRSSSKNRNSTIPPSPVDHDGAASLYSNESKDKTSSPTLTSSSGWAPPKPPKVPIPNPTYNPPPLPPRSGSQQTPTSASTHHSSLSGFSVNSQPAPSTPLDRYFTITQNDRMILVTLDNVHFVAADLKNVLSVPQATDVIAKALGLNTHDLRFRLTDVGSEASEKLDEEALSYFFSDNKVMLSNYKLLVESASPSATLAPAVAAQTSSSVTSSPGKSIYSLETPSGGTKYPATPSYLYTKTQEPPGDYFSSQPPSKPTRQPSQSSIQTASDDQDSFKVIRPPPKKEINFDNRRSSPYDTLSRNTSFVARREAPRRPESSSSVRVRSTAVNSYTPGESEKFIPRPYHGGSNRLVMRKPVSAASSPVDQQSNDPTAATTAVSAAPQPSRLNPKLSGNFTFGRSGLKFKVPNYQDKLQRRSTSSSVRVAPEQNFQENDISFDDIQFDDDDDESDDGLWSKKLTKPTEAVSSTVSSTRSSTSSSSDVWAVRPPAEVVYDNLERFFPNADLDKPIIDDVESPPTSPDKRETLDYVKPRSMIIDQSQNDRKATITPLTSKIKEEGTLEKEEKTPAAKFSRKTGTSRIKSIRVVAREASEARKRFSTSSTKSTMTNPALLRRRSTKMWGQKVVEATPNQIKKGHISTVRDQRGHLKKFVWVKGELIGVGTFGKVYLALNATTGDMMAVKQVEVRNKAAAEVGVGALHAEVGTMKNLDHFNIVQYLGFETMQDHTYNLFLEYVPGGSVGSCLRNHGRFEENIVRFLTRQILEGLAYLHGCGILHRDLKSDNLLLDLDGVCKISDFGISKKSRDIYSNDAEMSMQGTIFWMAPEVIHNVIHNEKQGYSAKVDIWSLGCVVLEMFAGRRPWSNDEAIGAMYKLGNSRLAPPIPEDTKTFVSEDAKDFLDKCFIM

SEQ ID NO: 14743 - protein, 387 aa, Saccharomycopsis fibuligera
MSGAAQRLSQISGILNPGTTSENTILIVPEKPFKISVIGSGNWGTTIAKVIAESTGENPELFQKDVHMWVFQEKIDGRNLTDIINTEHENVEYLPEVKLPENVIAEPDITKTVEGSDLIVFNIPHQFLGNVCRQLKGHVPTTARAVSCLKGLDVTPQGCKLLSSYITENLGIYCGALSGANLAPEVARQKWSETTVAYNEPADFRGQGKDIDKAILKKVFHRPYFHVRVVGDVPGVSLAGALKNVVAMAAGFVEGLGWGDNAKSAIMRIGLVEIIKFAQKYFPESDPKTFTEESAGVADLITTCSGGRNVRVGKYMAETGKDAAEAEKVLLNGQSSQGIVTTKEVHDLLANDNATQDFPLFEATYQIIYNGLPMGKLPSLLESAGDN

SEQ ID NO: 14744 - protein, 296 aa, Unknown
  Magnetococcus sp. MC-1
MATLESLIGNTPLVDLDRVVKGCVEGVKLLAKVEGNNPGGSVKDRAAYGMFMGAEQRGVLNRETRIFEATSGNTGIALAMMAARRGYQLTLVMPETMTLERRATMAAYGADFLLVTAEQGMEGAIDLVNAKVANGEGIKLDQFSNADNWGAHYRTTGPEIWRDTQGQITHFVSAMGTTGTIMGVSRALKERNPQIQIIGVQPDEGSQIAGIRRWPQAYMPKIFEPSRVDTILDVNTAEAREMTRRLARDEGLFCGLSAGGAVAAALKVCQGLSQPGTVVVIIPDRGDRYLSTDLFL

SEQ ID NO: 14745 - protein, 950 aa, Neisseria meningitidis
MKLSELFNPNEFAARHLSFGDEAALLAAVDEKSMDEFVGNTVPQSIRMPSELDLPEALTEADALAKLKGIASKNMINKSYIGLGYYPTRVPNVILRNVLENPGWYTAYTPYQAEIAQGRLEALLNFQQVCIDLTGFPVAGASLLDEATAAAEAMAMAHRVGKVKSERFFVDERVYPQTLDVMKTRAKYFGFELVVGDFAQADEGEYFGALFQYVGKDGDVQDLQDVIGRLKAKGTIVAVAADIMSLVLLKSPAELGADIALGNTQRFGVPMGFGGPHAAYFAFKDEFKRSAPGRIIGVSKDASGKPALRMALSTREQHIRREKATSNICTAQALLANLAGMYAVYHGPKGVKRIADRIHALASAFADALVSDGLNVVHKVFFDTVTVDFGNKEKADQVFAAALESGYNLRRVNDTQVAAAFHETSACEDLVDLYRAFTGKDTFAFADDVKGRLNAELLRQDDILQHPVFNSYHTEHEMLRYLKKLEDRDLAMNRSMISLGSCTMKLNATAEMLPITWAEFSDIHPYAPEAQTAGYRELLADMENSLKAITGFDAISLQPNSGAQGEYTGMLSIRRYQEAQGEAHRNICLIPKSAHGTNPATAAMLGLKVVVVDTDEHGNVNIDDLKAKAEQHRDALSAIMITYPSTHGVYEEGIRDICRIIHENGGQVYMDGANLNAQIGIMQPAEVGADVLHMNLHKTFCIPHGGGGPGMGPIGLKAHLAPFAPGHTLTDTHSASAGQTAVAAAAYGSASILPITWMYLTMMGKQGMEQATRWALLNANYVAKRLSEDYPILYTGKNGRVAHECIVDLRPLKAESGITETDIAKRLMDYGFHAPTVSFPVAGTLMIEPTESESKAELDRFIATLKSIRREVQKVIDGEWPKDDNPLVNAPHTAADITGNWAHPYSREEAVFPLPFVREHKFWPFVNRVDDVYGDRNLVCSCPPMENYED

SEQ ID NO: 14746 - protein, 622 aa, Burkholderia pseudomallei
MCGITGWIDFARDLRNEAPIVDTMTDTLARRGPDARGVWLDTHAALGHRRLSIIDPERGAQPMLTPERGPRGLPRAVISYAGETYNFRELRAELGALGHRFDTHCDTEVVLRAYLEWGAAFVDRLNGMYSIAIWDTARDELLLVRDRLGVKPLFYYPTADGVIFGSEPKAILAHPDVRARTSSEGLCDALLFLRTPGQVPFSGMREVKPGHVLRVRRGGLAEQRYWALEARPHTDDLPTTIATIRALLDDIVSRQMISDVPLCALLSGGVDSSTIAALAQKRRRASGGGALSTFCVDFTGHTRNFRADPIRPTADAPFALEVARHIGSDHHTIELDQAGLLDPQVREAVLRAWDLPFNFADLDVSLHRLFAEVRKHATVALSGEAADEIFGGYLWFSDPAARRAHTFPWLKLGAHRGLDPRALFHRSFIDALRLGEYEAQLYRAALAEVPRLDGENAEDRRTRELHYLTLTRWLPVLLDKKDRMGMASGLEGRVPFCDHRLVEYVFNIPWAMKTFSGQEKALLRAAAADLLPESVLNRKKAAYPSIQAPGYDRGLIERLNRAIAAGRAPLEPFIDAGALRGLTEKTAAGSLSEFERILLESSSRLNDWLDLYRVELDGVPAG

SEQ ID NO: 14747 - protein, 284 aa, Symbiobacterium thermophilum
MNRGDWLIEEQTPSYQTRWRVREVLHEEQTPYQKLQVLELEDFGRALVLDDAVQTTVGDEFIYHEMIAHVPLFTHPHPERVLIIGGGDGGTAREVCRHESVQKVDMVEIDRAVIEACRKHLPEIACGMDHPKVNLVVGDGIAWVADHADEYDVIIVDSSDPVGPAKGLFNQAFYKNVFRALKADGLFVCQVLSPFFHQSLIRDVYGVVSAIFPITMPYLAVVPTYPSGLHCFMLGSKRHSPLREGVRTPAWPTRWYTPAVHRAAFQLPPVVAQLLEPSGSQAGQ

SEQ ID NO: 14748 - protein, 948 aa, Unknown
  Mycobacterium sp. MCS
MLDSHQPRFADRHIGPDSDAVAVMLDTIGVATLDDLAAKALPANILDALSADGVAPGLECLPAPASETEALAELRALAESNTVAVSMIGQGYFDTLTPPVLRRNILENPAWYTAYTPYQPEISQGRLEALLNFQTMVSDLTGLEVANASMLDEATAAAEAMTLMQRAGRSKSNRLAVDADLYRQTAAVLATRARPLGIEIVTADLRHGLPEGDFFGVIVQLPGASGALVDWAPLVADAHDRGALVAVGADLLALTLVTPPGEFGADVSFGSTQRFGVPMGFGGPHAGYLAVHTKHARQLPGRLVGVSVDADGSPAYRLALQTREQHIRRDKATSNICTAQVLLAVIAAMYASYHGAEGLTSIARRVHGHARAVATGLAEAGVDVVHDAFFDTVLVKVPGRAAEIRDAAKSHGINIWLVDADHVSVSCDEATTADHVAAVLSAFGATRGGKPFAGPEIATRTSAFLTHPAFTRYRTETEMMRYLRSLADKDIALDRSMIPLGSCTMKLNAAAEMEPITWPEFARQHPFGPESDAPGLRRLIADLQTWLTGITGYDEISLQPNAGSQGEYAGLLAIKAFHDANGAPERDVCLIPSSAHGTNAASAALAGMRVVVVGCRPNGDVDLDDLRAKVTENAERLAALMITYPSTHGVYEHDVAEICAAVHDAGGQVYVDGANLNALVGLARPGRFGGDVSHLNLHKTFCIPHGGGGPGVGPVAVRAHLAPYLPGHPLADELGDDYTVSAAPYGSASILPITWMYIRMMGAPGLRAASLTAIASANYVARRLDEYYPVLYTGENGMVAHECILDLRTITKQTGVTVDDVAKRLADFGFHAPTMSFPVAGTLMVEPTESESLSEVDAFCEAMIAIRAEIDQVGSGAWPVDDNPLRGAPHTAESLLVTEWEHPYTREQAAYPLGKGFRPKVWPPVRRIDGAYGDRNLMCSCPPVEAFA

SEQ ID NO: 14749 - protein, 415 aa, Bacillus subtilis
MSEVLQKAALAKEAAAEMVMKTTAEKNEALQCIADGLRNERQLILTENQKDIEAGQKRGLTPDIIDRLTLDEKRLLDIADAVELLIGLEDPVGESLETIQKENGLSIEKIRVPLGVVGMIYEARPNVTVDAATLCLKTGNAVVLRGSSSAIHSNKALVSVMKRALGLSKLPIDAVQLIEDTSKETAKQLFTLNDGLDVLIPRGGKNLIDLVVRESTVPVLETGAGNCHVYIDESADPDMARDVVINAKTQRPSVCNAIESLLIHEKWAEVHGRKLLNQLTEKGVELRGDQMICELEPNAKQAEEADWGAEYLAPILSVKTVHDVQEAVRHIQQYGTNHSEAILTENGEHAAYFQTAVDAAAVYHNASTRFTDGFEFGYGAEIGISTQKLHARGPMGLPALTSTKIIIKGNGRIRV

SEQ ID NO: 14750 - protein, 229 aa, Brassica napus
  misc_feature (206)..(206): Xaa can be any naturally occurring amino acid
MSSLQDAKNGAVLETQSSSSTVVVHSGEPSALRKIISVSSIAAGVQFGWALQLSLLTPYVQLLGIPHKWSSLIWLCGPISGMLVQPTVGYYSDRCTSRFGRRRPFIASGAVLVAVAGLLIGYAADLGKLAGDKLDETVKVRAIWFFALGFWILDVANNTLQGPCRAFLADLAAGDARKTRTANAFFSFFMAVGNILGYAAGSYTNXLHKMFPFTMTKACDVYCANLKSC

SEQ ID NO: 14751 - protein, 111 aa, Oryza sativa
MCGIFACHRHPDVEKFKPTALKLAKQIRHRGPDWSGSVIANHTILCHERLSIVGVESGAQPLTNADDSIILAVNGEIYNHRHIRKNLKEQYHFKTTSDCEVIIPLYTEFDT

SEQ ID NO: 14752 - protein, 628 aa, Rumex palustris
MNTCDCVDTQWFADDLLIKSQYISDLFIVLAYFSIPLELIYFVQKSALFPYRWVLIQFGAFIVLCGTTHLINLFTFSMHSKTLAVVMAIAKMSTAAVSCITALMLVHIIPDLLSVKMRESILRRRADELDREMGLILSQEETGRHVRMLTHEIRSTLDRHTILKTTLVELGRTLGLEECSLWMPSQTGMTLKLSHALQNLTPVGSCVSLNLPVITEIFNNPGVVRISHTCPLVSTRPISGRYLAPEVAAIRVPLLNLSNFQINDWPDVSGRTYAVMVLVLPCDGLRKFRKHELELIEVVADQVAVALSHAAILEESMRAHDQLLEKNVALDLARQEAELAIRARNDFLAVMNHEMRSAMHAIITLSSFLLETELTPEQRVMIEIILRSSNILATLINDVLDLSRLEDGSLELDSLTFNLHAVFKKVINLLKPITCVKKLSLTLAVAPEAICVVGDEKRLVQTILNVVGNAVKFTKVGKISIIVSVAKPDSLSSWQPADVIYAAVSKGQFYLRVQVKDTGCGINPQEIPHIFDKFYQSQNCRRNSTDSGLGLAICKRFVNLMGGQIWVESEGLDKGSLVTFVVKMGICRNPDERSINQAASTGHMNQSSTDLLGDSSMSFSLKRFEKSC

SEQ ID NO: 14753 - protein, 521 aa, Pseudomonas aeruginosa
MLDANLKTQLKAYLEKVSQPFEIVASLDDSDKSRELLGLLQDIVGLTDKITLKTDGSDARKPSFSLNRPGADIGLRFAGIPMGHEFTSLVLALLQVGGHPSKLDADVIEQVKGIEGTFEFETYFSLSCQNCPDVVQALNLMAVLNPNIRHVAIDGALFQDEVEARQIMSVPSIYLNGEVFGQGRMGVEEILAKIDTGAAARDAEKLTARDAFDVLVVGGGPAGAAAAIYAARKGIRTGVAAERFGGQVLDTMAIENFISVQETDGPKLARALEEHVRHYEVDIMNLQRASKLVPAKNTGELHEVQFESGGSLKAKTLILATGARWREMGVPGEQEYKAKGVCFCPHCDGPLFKGKRVAVIGGGNSGVEAAIDLAGIVAHVTLLEFDSKLRADAVLQRKLYSLPNVEVITSALTSEVKGDGQKVTGLVYKDRNSEEFKSIELEGIFVQIGLLPNTEWLKGSVELSPRGEIIVDARGETSLPGIFAAGDVTTVPYKQIVIAVGEGAKASLSAFDHLIRTSAPE

SEQ ID NO: 14754 - protein, 481 aa, Oryza sativa
MEADAGKLFIGGISWDTNEDRLREYFDKYGEVVEAVIMRDRATGRARGFGFIVFADPAVAERVIMEKHMIDGRMIHDDDDGVLDPSMVVEAKKAVPRDDQHALSKSGGSAHGSPGPSRTKKIFVGGLASTVTEADFRKYFEQFGTITDVVVMYDHNTQRPRGFGFITYDSEDAVDKALFKTFHELNGKMVEVKRAVPKELSPGPSMRSPVGGFNYAVNRANNFLNGYTQGYNPSPVGGYGMRMDARFGLLSGGRSSYPSFGGGYGVGMNFDPGMNPAIGGSSSFNNSLQYGRQLNPYYSGNSGRYNSNVSYGGVNDSTGSVFNSLARNLWGNSGLSYSSNSASSNSFMSSANGGLGGIGNNNVNWGNPPVPAQGANAGPGYGSGNFGYGSSETNFGLGTNAYGRNAGSGVVNTFNQSTNGYGRNFGDSSGGGGGGGGGSIYGDTTWRSGSSELDGTSPFGYGLGNAASDVTAKNSAGYMGH

SEQ ID NO: 14755 - protein, 528 aa, Streptococcus thermophilus
MKFTDLNLSEDIQSAVVAAGFEQPSPIQELTIPLALEGKDVIGQAQTGTGKTAAFGLPTLDKIHTEENTIQALVIAPTRELAVQSQEELFRFGRDKGVKVRSVYGGSSIEKQIKALRSGAHIVVGTPGRLLDLIKRKALKLNNIETLILDEADEMLNMGFLEDIEAIISRVPEERQTLLFSATMPDAIKRIGVQFMKDPEHVKIKAKELTNVNVDQYFIRVKEQEKFDTMTRLMDVDQPELSIVFGRTKRRVDELTRGLKLRGFRAEGIHGDLDQNKRLRIIRDFKNGQIDILVATDVAARGLDISGVTHVYNYDIPQDPESYVHRIGRTGRAGQSGQSITFVSPNEMGYLGIIENLTKKRMKGLKPPTAQEAFQSKKKVALKKIERDFADEAIHANFDKFKDDAVKLAQEFTPEELALYILSLTVQDPETMPEVEIAREKPLPFKPSGGGFGGKGGKGGRGNRGRDNNRRGGYRGDRNRDDRDGGRRDFKRKSKNNSRDFENRGNKRPHRASSEKKNGFVIRNKGDK

SEQ ID NO: 14756 - protein, 287 aa, Triticum aestivum
  misc_feature (80)..(80): Xaa can be any naturally occurring amino acid
MASSVAAAASTFLGTRLADPAPQNGRIVARFGFGKKKAPPKKAKAPPTTDRPLWFPGAQAPEYLDGTLVGDYGFDPFGLXGKPAEYLQYDVDSLDQNLAQNLAGEIIGTRFEDADVKSTPFQPYAEVFGLQRFRECELIHGRWAMLATLGALTVEWLTGVTWQDAGKVELVDGSSYLGQPLPFTLTTLIWIEVLVIGYIEFQRNAELDPERRLYPGGSYFDPLGLAADPVKKETLQLAEIKHARLAMVAFLGFAVQAAATGKGPLNNWATHLSDPLHTTIFDTLGSS

SEQ ID NO: 14757 - protein, 140 aa, Picea glauca
VEDGSGGETDFQEVDRHAVEDRELKDHLLRRYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 14758 - protein, 544 aa, Unknown
  marine gamma proteobacterium HTCC2143
MHAKIEKNKNETAAATDFDAVVVGAGFAGMYMLHRLRELGLRARVLEAGDGVGGTWYWNRYPGARCDVESMEYSYQFSEELQQDWEWSQRYSPQPEILAYANHVADRFDLRDDIQFNTRVESAHYDESSRSWNVKTLSGESLTSRFCIMATGCLSSANTPDFKGLDDFQGVNYHTGNWPHEGVDFTGLRVGVIGSGSSAIQSIPIIASQASTLNVFQRTPNYSVPAKNRSLEQQERQLIKSQYREFREQNKTMPGGFGVGHAREDAGSALDLTAEQREARYEEYWELGGLLFLGAFEDTGVDINANKTAAEFVRTKIRDIVDDPQTAELLCPDNTFGCKRLCADTQYFQTYNQPNVHLIDIKDAPIDHFTAAGVVTGGVEYELDAVVFATGFDAMTGALHRIDIRGKEALPLKEKWEAGPRTYLGLCTEAFPNLFTITGPGSPSVLTNMLPSIEQHVDWIADCIAYLDSEGLSAIEADIDAENDWVEHVNGLAEETLYPTCNSWYLGANVPGKPRVFMPHIGFPAYVEKCKEVVAAGYQGFRLS

SEQ ID NO: 14759 - protein, 153 aa, Arabidopsis thaliana
GSGFPGRTTRVQEEVRASFMFSFAVGVTSPVKATMVVQLTGWKQSVFFRVTRKANNTFTSITGIGGGVSCLKVGPPIGRKKLGTLFYLPDLTDVEWAKEVDYLLRTKGIPGVEFEWEHGFGSREPGTTPGSYIGRSWPMGKLPLFGCTDSVQG

SEQ ID NO: 14760 - protein, 618 aa, Gossypium hirsutum
MEQHIMWVFWFFLHWFCSVHSASDGDSLLSPKGVNYEVAALMSVKRELRDDKQVMDGWDINSVDPCTWNMVACSAEGFVISLEMASTGLSGMLSPSIGNLSHLRTMLLQNNQLSGPIPDEIGKLSELQTLDLSGNHFVGAIPSTLGSLTHLSYLRLSKNNLSGPIPRHVANLTGLSFLDLSYNNLSGPTPKILAKGYSITGNNFLCASSEHICTDVSYPLNGSVSSSRVSGNHHWLLSVAIGIGFAFVVSVMLLACWVHWYRSRIMLPSYVQQDYDFEIGHLKRFSYRELQIATGNFNPKNILGQGGYGVVYKGCLPNRSVVAVKRLKDPNFTGEVQFQTEVEMIGLALHRNLLRLYGFCMTPDERLLVYPYMPNGSVADRLRDACHGKPALNWSRRMHIALGAARGLLYLHEQCNPKIIHRDVKAANILLDESFEAVVGDFGLAKLLDKRDSHVTTAVRGTVGHIAPEYLSTGQSSEKTDVFGFGILLLELITGQKTLDAGNGQVQKGMILDWVRTLHEERRLEVLVDRDLQGCFDTIELETVTELALQCTRPQPHLRPKMSEVLKVLEGLVQSGTDEPQGGTNHCETSAYSFSRNYSDVHEESSFIIEAMELSGPR

SEQ ID NO: 14761 - protein, 708 aa, Parvularcula bermudensis
MFTITKKTTEWAGRPLTLETGRIARQADGAVLATYGETTVLATVVGQKEAKPGQDFFPLTVNYQEKTYAAGRIPGGFFKREGRPSEKETLTSRLIDRPIRPLFAPGFKNEVQVVCTVMSHDLENDPDVVAMIAASAALTISGIPFMGPIGAARVAYKDGEYLVNPTGADLEGSRLDLVMAGTADAVMMVESEADELSEDIMLGAVIKGHAAAKEMIDHIISFAEQCAKEPWDYQPPDFSDQKPRVEEAARSGLAAAYQQTDKTQRVAAIGEAKQAAYDALTGDDAADPMDPAVVATLLKQIESEIVRNAIIEGRPRIDGRDTKTVRPIESEVGILPRTHGSALFTRGETQAIVVATLGTADDEQFIDALEGTYKENFLLHYNFPPYSVGETGRMGSPGRREIGHGKLAWRAVRAVLPSQEEFPYVIRLVSEITESNGSSSMATVCGSSLAMMDAGVPLKRAVAGIAMGLILEGEQFAVLSDILGDEDHLGDMDFKVAGTSEGVTSLQMDIKVAGITEEIMQTALGQAKDGRMHILGEMNKALSASRGELGEFAPRIETMKIPVDKIRDVIGSGGKVIREIVEKTGAKINVEDDGTIKIASSEHSQIDAAVKWIRGLTDEPEVGEVYKGKVVKTVDFGAFVNFFGARDGLVHISQLNDGRPEKTTDVVKEGDEVFVKLLGFDDRGKVRLSMKVVDQETGKDLEQAGAAE

SEQ ID NO: 14762 - protein, 458 aa, Burkholderia pseudomallei
MNGRDGRECARGTRRARFPTIVFSPLDAACIASLTMDIDQYMTDVGRRARRASREIARASTAAKNAALEAVARAIGRDADALKAANARDVARAKDKGHDAAFVDRLTLSDKALKTMIEGLRQVATLADPIGEMSNLKYRPSGIQVGQMRVPLGVIGIIYESRPNVTIDAAALCLKSGNATILRGGSEALESNTALAKLIGEGLAAAGLSQDAVQVVGTADRAAVGKLITMTEYVDVIVPRGGKSLIERLINEARVPMIKHLDGICHVYVDDRASVAKALAVCDNAKTHRYGTCNTMETLLVARGIAPAVLTPLGRLYREKGVELRVDADARAVLEAAGVGPLVDATDEDWRTEYLAPVLAIKIVDGIDAAIEHINEYGSHHTDAIVTEDHDRAMRFLREVDSASVMVNASTRFADGFEFGLGAEIGISNDKLHARGPVGLEGLTSLKYVVLGHGEGRE

SEQ ID NO: 14763 - protein, 428 aa, Tropheryma whipplei
MNHGVYQNLFIDSLDSVDPQIAEVLDLELRRQRDFLEMIASENFVPRAILQAQGSVLTNKYAEGYPQNRYYGGCECVDLAEDLAISRVRDLFGSEFANVQPHSGSTANAAALMALTEVGSTIMGLELDHGGHLTHGMPLSFSGKHYKAVTYRLDPKTCLIDMDSVRDLALRHRPSVIIAGWSAYVRHLDFEAFRSIADEVGARLWVDMAHFAGLVAAGLYPSPIPWADVVTSTTHKTLAGPRGGFILAKKEFGKAINTAVFPGQQGGPLMHVIAAKAVAFKVAASEGFRERQRITIEAARTVAKRIGEDYRLRDRGIDILTGGTDVHMVLVDMRKSDMDGLTGQNLLHEVGVTVNRNSMPYDKRPPRITSGIRIGTPALVTRGLSLDEFDEVADIISNALLTIDLPKQKQRALRIARTHPVYEGLRQY

SEQ ID NO: 14764 - protein, 482 aa, Vibrio cholerae
MKGDIGVIGLAVMGQNLILNMNDHGFKVVAHNRTAAKVDEFLEGPAKGTNIVGAYTLQELVDKLATPRKVMLMVRAGQVVDDFIEQLVPLLDKGDIIIDGGNTNFPDTNRRVKALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEALVEKILDTAGQKGTGKWTGINALDMGIPLTLITESVFSRCLSALKDQRVEAEKLFGKTKTQVEGDKQVWVDALRQALLASKIISYAQGFMLMREASNENGWNLNYGNVALMWRGGCIIRSAFLGNIRDAFEKNPELAFLGSDAYFKGILDNCLAAWRKVAAKSLEVGIPMPCTTSALTFLDGYTTARLPANLLQAQRDYFGAHTYERIDRPRGEFFHTNWTGTGGNTASTTYDV

SEQ ID NO: 14765 - protein, 463 aa, Alkaliphilus metalliredigenes
MKTVSVKEIYRQTEQYAGQSIRVEGWIRTLRASKAFGFIELNDGTFFKNIQIVFDEDLHNFSDVSKFTISSAIIIEGTLEITPGAKQPFEIKATNVELEAHSHKDYPLQKKRHTFEYLRQIAHLRPRSNAFSAVFRVRSIAAFAIHQFFQEKGFVYTHTPIVTGSDAEGAGEMFRVSTLDFKNIPLDEEQQVDFKKDFFGKETSLTVSGQLAAEAYALAFKKVYTFGPTFRAENSNTARHASEFWMIEPEIAFADLQDNMELAEDMLKYMIRYVMEQAPEELEFFNQFVDKGLIDRLNHVANSEFGKVTYTEAVKMLQESGEEFEYPVEWGHDLQTEHERYLTEKVFKKPVFVMDYPKDIKAFYMRMNDDNKTVAAMDLLVPGIGEIIGGSQREERLDVLTDRMKQMGLDEEEYWWYLELRKYGGVKHAGYGLGFERAIMYLTGMANIRDVISYPRTPKSAEF

SEQ ID NO: 14766 - protein, 712 aa, Herbaspirillum seropedicae
MFNKVTKTFQYGQHQVTLETGEIARQASGAVVVSVEDTVILATVVARKEAKPGQDFFPLTVDYIEKTYAAGRIPGGFFKREGKPSEKETLTSRLIDRPIRPLFPEGYLNEVQVIIHVLSVNPEIDPDIPAMIGASAALSLAGIPFNGPVGAARVGYIDGQYVLNPTTSQLKSSQLDLVVAGTETAVLMVESEADQLSEEVMLGAVVFGHDQSKAVIEAIHALVRDGGKPEVQWTAPAKNEALIARVSQLAEGPLREAYQTKDKQARTEKLKAVTAQVNEALVAEAAANNGVAADAAEVGSILFDLEAKIVRSQILEGEPRIDGRDTRTVRPISIRTGVLPRTHGSALFTRGETQALVIATLGTARDGQVIDAVAGEYKENFLFHYNFPPFSVGECGRMMGPKRREIGHGRLAKRGVLAVMPSLEAFPYTIRLVSEITESNGSSSMASVCGSSLALMDAGVPMKAHVAGIAMGLIKEGNKFAVLTDILGDEDHLGDMDFKVAGTANGITALQMDIKIQGITKEIMQVALEQAKEGRHHILGKMQEAVPAGRAELSDFAPRLITIKINPEKIRDVIGKGGAVIRALTEETGTQIDISDEGVVTIASVDASAGQEAKRRIEELTASVEVGKIYEGTVLKLLDFGAIVQVLPGKDGLLHISQIANERVNAVADYLKEGQQVRVKVLETDDRGRLKLSMKAAQAEEGGEAAAPQEAQ

SEQ ID NO: 14767 - protein, 444 aa, Deinococcus radiodurans
MPNPNALPGAAHLSGAGAAQTGSPMKTRIAGKTILAIVLAGGRGSRLSPLTDERAKPAVPFLGTYRLIDFTLSNLVHSGINDVWVIEQYLPHGLNDHLSGGRPWDLDRTRGGLVVMPPFASAENEEGEFAQGNAHALAQHAHLIREFGADLVLVLSADHVYRLDYSDVIRQHVERGASVTMVTTELADEQQATRFGNVRAAKNGKVSEFAYKPDEPLGKTVTAEVFVYDAHIMLSTLEALSKEGELGDYGEELLPALVARGDAHAFPMHGYWMDVGTLDAYLQTHRDFLDGKGFALDDPQWPFITSSISRPPTRIEKTARLDEALVCGGAVIAGEVVRSLIAPNAVVEAGAVVRDSVVQPGAVIRAGAQVSRAVVDQDAEVGPGSRVGGQTGNSRPTVVGAHAHLGPGVQVGPGQVVAPRTRVKAGEEGQKVQELDADDKAGKK

SEQ ID NO: 14768 - protein, 182 aa, Mycoplasma gallisepticum
MMSKLNYTIEKILITNEQINEAAIKAANWINQTYKDDEIILVGILKGCIPFIGKIIDKIECEMILDFMTLSSFKGETKSQGTPKIVMDLAYDVMDKNVLLVEDIIDSGNTIKIVLDLLKQRGAKSVRLLTFLDKPSGREVDVKADYVCFEVPHGFLVGFGLDYKDKLRNLPYVAHMVSNDKK

SEQ ID NO: 14769 - protein, 356 aa, Brassica napus
MSLLTDLVNLDLSDNTEKIIAEYIWVGGSGMDMRSKARTLPGPVTDPSKLPKWNYDGSSTGQAPGEDSEVILYPQAIFKDPFRRGNNILVMCDTYTPAGEPIPTNKRHAAAQIFSNPDVVAEVPWYGIEQEYTLLQKDVNWPVGWPIGGFPGPQGPYYCSVGADKSFGRDIVDAHYKACLYAGINISGINGEVMPGQWEFQVGPSVGISAADEVWIARFILERITEIAGVVVSFDPKPIPGDWNGAGAHTNYSTKSMREEGGYEIIKKAIDKLGLRHKEHISAYGEGNERRLTGHHETADINTFKWGVANRGASIRVGRDTEKEGKGYFEDRRPASNMDPYTVTSMIAETTLLWNP

SEQ ID NO: 14770 - protein, 432 aa, Deinococcus radiodurans [sequence omitted]

SEQ ID NO: 14771 - protein, 124 aa, Unknown
  Synechocystis sp. PCC 6803
MSTLYEKLGGTTAVDLAVDKFYERVLQDDRIKHFFADVDMAKQRAHQKAFLTYAFGGTDKYDGRYMREAHKELVENHGLNGEHFDAVAEDLLATLKEMGVPEDLIAEVAAVAGAPAHKRDVLNQ

SEQ ID NO: 14772 - protein, 1261 aa, Unknown
  Synechocystis sp. PCC 6803
MFWQPVSPLNADQLNYQGSYDPKLVLLSVAIAIFTAYMAFLMASSALSLPGRWSRKIALALSGTVMGLGIWAMHFIGMLGFELPCPISYDPLITFISVIPAIAASIYALNFLSFQAPTAKNLMVGAIWFGLGIGTMHYSGMAALELHGNIYYELPLFVLSLVIAVMLAFVALLFRFHSAKIFHTTHGPALGSSALVMGLSTSGMHYTAMTATHFICRPWGEFFIQGIDIQEVAIAVTISITLLTGGVMLFVLREISIQNQQQKILVATESWYRQIIEYAPEGIMVLDAQGNIILANTSIEKLFGYSQTELIGQSIALLGLAELLQQSLHLLQEGEDVGPTCPLDQEEFEILGTRYDGSEFPIEVSLTSLPSLSQREMNIFASVRDISARQEAQQQILRQREHLQSVLDSAPVGVAITVNGITQFANPHIGELVDLKVGDSPQKIYVDLGDRQQMLEELTQFGRSQSRVYKMYNPRGEIRDILATFLATDYEGQKGILGWLADITPIKAAEAEMKRAKELAEEASRIKADFLANMSHEIRTPMNAVIGMTHLALKTDLTPRQREYLHKIRFSGQHLLGVINDILDFSKIEAGKLPMESIDFDLDKVLDNVATLISEKATNKGLELLFDIDRNLPRHFIGDPLRLGQILINYANNAVKFTEQGDITIVVRLQEYRDQDVVLYLAVKDTGIGIKPEHIANLFNSFQQADSSTTRNFGGTGLGLAICKRIAELMGGEVGVESEYGQGSTFWAKVCLQKSNVIPHRLVLSKDLEGKRVLVVDDNDHARLVMKDLLEQMKFVVETVESGPEALNFLAEADRENHPHSIVFIDWQMPNMDGLEVARRLKAMGLNHQPSIFIVTAYGREELFVKAKSLGIDDVLVKPISPSVLFDSLARVLGDPTALAQEMRQSSGIGAEDLALEKLRRIRGARILLVEDNEINQEVAAELLRDVGFNVDVAANGLIALERLNNNAYALVLMDMQMPEMDGIEATIAIRQNPRYAQLPIVAMTANVMQGDRERCLQAGMNDHLGKPIEPEELWNKLLHWIPVDSPLAPETIEESAINTSDPEISIPHIPGLNSDDGLRRVLGKKSLYLKMLHKFVASQSSFLPEITQALGEKDYGFAERLAHTLKGVAGNIGAQELQQEAAELEKAIKEQWPQPEVENLLTNLGDRLDNLIAQLTSNLPPEPATVAITLDQGQLEEICDHLAQLLGEDDAEAADLLQNHGDLLRQAFPDHYSAIAAGINNFDFEAALAALTTARQFSQP

SEQ ID NO: 14773 - protein, 280 aa, Hibiscus trionum
GLPPSMAANGHRVMTVSPRYDQYKDAWDTSVVFKLKVGDKVETVRFSHCYKRGVDRVFVDHPMFLEKVWGKTASKIYGPRAGVDYKDNQLRFSLLCQAALLAPQVLNLNSSKYFSGPYGEDVVFIANDWHTALLPCYLKSMYQSRGIYMSAKVVFCIHNISYQGRFAFADFSLLNLPDRFKSSFDFIDGYNKPVKGRKINWMKAGTLESDRVMTVSPYYAQELVFGEDTGVELDSIICKTGITGIVNGMDVQEWNPATDKYTCVKYDATTVMDAKPLLKE

SEQ ID NO: 14774 - protein, 135 aa, Glycine max
  misc_feature (34)..(34): Xaa can be any naturally occurring amino acid
  misc_feature (60)..(60): Xaa can be any naturally occurring amino acid
DMAILPYKDSLLLFSRYLQQLVMESLGKVFDLDXYIQQLREGVHNFFVTFIEVLRDRPPXHDWELEPGVTCGDYLSGMLQGTRSALYANNRESITVTVQEVTPRTVGALIGLYERAVGIYASLVNINAYHQPGKI

SEQ ID NO: 14775 - protein, 549 aa, Leuconostoc mesenteroides
MTELGKHVVYQVYPKSFQDSNGDGVGDLPGIIQRLPYLAKLGVTMIWLNPVFPSPQNDNGYDISNYTAIDPLFGTMTDFENLVKEAKTYHMGIMLDMVFNHTSTDHTWFQKALAGDQKYQDYYYLRPYRDDGHEPTNWVSKFGGSAWAKFGDTNLAYLHLYDPTQADLNWHNPAVRQELYDVLNFWLAKGVRGFRFDVINVIGKSEVLVDDETDNGGKFLYTDTPIVQDYIQEMNAATFGKYPDVITVGELSSTTVQNTAAYTNPDNKALSMGFNFHHLKVDYDHGNKWTKVPYEFESLRHIWHEWSQGLMENHGWPAWFWNNHDQPRAINRFIKTPKYYRVGAKMLAMLVHLNRGTPYVYMGEEIGMIDPTYHKIETYVDVESKNAYQMLLKQGLTKQQAFEIVQTKSRDNSRVPMQWRNEDYAGFSTHEPWLQNANYEQINVAQDEKSADSLYAFYQNLIRLRQENEVIADGDYTPKYEESEEIIAFERQLAGKHILVVTHFGETPVSISISDEIVKNGQVLVTNYPAQPVSGTMLLKPYESFAIAY

SEQ ID NO: 14776 - protein, 1002 aa, Schizosaccharomyces pombe
MLMKQTFLYFLLTCVVSAQFNGYVPPEQNGGDIVVPKDFYEKFGEDFIREQEESSAPLMNPVPERDEAEAPHHPKGHHEFNDDFEDDTALEHPGFKDKLDSFLQPARDFLHTVSDRLDNIFDDDEDEHVREKRPHDSADEDAPRRKHGKCKGKGKHHKGKHAKGKGKKSHPKPEDDSVFFDDERPKHHEFDDEDREFPAHHEPGEHMPPPPMHHKPGEHMPPPPMHHEPGEHMPPPPMHHEPGEHMPPPPMHHEPGEHMPPPPMHHEPGEHMPPPPMHHEPGEHMPPPPMHHEPGEHMPPPPMHHEPGEHMPPPPMHHEPGEHMPPPPMHHEPGEHMPPPPFKHHELEEHEGPEHHRGPEDKEHHKGPKDKEHHKGPKDKEHHKGPKDKEHHKGPKDKEHHKGPKDKEHHKGPKDKEHHQGPKEKHNERPEQNMQSSHELLVIEAFADLINSVPVEEIAEEFSRFLDTLGIEYYGNIPVHIQENAPKDSSIPPLFEFDDDLELSDLTPEQFAYLEMLKAEGIDPMTAFRDQSHPAKPSNAQPADSSRPYAVFSQEENGEHVNLKAFPDHTLRVKDSKPESLGIDTVKQYTGYLDVEDDRHLFFWFFESRNDPENDPVVLWLNGGPGCSSLTGLFMELGPSSINIETLKPEYNPHSWNSNASVIFLDQPINTGFSNGDDSVLDTVTAGKDVYAFLNLFFAKFPQYAHLDFHIAGESYAGHYIPQFAKEIMEHNQGANFFVASGYEMEKQYINLKSVLIGNGLTDPLVQYYFYGKMACESPYGPIMSQEECDRITGAYDTCAKLITGCYQTGFTPVCIGASLYCNNAMIGPFTKTGLNIYDIREECRDQEHLCYPETGAIESYLNQEFVQEALGVEYDYKGCNTEVNIGFLFKGDWMRKTFRDDVTAILEAGLPVLIYAGDADYICNYMGNEAWTDALEWAGQREFYEAELKPWSPNGKEAGRGKSFKNFGYLRLYEAGHMVPFNQPEASLEMLNSWIDGSLFA

SEQ ID NO: 14777 - protein, 255 aa, Pennisetum alopecuroides
CELDNIMRLTGITGIVNGMDVSEWDPSKDKYIATKYDVSTAIEAKALNKEALQAAAGLPVDRKIPLVAFVGRLEEQKGPDVMAAAIPQLMEEDVQIVLLGTGKKKFERMLMSAEEKYPDKVRAVVKFNAALAHQIMAGADLLAVTSRFEPCGLIQLQGMRYGTPCVCASTGGLVDTVIEGRTGFHMGRLSVDCKVVEPADVRKVASTLKRAIKVVGTPAYEEMVRNCMIQDLSWKGPAKNWENVLLSLGVAGSEP

SEQ ID NO: 14778 - protein, 332 aa, Zea mays
MVINLEFIRAIVTAEEVLLLDPLMHEVLPFVDQLRQHLPLRSLVGGNGECAPDGNGEKQGGSHGGQVPRLNEATGAEHEFPFEFHVLEVALEIVCSSLDLSVDDLERHATPVLDELTKNVSTRNLERVRSLKSHLTRLLARVQKVRDEIEHLLDDNEDMEHLYLTRKQVQNQQVEALMSSAASNSIVLAGPGVPRLNSSFRRSLSVATSMHLDNDVEDLEMLLEAYFMQLDGIRNRILSVREYIDDTEDYVNIQLDNQRNELIQLQLTLTIASFGIAANTFIVGAFAMNIPSSLYNTDNTLFWPFVGGTSSGCFVITILLFGYAWWKKLLGP

SEQ ID NO: 14779 - protein, 368 aa, Oryza sativa
MASLTDLVNLNLSDTTEKIIAEYIWIGGSGMDLRSKARTLSGPVTDPSKLPKWNYDGSSTGQAPGEDSEVILYPQAIFKDPFRKGNNILCTSISVHPDQHMSCAIATRQPENRSPPTRGTMLPRSSAPLRLLLRSPGTVLSKSTPSSRRTSTGPLAGLLVASPGPQGPYYCGIGADKSFGRDIVDSHYKACLYAGINISGINGEVMPGQWEFQVGPSVGISAGDQVWVARYILERITEIAGVVVSFDPKPIPGDWNGAGAHTNYSTKSMRNDGGYEIIKSAIEKLKLRHKEHISAYGEGNERRLTGRHETADINTFSWGVANRGASVRVGRETEQNGKGYFEDRRPASNMDPYVVTSMIAETTIIWKP

SEQ ID NO: 14780 - protein, 360 aa, Prochlorococcus marinus
MKTWVIKIGTSILRGTEETSTEEVIENLSRSFTSFLSKGNKLILVTSGAVGLGCQKLNIKTRPNDLSTLQATAAVGQVNLMSLYDKVFNRLGLNIAQILITKADFNSRESFNNASKTLKRLIDLNVIPIVNENDTVANEELKYGDNDTLSALVALAINANKLILLTDIENLYSKDPRNNKDAQPIKEVHNSELKEIKDKNIQNSNNEWGTGGISTKLISAEIATKGGVEVQLVDGTNKKNLIEIFNDNKIGTLFYPVEKPIGNKKSWLSHAIQTVGKITLDDGASFAIKKKGASLLAVGVKNVEGNFTINQAVKIVNTNDKEVAKGLVSISSDKLRSILNNKENNNSSIIVVHRDVLALS

SEQ ID NO: 14781 - protein, 258 aa, Lygeum spartum
CELDNIMRLTGIKGIVNGMDVSEWDPSKDKYIAVNYDAATAVEAKALNKEALQAEVGLPVDSKVPLVAFIGRLEEQKGPDVMVAAIKELMEEGSEDVQIVLLGTGKKKFERMLKSVEEEFPDNVRAVVKFNAPLAHQIMAGADVLAVTSRFEPCGLIQLQGMRYGTPCACASTGGLVDTIVEGKTGFHMGRLSVDCDVVEPADVKKVATTLKRAIKVVGTPAYQEMVKNCMAQDLSWKGPAKNWEDVLLDLGVAGSEP

SEQ ID NO: 14782 - protein, 254 aa, Anomochloa marantoidea
  misc_feature (141)..(141): Xaa can be any naturally occurring amino acid
CELDNIMRLTGVTGIVNGMDVSEWDPSKDKYITINYDEMTVLDAKPLNKEALQAEVGLPVDRKIPLIAFIGRLEEQKGPDIMAAAIPQLMEENVQIILLGTGKRKFERLLQSAGEKYPEKVRSITKFNAPLAHHIMAGADXFAITSRFEPCGLIQLQGQQYGTPCACASTGGLVDTVIEGKTGFHMGRLNIDCEVVLPGDVQKVASTLKRAIKVVGTPAYDEMVRNCMIQDLSWKGPAKNWEKVLLSLGVAGSE

SEQ ID NO: 14783 - protein, 614 aa, Arabidopsis thaliana
MGTPETSREPCPDRILDDIGGAFGMGAVGGSAFHFIKGTYNSPKGSRFVGGTQSVSMNAPRTGGSFAVWGGLFSTFDCTMVYLRQKEDPWNSIIAGAATGGFLSMRQGAGAASRSAIFGGVLLALIEGAGIMLNKVLAQPQNMMMEDPGMQGMPGMQGMQGMPGMPGMQGMPGMQGMQMGQMQSQAQIRSESQNQNTASSSSSSSWFGGLFDKKKEEVQPGSESKTEVLESFDAPPVPSFEFNPSTQLKHSNYIVVTASTSKLQKKINQSGFLGVFSLFAIMESLGKLQLHQQPNHLSFTHFSSSFPKKPSSFSLRSLPRSTSSFKCISIKASSSKSQDSKLSILKSTCVSFTAAAALFLVNLQLKPSPAIAAPVAATPLMESLKQSNGNVSFEEEERSLEEYLASHPDDVEALRSLMEVRIKSRKLLEAIELIDRLIELEPEEKEWPMLKANIFSYSGDLESAKTGFEEILVKDPLRVEAYHGLVMAYSDSGDDLNAVEQRIEEAMVRCKKEKNRKDLRDFKLLVAQIRVIEGKHNEALKLYEELVKEEPRDFRPYLCQGIIYTVLKKENEAEKQFEKFRRLVPKNHPYREYFMDNMVASKLFAEKVQREMAE

SEQ ID NO: 14784 - protein, 255 aa, Glyceria grandis
CELDNIMRLTGITGIVNGMDVSEWDPSKDKYIAVKYDADTAVEAKALNKEALQAEVGLPVDRNIPLVAFIGRLEEQKGPDVMAAAIPEIMQEDVQIILLGTGKKKFERMLKSAEEKYPGKVRAVVKFNAPLAHYMMAGADLLAVTSRFEPCGLIQLQGMRYGTPCVCASTGGLVDTIVEGKTGFHMGRLSVDCNVVEPSDVKKVATTLKRAIQVVGTPEYREMVRNCMAQDLSWKGPAKNWEDVLLGLGVAGSEP

SEQ ID NO: 14785 - protein, 70 aa, Zea mays
MVTSTTADDVLSPPSVDGLRLTPSPRERVSFRAASSRRPLPALAHLRPSLPIWLSTGATLLLGRFDFLHF

SEQ ID NO: 14786 - protein, 338 aa, Shewanella oneidensis
MNNSADITVLGAGSYGTALAISLASNGHKTLLWGHDPAHMQTLAEDKCNQAFLPGIAFPECLHIEADLAKALAASNNVLVVVPSHVFGTVLAQAKPLLRQDARIVWATKGLEPETGRLLQDVARDVLGEQYPLAVLSGPTFAKELAMGLPTAISVAGTCPQFTAELVELLHSPKRLRVYANDDFIGLQLGGAVKNVIAIGAGMSDGIGFGANARTALITRGLVELTRLGEALGASTATFMGMAGLGDLVLTCTDNQSRNRRFGLALGKGCDVDTAQVEIGQVVEGYRNTKEVFTLAKRLGVEMPITEQIYQVLYQGKSPVDAAKELLGREKKSETPTQ

SEQ ID NO: 14787 - protein, 255 aa, Hakonechloa macra
CELDNIMRLTGITGIVNGMDVSEWDPSKDKYITVKYDATTAVTAKALNKEALQAEVGLPVDRKIPLAAFIGRLEEQKGPDVMAAAIPQLMEEDVQIILLGTGKKKFERMLMSAEEKYPDKVRAVVKFNAALAHHIMAGADLLAVTSRFEPCGLIQLQGMRYGMPCACASTGGLVDTVVEGKTGFHMGRLSVDCKVVEPADVQKVATTLKRAIKVVGTPVYEEMIRNCMIQDLSWKGPAKNWENVLLSMGVAGSEP

SEQ ID NO: 14788 - protein, 318 aa, Betula pendula
MATFPVIDMEKLNGEERGATMELIEDACENWGFFELVNHGISHDLLDTVEKLNKEHYRKCMEERFKDMVASKGLEAAQSEVRDMDWESTFFLRHLPASNMSEIPDLDEDYRKAMKEFAGNLEKLAEQLLDLLCENLGLEKGYLKKSFYGSKGPNFGTKVSNYPPCPKPELIQGLRAHTDAGGLILLFQDDKVSGLQLLKDGKWVDVPPMRHSIVINLGDQLEVITNGKYKSVLHRVLAQPDGNRMSLASFYNPGSDALIYPAPVLVEKEAEKGQVYPKFVFEDYMKLYAGLKFQAKEPRFEAMKAMESTVKLGPIATA

SEQ ID NO: 14789 - protein, 241 aa, Clostridium thermocellum
MKYVEVIMSIKDEGEFFMKVLQKNEFLQKSNETLASILDMLEKLPVVKFDEIEADKAVLVIIDMTNGFAKEGALKSDAVKELIPRICELSEICDRRKIRKIAFADCHTDESPEFDAYPKHCMKGTAESEIVDEIKNIGGYTLIEKNSTNGFLEEAFRKWLLENPDINTFILTGDCTDICVQQFAITLKAYFNMNNKRARVIVPLNAVDTYDLGVHDRNLMNVMAAYNMIINGVEVVRDIVE

SEQ ID NO: 14790 - protein, 837 aa, Dechloromonas aromatica
MKLNRRDFIKANAAAAAISAAGLSVPGAAVAQGKDEIRWDKAACRFCGTGCGVLVGTQDGRVVATQGDPDAPVNRGLNCIKGYFLSKIMYGADRLKTPMLRMKDGKYDKNGEFTPISWTKAFDIMEEKAKATMKAKGPNGLAMFGSGQWTIWEGYAASKLMKAGFRTNNLDPNARHCMASAVAGFMRTFGIDEPMGCYDDIEHADAFVLWGSNMAEMHPILWTRITDRKLSNKGVKVAVLSTFEHRSYELADIPMIFTPQTDLAILNYIANYIIQNGKVNQAFVDKNVNFKKSATDIGYGLRPTHALEKNATSNGYPDADGKPKGDTGKSDPITFDEFKKFVSEYTVEKVSKLSGVAEKDLKALAELYADPKVKVISFWTMGFNQHTRGTWANNLCYNIHLLTGKISEPGNSPFSLTGQPSACGTAREVGTFSHRLPADMVVTNPEHRKHTEELWGLPEGTIPDKVGYHAVAMARALKDGKVNFYWQQCNNNMQAGPNINEELYPGWRKPENFIVVSDPYPTVSAMAADLILPTAMWVEKEGAYGNAERRTQFWRQQVKAPGEARSDLWQLMEFSKRFKVEEVWPAELVAKAPKLKGKTLFDVLYANGVVNKYKLNETAAGFDNDDSKLIGFYIQKGLFEEYASFGRGHGHDLAPFDSYHQARGLRWPVVGGKETLWRFREGYDPYVKKGEGVKFYGHKDGKAVIFALPYQPPAESPDKEFDMWLSTGRVLEHWHTGTMTRRVPELYKAFPDAVVFMHPDDAKARGLQRGMEVKVASRRGEIQLRVETRGRNKPPRGLVFIPFFDAGRLVNKLTLDATCPISKETDYKKCAVKVTKV

SEQ ID NO: 14791 - protein, 139 aa, Medicago sativa
YRYLPPDLQVCLISATLPHEILEMTNKFMTDPVRILVKRDELTLEGIKQFFVAVEREEWKFDTLCDLYDTLTITQAVIFCNTKRKVDWLTEKMRNNNFTVSSMHGDMPQRERDAIMGEFRAGTTRVLITTDVWARGLDV

SEQ ID NO: 14792 - protein, 327 aa, Aspergillus oryzae
MSPPAAIYEPTVAATGLKGKVVVSETVPVEGASQTKLLDHFGGKWDEFKFAPIRESQVSRAMTRRYFEDLDKYAESDVVIVGAGSCGLSTAYVLAKARPDLKIAIVEASVSPGGGAWLGGQLFSAMVMRRPAEVFLNELGVPYEEDANPNYVVVKHASLFTSTLMSKVLSFPNVKLFNATAVEDLITRPTENGNPQIAGVVVNWTLVTLHHDDHSCMDPNTINAPVIISTTGHDGPFGAFCAKRLVSMGSVDKLGGMRGLDMNSAEDAIVKNTREVTKGLIIGGMELSEIDGFNRMGPTFGAMVLSGVKAAEEALKVFDERQRECAE

SEQ ID NO: 14793 - protein, 189 aa, Medicago sativa
TLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITL

SEQ ID NO: 14794 - protein, 205 aa, Parvularcula bermudensis
MPLDFPTSGRVAEHSRKTKETDIRVRMDLDGTGRSDVSTGIGFLDHMLEGFAKHSLIDLEVEAKGDLHIDMHHTTEDVGIVMGLAAAKALGDAGGIHRFGHAYVPMDETLTRAALDVSKRPYLIWKVAFSRDKIGEMDTELFKEWFHAFATNAGLCLHVENLYGTNNHHIAESCFKALAKAFDMAIRLDERRAGASPSTKGSLGS

SEQ ID NO: 14795 - protein, 663 aa, Vibrio parahaemolyticus
MTRLFSRPYPLGATLNKEGCNFSIHAPGVKDIQLALFASDGSYSLHDLPNEYAGIRHTFIPDIKPGQKYGYVVTRRDEPLLISDPYAKSLDKALHYHPPYTPAKSFDMPKCVVIEDTFDWQETDHPRIPREDMVLFETHVKGLTQLHPEVSATTKGRYLGLASPQMLAFYKQQNINTLQLLPIAACMHEPHLLEMGKVNYWGYNPYLFMVPDPRYAEKDAVTELKTTIRELHKHGIEVILDVVYNHTAEGGEGATVFNLKALDSRFYIKHGNHFANYTGCGNTVDLTYQPALNLVMDTLRYWVSEFKIDGFRFDLAATLGRQGDDYNPEAAFFKAVAQDPILRETKLIAEPWDIGPNGYQVGNFPFGWNECNDKLRDISRSFWRGDQGYLKEFATRLMGSRDIYSAANWPYKLTVNYITYHDGFTLQDLVSYKHKHNEANGEENRDGHGDNRSENYGVEGETENIMIIATREKQKRNLIASLLFAFGIPHILTADVLSHSQDGNNNAYCQDNKTSWINWSETERKAHFKTWMAQMVANRHQYMVPFIRAFSGENRNNNRIFWRRTDGRLMEHDDWNRLSSVALHLGIGKDGQELVYLINQTNATARFKLPNERNQEWVTICDTNVRNLNPGHAEGEVLLSPTSMVILHYQPKPNSPQGEQLQS

SEQ ID NO: 14796 - protein, 140 aa, Picea glauca
VEDGSGGETDFQEVDHHAVEDRELKDHLLRRYSGYLSSLKQEFLKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 14797 - protein, 387 aa, Saccharomycopsis fibuligera
MSGAAKRLSQVSGILNPGATSEDTTLIVPVKPFKISVIGSGNWGTTIAKVVAESTGENPDLFQKDVHMWVFQEKIDGENLTDIINTKHENVKYLPDVKLPENVIAEPDITKTVINSDLIIFNIPHQFLGNVCKQLKGHVPTTARAVSCLKGLDVTPQGCNLLSSYITENLGIYCGALSGANLAPEVANQKWSETTIAYNEPDDFRGQGKDIDKAILKKLFHRPYFHVRVIADVPGVSVAGALKNVVAMAAGFVEGMGWGDNAKSAIMRIGLVEIVKFADKYYPESDSKTFTEESAGVADLITTCSGGRNVRVGKYMAETGKDATEAEKVLLNGQSSQGIVTTKEVHDLLENDNATHEFPLFEATYQIIYNGLPMDKLPSLIESIGDN

SEQ ID NO: 14798 - protein, 950 aa, Unknown
  Synechocystis sp. PCC 6803
MKSFFLNTFSPLRSTARFWVLVALLTSMELSASQLRDTEQAVAIEESKCTDCVEGRGTGIVRGESFAQVETVPTEAKVEQIKPMIERISPHLGLVGFGLAFIGVLWLTYLLKKDRQTKAQLAFQARRSDVLLELPQYADRLSEVEFLQRGQEFAEELTKSKIAFIHFVNDDEQTIELVAWSRATLANYCRVVAASHYPVEEAGIWADALRLRRPVLINDYATHQGKKGLPEGHAYLARLISVPVIDDGKVVMLTGVGNKDVFYTDQDVETVQLISNEIWRIARSRRLVKKLTESENRYRLAQAIAKIGNWELDYATNVLFWSPEVFNLFEIAPQDFAGTYEAFLNLIHPGDRELVDEAYQCHLQKYQPYDIVHRLLMPDGRIKYVQEQCNTVFDKNNLPLLSRGTIQDVTELQEAQISLEHLNEKLEQRIQERTQELENSQESLLEAKLVAEGATKAKSEFLANMSHEIRTPMNAIIGMSELVLQTDLTSQQRNYLQKVQYAGELLLGIINNILDFSKMEAGKLELEQKPFSVEEVMGNLHSILGIQAEAKGLTLNFHLDPRIPPILVGDRLRLSQILINLGNNAVKFTNQGEITIRGQLLKTENEQTKLQFSVTDTGIGLTPDQQSKLFQWFNQGETSTSRQYGGTGLGLAISKSLTELMGGDIWLESVVGQGSTFHFTVCLGTASPAVAQDYLVSRVSILEAKPSVTQAITQLEGASILLVEDNEINREFAHDLLTSKGLRVQVANNGQEALTLLTSNTYDAILMDIQMPMLNGYDATRAIRQQEYHRNLPIIAMTANAMAGDQEKALDAGMNDHLTKPIKPDLLFQTLAHWIPPNSAREKKNPSSNLKADLSFSSMTGINQQIGMQYIENVELYHRLLVKFGDRYSNFADQFRTEQASDDPTAATRYAHSIKGAAALLGIENVHHTAQQLEDSCREHESPEMIDRHL

SEQ ID NO: 14799 - protein, 517 aa, Unknown
  Azoarcus sp. BH72
MLDANIKTQLKAYLERVTQPIEIVASLDDGAKSREMQELLADVAEQSHLITVIERRDDNERKPSFSVGPKGGEARVRFAGLPMGHEFTSLILALLQSAGYPPKVEADVIEQIKALEGEFNFETYISLSCHNCPDVVQALNLLSILNPNIRHTMIDGGVFQEEVEKRQIMAVPTVYLNGQEFGAGRMELGEILAKIDTGAAKRDAAKLSAKDVFDVLVVGGGPAGAAAAIYAARKGIRTGVLAERFGGQVMDTLAIENFISVKETEGPKLAMALEEHVKQYEVDVMNLQRATALVPGDIHEVRLENGGTLKAKTVILATGARWREMNVPGEKEYRGKGVAYCPHCDGPLFKGKRVAVIGGGNSGVEAAIDLAGIVAHVTLLEFADTLRADAVLQKKLASLPNVTVIKSAQTTEVTGAEKVNGLVYKDRVSGEEKRLELEGIFVQIGLLPNTDFLKGTVELTRFGEIIVDAKGQTSVPGVFAAGDCTTVPYKQIIIAMGEGSKASLAAFDHLIRTSVPA

SEQ ID NO: 14800 - protein, 356 aa, Unknown
  Frankia sp. EAN1pec
MSSKSKSYQAEYIWIDGTEPEPLMRSKTRIVKGGKEPEIWGFDGSSTNQAPGSNSDCVLQPVFTCPDPLRGGDNVLVLCEVQLTDFTPHPTNTRAAARAVAEKYADMSPMFGIEQEYTFFQNGRPLGWPASGFPEAQGPYYCGVGGEKMPGRDIVEKHTQACLDAGLAIEGTNAEVMMGQWEFQIGVLPTPAIGDHIWVGRWLLHRIAEDFGASVSFAAKPMAGDWNGAGAHTNFSTKQTMESWDAIVAVCEALGTRVMEHVTHYGDGIELRLTGKHETAPWNKFSWGASDRGASIRIPWAVEKAKKGWIEDRRPNANMDPYVVSSLIVDTCCSALAGDKPTLFVPSQTADATVKV

SEQ ID NO: 14801 - protein, 346 aa, Oryza sativa
KDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVHILPFYSHC

SEQ ID NO: 14802 - protein, 81 aa, Glycine max
SNSYTRAVHQLSHRARGTAWLHPYTGLKSMAGLPTRKTNTDITSIASNGGRVQCMQVRPPAGSMKFETLSYLPDLDDAQLA

SEQ ID NO: 14803 - protein, 369 aa, Unknown
  Petunia x hybrida
IPRVTPSTLTALAEEKTLQTSFIRDEDERPKVAYNQFSNEIPIISLEGIDDETGKRAEICDKIVKACEDWGVFQVVDHGVDAELISQMTTFAKEFFALPPEEKLRFDMSGGKKGGFIVSSHLQGEVVQDWREIVTYFSYPTRARDYSRWPDKPEGWIAVTQKYSEKLMELACKLLDVLSEAMGLEKEALTKACVDMDQKVVVNFYPKCPEPDLTLGLKRHTDPGTITLLLQDQVGGLQATKDNGKTWITVQPVEGAFVVNLGDHGHFLSNGRFKNADHQAVVNSNSSRLSIATFQNPAPEAIVYPLKIREGEKSIMDEPITFAEMYRRKMSKDLELARLKKQAKEQQLQAEVAAEKAKLESKPIEEILA

SEQ ID NO: 14804 - protein, 530 aa, Unknown
  delta proteobacterium MLMS-1
AVGKDYVLVDIGDKSEGEIDITEFRNEEGEIEVKVGDTFEVYVEKREPEGGIKLSRERAIGIKVWEEIARIQEADSTIAGRIDSRVKGGLSVDIGVPAFLPYSQIDLRPVRDLDALIGESFDFKILKFNRRRNNVVISRRAIMEEARQQLRNEMRGTLEEGQVLTGTVTNITDYGVFVDLGGMDGLCHITDLSWGRVSHPSKMFKVGDDIQVKVLKYDQENDKVSLGVKQLKSDPWETIQQRYPVGAKVPGKVVSITDYGAFVELEEGVEGLVHISEMSWSKKSRHPSKIVTVGDEVEVSVLNVDPEAKRISLGMKQLQPNPWDMVAENYPAGSIIEGKIKNITDFGIFIGIEEGIDGLIHVSDLSWTERIKHPGEKYAKGETIQAVVLKIDKENERFSLGIKQLQPDPWEAAVEKYAIGTKLEGKITNVTDFGVFVELEEGIEGLIHVSELSKEKVETPVGLYNVGDTIEARVINVSAKDRKIGLSIKALSGEDEEARLEDFKQQQAKSGPSTLGDLLKEEMNRDKDEA

SEQ ID NO: 14805 - protein, 255 aa, Chusquea exasperata
CELDNIMRLTGITGIVNGMDVSEWDPSKDKYIPVKYDKTTAMEAKTLNKEALQAEVGLPVDGKIPLVAFIGRLEEQKGPDIMAAAIPKLMEENVQIILLGTGKKKFERMLKSAEEKYPGKVRAVVKFNAPLAHQIMAGADLLAVTSRFEPCGLIQLQGMRYGTPCVCTSTGGLVDTVIEGKTGFHVGRLSVECKVVEPGDVQKVATTLKRAIKVVGTPAYKEMVRNCMAQDLSWKGPAKNWENILLGLGVAGSEP

SEQ ID NO: 14806 - protein, 463 aa, Bacillus cereus
  misc_feature (244)..(244): Xaa can be any naturally occurring amino acid
  misc_feature (260)..(260): Xaa can be any naturally occurring amino acid
  misc_feature (276)..(276): Xaa can be any naturally occurring amino acid
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFXRILLFYVGALFVMMAXYPWNELGEKGSPFVLXFQQIGIAKAAGIINFVVLTAALSSCNGGLFSTGRMLYTLAQQKKAPERFGRLNKNGIPSQGIVATAIVLLVGVILNYLVPAKVFTWLTSISTFGAIWTWGIILVAQIKFRKSLPTQNKQKLSYKMPLYPLSSYFSLAFLALVLCIMAYSEDTRIALIVGPIWLIGLAVVYYMKGFHKIDETPNSKIS

SEQ ID NO: 14807 - protein, 583 aa, Zea mays
MDAQDGDERPLIIHRLPLLQDESTSEFTSDGTVDLRNQPARKQRTGKWKACFFILGAEFAECVAFFAISKNLVTYLTGVLHESNVDAATTVSTWIGTSFFTPLVGAFLADTFWGRYWTILAFLSVYVTGMTVLTASALLPLLMGASYSRSAHRLFAYLGLYLAALGNGGIKPCVCALGADQFDASDPVERRAKGSFFNWYYFSVNIGSLLSATVVVWVQDNVGWGVGFAIPTLLMLSGLVLFVAGRKVYRYQRVGGSPLTRASQVVVAAVRNYRLVLPEPDDSSALLHQVPPGTTEGNYSTMQHTSQFRFLDKAAIVAPSSGEKGATASPWRLCTVSQVEELKTVLRMFPVWVSMVLFFAATAQMSSTFIEQGETMDNRVGPFTVPPASLSTFDVISVMVCIPIYDKALVPLARRATGKERGLSQLQRLGVGLALSVAGMVYAALLEARRLSLARAAADGRPPMSIMWQAPAFAVLGAGEVFATIGILEFFYDQSPDGMKSLGTALAQLAVAAGNYFNSAVLAAVAAVTTRNGEAGWIPDDLDKGHLDYFFWFMAVLGVVNLLHFLHCSVRYRGSSNNSTYSS

SEQ ID NO: 14808 - protein, 255 aa, Chusquea oxylepis
  misc_feature (3)..(3): Xaa can be any naturally occurring amino acid
CEXDNIMRLTGITGIVNGMDVSEWDPSKDKYIPVKYDKITAIEAKALNKEALQAEVGLPVDGKIPLVAFIGRLEEQKGPDVMAAAIPKLMEENVQIILLGTGKKRFERMLKSAEEKYPGKVRAVVKFNAPLAHQIMAGADLLAVTSRFEPCGLIQLQGMRYGTPCVCTSTGGLVDTVIEGKTGFHVGRLSVECNVVEPGDVEKVATTLKRAIKVVGTPAYKEMVRNCMAQDLSWKGPAKNWENILLGLGVAGSEP

SEQ ID NO: 14809 - protein, 257 aa, Unknown
  Eremitis sp. Clark and Zhang 1343
CELDNIMRLTGITGIVNGMDVSEWDPSRDKYLTVKYDTATALEAKALNKEALQAEVGLPVDGKVPLVAFIGRLEEQKGPDVMAAAIPRLLEENDNVQIILLGTGKKKFESVFKSAEERYPGKVRAVVKFNAPLAHQIMAGADLLAVTSRFEPCGLIQLQGMRYGTPCVCASTGGLVDTVKEGKTGFHMGRLSVDCNVVDPGDVQKVATALKRAIKVVGTPAYEEMVRNCMAQDLSWKGPAKNWENVLLGLGVAGSQP

SEQ ID NO: 14810 - protein, 521 aa, Dechloromonas aromatica
MLDTAIKGQLKAYLERLQRPIELVGTLDDSAKGQEMRALLNDILECSDKVTLRENGGATRIPSFAVALPGETPRIHFAGLPMGHEFTSLVLALLQTGGHPPKVEQSVIDQINALPGSFKFETYISLSCHNCPDVVQALNLMAVLNPNVTSTMIDGAMFQDEVNARQIMAVPTTYLNDAEFGAGRMLIEEILAKVDTGATARAAEELGKKETFDVLVVGGGPAGAAAAIYAARKGIRTGIVAERFGGQVMDTLGIENFISVPYTEGPKLVASLEQHVKEYAVDVMNLQRANKLTPASENGGLVGLELENGAKLQAKTVILSTGARWREMNVPGENQYKAKGVCFCPHCDGPLFKGKRVAVIGGGNSGVEAAIDLAGIVAHVTLLEFADTLRADAVLQSKLNSLPNVTVIKSAQTTEVTGDDQKVNGITYKDRITGEEKHVELEGIFVQIGLLPNTDWLKGSLDLSKFGEIIIDAKGQTSAPGVFAAGDCTTVPYKQIIIAMGAGATASLSAFDHLIRSSAPA

SEQ ID NO: 14811 - protein, 528 aa, Coccidioides immitis
MSVNRCGRQAAKLLRLSGGYSRVACGLRWSHPARRVAQWQSVASVHTDGHQNMLAEKLEQADPTVYKIIQNEKSRQKHFINLIPSENFTSQAVLDALGSVMQNKYSEGYPGARYYGGNEFIDQAERLCQQRALQAFGLNPEEWGVNVQPLSGSPANFYAYSAVLQPHDRLMGLDLPHGGHLSHGYQTPTKKISAVSKYFETLPYRLDESTGLIDYAKLEDLATLYRPKLIVAGTSAYSRLIDYPRMKKIADSVGAYLLSDMAHISGLVAAGVIPSPFPQSDIVTTTTHKSLRGPRGAMIFYRKGVRKHDAKGNPIMYDLENPINAAVFPGHQGGPHNHTITALAVALKQAHSPEFKTYQQSVLENAKALAARLGNSTNSGGLGYNIVSGGTDNHLVLVDLKNRGVDGARVERVLELCGVASNKNTVPGDKSAMKPGGLRMGTPAMTSRGFGPEDFSRVADIVDRAVIITQKLDKAARAEAEAKNRKNPTSLKAFFEYLGQGEEVSEIVQLRKEVEDWVGTFSLPWTEE

SEQ ID NO: 14812 - protein, 870 aa, Pichia anomala
MSSESPSSVFSETSSIQISETDVEPELNFPLRKDVPKSKVLELDINTKDYRVPRDPRLLRLTGSHPFNCEAPLTTLFEDGFITSSDLHFVRNHGPVPHVEDEEIMNWTFSVEGLVDEPFEMKLSDMIQEFPQYTNPITLCCAGNRRKEQNQVKKGKGFNWGAAGVSTSLWTGAFLWDVISKAKPSKKARYVWMEGCDDPAKGAYGTCVPLPMVKDPERNIMLCYKQNGIYLEPDHGKPLRIVIPGVIGGRSVKWLKKLVVSDKPSDNWYHFFDNRVLPTMVTPEMAASDESWWKDERYAIYDLNLQSITVYPENDETLIVDSSNEDELYNVKGFAYNGGGKRVGRVEISLDGGKTWKLCEIDYPEDSYRDAGYIELYGGTINVCDRMSCLCWCFWNLQIPKRELKCAKDLVVRAMDISMTVQPRNMYWNVTSMLNNWWYRIAIQPGSQNDEIRFEHPTLANKPGGWMDRVKKEGGDILNPNYGERVANGEQEEERKPYVDEELQMILNPDKVNIIITKEQLAQHSNEQDPWFIVKGHVFDGTPFLQEHPGGAQSITMVAGEDATEDFMAIHSDNSKRMLQKFHLGKLEDQSSTTTSVPIVEIIEKTPTLLNPKKWKKIKLVNKEIISHDSRIFHFELEHPEQTTGLPVGKHFFIRSKDSTGSLVMRAYTPKSNHKIMGKLEVLVKVYFAKEGIPGGKMTNILENMDIGSFIEIKGPTGEFEYLSNGEYLLDNKPGKVDSFLMIAGGSGITPCYQVIKEIVDNEQDNTKMKLFYGNRKPEDILCLQDLDDFVATKNSNLSVVHCLSDYRGIPNEWEGLTGRMNKLLWNQYIEEQNKIGDFLVLVCGPPGMVEGVKTIVKETGFDPSRVVYF

SEQ ID NO: 14813 - protein, 411 aa, Unknown
  marine gamma proteobacterium HTCC2143
MRKKLSRRQILTGLSGVAGVVATRPLLAADSAEQLSLEKIDQLLASTRQQGWAPSGLGQRSAFESPQRLPLYNIASGTPLQDLHGTITPADLHFERHHAGVPTLDPDMHELLIHGMVDKPLKFSLADLKRMPSVTRVCFIECSGNLNIRAGEKTTPQQLSGLTSQSEWTGVALSTLLNETGVKGKARWFLAEGADAAVLARSIPLAKGLDDAMIAYAQNGEAIRPEQGYPFRLLLPGWEGNTNVKWLRRLEVSDQPFMTREETSKYTDPLKSDKSRLFSVVMDARSIITSPTYPSVLSKGWTEIRGLAWSGHGKIVQVDVSVDGGRRWQKAALQGPVLSKAHTRFTLPWRWDGTGTELLSRAVDESGYIQPTRRQLIDSRGLGSLPYHLNCILGWQVRSDGQVLYAAEPWA

SEQ ID NO: 14814 - protein, 258 aa, Leuconostoc mesenteroides
MAVISMKELLEAGVHFGHQTRRWDPKMDEYIFTERNGIHIIDLQKTVKLVDEAYNFIRNASTDGANVLFVGTKKQASDAIAEEATRAGQYYINHRWLGGTLTNWNTIKTRIQRLKDLQTMAEDGTFEQLPKKEVVLLNKQREKLEKFLGGIQDMPGLPDVLFVVDPKKEEIAVKEANMLNIPVVAMIDTNANPDVVDVKIPANDDAIRAVRLITSKIADAVIEGRQGQDSAPEDAFVEGDENTESIEEIANIVEEGNN

SEQ ID NO: 14815 - protein, 458 aa, Shigella flexneri
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGYGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRK

SEQ ID NO: 14816 - protein, 1077 aa, Pichia anomala
MKVEEHIGGVPPLPGKTDGVKQYSDMKNMVIVGLGMTGIAFLEKMLNNDTAQEYFYTVIGEEPYLAYNRVGLTEYFEHKNFDKLLLSPKTFYEERNKNRWNFKVDEAVVEVDRDHKVAKTSKGNSYEYDTLVFATGSNGVLPLQLLPDPVNGKSKQDYRNYREMGCFVYRTIDDLNSMLSFSEELSIPKDSTKRAIVVGGGLLGLEAGKALLDMKTFDNVTVVHRSKWLLSQQMDEKGGALLTEKVRDLGVTARTGTTVDELLFDNNGKLKAVKYNDGEIEECQLLCYTIGIQPRDEVAAESGLVCSKRGGVAINNFMQTSDPNIYAIGECASWNDKTFGLIAPGITMADILSFNLIQSKFHSPKEFSEPDIGTRLKLMGVEVASFGDYFADKNGPKWLPKGYTLKKVRSLVYEDPIEGIYIKLILTQDGKYLLGGILVGNTKQFTKFTSIAKQRKPLPCPASEFILGKGGDDDEDADMLSDDTQVCSCQNISKGTLVENIRNGKCSSLGELKSVTKAGTSCGGCEPTMKAIFESEMKKMGKQLSNALCAHFKQSRADLFSIIMVKQYKSFKEIMQNVGLKPEAAGCEICKPTTIGSIFSTLYNRHILDSDVHGLQETNDRYLGNIQRNGTYSVIPRMSAGEITPEKLIAIGNIAQKYDLYTKITGAQRVDLFGALKQDLPKIWEELYEHGFESGQAYGKSLRNVKSCVASTWCRYGKRYKGIRSPHKMKGGVSGCVTHCAEFHSKDFGLCAVQNGFNVYVGGNGGMKPAHAQLLKSDVPPDQVIPLLDRYLMFYFRTADRLQRTARWLENLEGGIEYLRDVVVFDKLGICKELEDQMNELVGHYFDEWRESVIRKEDQIFKQFANTDKSQETVEIIRERGQRRPADWPEKETVEKKDFKNIKWSSTSWRSVCPSTELPEKEAGSSTTILISDTQIALFRLNGKLYASQNMCGHKRAFVLSQGIISTDENDNVYISCPLHKRNYVIDADKPNAGACKNDDSLSVALFDIKEEDGMILVKLPPEDELDEVLGTTKWKVKKSETVSEGIATFKKLDAKFNIKVPVRTPVPSVGGSELDW

SEQ ID NO: 14817 - protein, 247 aa, Melica cupanii
CELDNIMRLTGITGIVNGMDVSEWDPSKDKYIAVKYDAATAVEAKALNKEALQAEVGLPVDRKIPLVAFIGRLEEQKGPDVMAAAIPEIMKENVQIVLLGMGKKKFERMLKNAEEKYPSKVRAVVKFNAPLAHHIMAGADLLAITSRFEPCGLIQLQGMRYGTPCACASTGGLVDTIVEGKTGFHMGRLSVDCNVVEPSDVKKVATTVRRAVKVVGTPAYQEMVRNCMAQDLSWKGPAKNWEDVLLG

SEQ ID NO: 14818 - protein, 257 aa, Pariana radiciflora
CELDNIMRLTGITGIVNGMDVSEWDPSKDKYLTVKYDATTAIEAKALNKEALQAEVGLPVDGKVPLVAFIGRLEEQKGPDVMAAAIPRLMEENDNVQIILLGTGKKKFERVFKSAEERYPGKVRAVVKFNAPLAHQIMAGADLLAITSRFEPCGLIQLQGMRYGTPCVCASTGGLVDTVKEGKTGFHMGRLSVDCDVVDPGDVQKVATALKRAIKVVGTPAYEEMVRNCMAQDLSWKGPAKNWENLLLGLGVAGSQP

SEQ ID NO: 14819 - protein, 307 aa, Synechococcus sp.
MVTQDIPAVDIGFTHEDFAALLDQYDYHFNPGDTVVGTVFNLEPRGALIDIGAKTAAFFPVQEMSINRVESPEEVLQPSEMREFFILSDENEDGQLTLSIRRIEYMRAWERVRQLQTEDATVRSEVFATNRGGALVRIEGLRGFIPGSHISTRKAKEDLVGEELPLKFLEVDEDRNRLVLSHRRALVERKMNRLEVGEVVVGAVRGIKPYGAFIDIGGVSGLLHISEISHDHIETPHSVFNVNDEVKVMIIDLDAERGRISLSTKQLEPEPGLMVRNPEVVYEKAEEMAAQYREKLKQQAEGLVVTE

SEQ ID NO: 14820 - protein, 635 aa, Pisum sativum
MMESCECIDTPYPPDELLVKYQYISDVLIALAYFSIPVELIYFVQKSAFFPYRWVLMQFGAFIVLCGATHFINLWTFSAHSKAVAVVMTIAKVSCAIVSCATALMLVHIIPDLLSVKTRELFLKNKAEELDREMGLILTQEETGRHVRMLTHEIRSTLDRHTILKTTLVELGRTLGLEECALWMPSRSGLNLQLSHTLTYHVQVGSTVPTNLPIVNEVFNSPRATRIPHTCPLARIRPLVGRYVPPEVVAVRVPLLHLSNFQINDWPDLSAKSFAIMVLILPTDSARKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLAALINDVLDLSRLEDGSLELEMGKINLHGVLEEVIELIKPIASVKKLPITLILAPDLPDNAIGDVKRLMQTLLNVVGNAVKYTKEGYVSIRASVAKPESLQDWRPPEFYPASSDGHFYIRVQVKDSGCGILPQDIPHLFTKFTQSQSGAGRSSSGSGLGLAICKRFVNLMGGHIWMESEGPDKGSTATFVVKLGICGNPDSSDHQATTRGQAYSGSGGLARFKHLVNDGDIGFSNRRNQRSF

SEQ ID NO: 14821 - protein, 552 aa, Unknown
  Synechococcus sp. CC9605
MRGHHARSWIRSARLQRPPGMSFPDFSASDAHIQWQRFCDLSWYHDDLGVWLDISRMHVNASDLQQLQPRMDKAFAAMQELEAGAIANPDEQRQVGHYWLRTPELAPSSELQQHISREIDLIAAFGRDVVNGTIKAPNGEAFTDVLWIGIGGSGLGPALMIKALQNPGEGLPFHFFDNVDPNGMSNVLAGLEGRLDRTLVVTVSKSGGTPEPHLGMEQARHRLEAAGGQWAGQAVAVTMLDSKLDQQAQKEGWLKRFDMFDWVGGRTSITSAVGLLPGALIGCDIRDFLSGASQMDAATRMADLRRNPAALMAASWHVAGGGRGQRDMVVLPYRDRLEVFSRYLQQLVMESLGKRLDRNGDVVHQGIAVYGNKGSTDQHAYVQQLRDGVDNFFATFIEVLEDVSDIPTISGECPGDFLDGFLQGTRSALTESGRQSMTISMRCFDARRLGALIALFERAVGLYGELVNINAYHQPGVEAGKKAAAAILNLQGRVEAILADGVARSADEIRLALGDGTDESIFWILRHLTGNQRGFSAQGDWSQPASMRFSKG

SEQ ID NO: 14822 - protein, 605 aa, Propionibacterium freudenreichii
MTSDQNMTSDQHSETPPIRALLGEDEERTADARAKLEMALSLTQPTGAVDPHDTSWFETAVFYEVMVRSFADSSGDGIGDLAGLTEHLDYLQWLGVDCLWLPPFFASPMTDGGYDVADYRAISPDLGTLSEFGDFIDKAHDRGIRIIIDFVMNHTSDHHPWFEESRRHPDGPYGDFYVWRDNPDGYPDARIIFIDTETSNWTFDPVRGQYFWHRFYSHQPDLNYENPKVLAEMLDALRFWLGFGVDGFRLDAVPYLVEEEGTNCENLPGTHDILKQVRKMVDEEFPGRILLCEANQWPHDVVEYFGDNDECQMAFHFPVMPRLYMGVARHTREAITTILASTPPVPQGCQWATFLRNHDELTLEMVTEDDRQYMWREYAPDPRMRLNLGIRRRLAPLMGNDPDKIRLMNAMLLSLPGSPVLYYGDEIGMGDDIWLHDRDGVRTPMQWTADPSAGFSTATPDKFFLPLLADPYSPQQVNVTDQMADPGSLLVWMRSMLTTRRQFPVFGRGEFIDMGGQNDAVLSFLRVLDDDKHGSQRLLCLNNLSPEEQDVLLYLPDDAGTKPVSLLTSQAMAPIAANGEFHDTLPAWGFAWLDLSKGSDEHESE

SEQ ID NO: 14823 - protein, 466 aa, Unknown
  Dehalococcoides sp. BAV1
MNKERAFYKAVSRSIQSLNTPAELKAKLEGIIRLAARASHCAVSLLLIDAAGQKLSHNISFGLPQFYIHKGVLSAADSIGETVNIQTTAITDVQNDHRIQFPQMALKAGFSSILGSPIIYREKVIGSIRFYCKDFYEFSQQDITFAENMARIISLAFCTLPTTTAPVDNTASMPASNLKTAQNITFAHQSETEFARLLDFYNIEWIYEPRSFPLDWEGELVTEMFTPDFYLPGLDMYIELTTLKQSLVTTKNHKLKMLRELYPDIKISLLYKNDYARLLSKYGCGPLAQTRAHGIDRVLYTAGDIAERVASLARQISDDYPDNRPILIGVQRGFICFMADLIRQIAIPLDIDFMTISYYSGSNASMVRITKDMDLEVAGRDVLLVEDIVDTGITLNYLLNHLRSKNPASLKVCTLLDRKVRRLIDINIDYVGFELPDEFVVGYGLDYHEEYRNLPFIGIPGIKQNP

SEQ ID NO: 14824 - protein, 618 aa, Gossypium hirsutum
MEQHIMWVFWFFLHWFCSVHSVSDGDSLLSPKGVNYEVAALMSVKRELRDYKQVMDGWDINSVDPCTWNMVACSAEGFVISLEMASTGLSGLLSPSIGNLSHLRTMLLQNNQLSGPIPDEIGKLSELQTLDLSGNHFVGAIPSTLGSLTHLSYLRLSKNNLSGPIPRHVANLTGLSFLDLSYNNLSGPTPKILAKGYSITGNNFLCASSEHICTDVSYPLNGSVSSSRVSGNHHWLLSVAIGIGFAFVVSVMLLACWVRWYRSQIMLPSYVQQDYDFEIGHLKRFSYRELQIATSNFNSKNILGQGGYGVVYKGCLPNRSVVAVKRLKDPNFTGEVQFQTEVEMIGLALHRNLLRLYGFCMTPDERLLVYPYMPNGSVADRLRDACHGKPALNWSRRMHIALGAARGLLYLHEQCNPKIIHRDVKAANILLDESFEAVVGDFGLAKLLDKRDSHVTTAVRGTVGHIAPEYLSTGQSSEKTDVFGFGILLLELITGQKTLDAGNGQVQKGMILDWVRTLHEERRLEVLVDRDLQGCFDTIELETVTELALQCTRPQPHLRPKMSEVLKVLEGLVQSGTEEPQGGTNHCETSAYSFSRNYSDVHEESSFIIEAMELSGPR

SEQ ID NO: 14825 - protein, 119 aa, Triticum aestivum
DLEHPERPTKYGKYWCWCFWSVDVEVLDLLGAKEMAVRAWDEALNTQPERLIWNLMGMMNNCWFRVKINVCRPHKGEIGLVFDHPTQPGNQSGGWMARQKHIETSETTQGTLKRSTCTP

SEQ ID NO: 14826 - protein, 285 aa, Burkholderia pseudomallei
MSTTLLFHPTPDVAYGFPNARRLARIESEYQEIEVWETSLLGRLFTLDGRPMTSVGDEFVYHECMTHPAALAHPAPKKALVLGGGDGGAARQLLRHPCIERIVVAELDAAVVDMARRFLGDVHQGALDDPRVELAIGDAARYVDHACEHFDLAVFDLTPPDSPAAGLYTPAFYTRLKRILTPQGAVSLHLGSPLYHGARIAALLAGLRERFAVVAPLCAHVPLYGSPWLMAIASDTLDAASLFSHDIDARLAERHIEGLRFYDAKLHSALFTLPHALRDTLGMHR

SEQ ID NO: 14827 - protein, 134 aa, Saccharomyces cerevisiae
MARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKDIKLARRLRGE

SEQ ID NO: 14828 - protein, 140 aa, Picea glauca
VEDGSGGETDFQEVDHHAVEDRELKDHLLRRYSGYLSSLKQEFMKKKKKGKLPKDARQKLLDWWSLHDKWPYPSETEKIAFAECTGLDQKQINNWFINQRKRHWKPSEDMHFMVMNSHSPHSAALYVERHLMTEGYHLDC

SEQ ID NO: 14829 - protein, 604 aa, Oryza sativa
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEARHIEMIYKIIQHMAANDRALIAEGSCGSPRSIKVYLGECNVDEDMLAA

SEQ ID NO: 14830 - protein, 325 aa, Triticum aestivum
MGEASSPAIAKDVTELIGNTPLVYLNKVTDGCVGRVAAKLESMEPCSSVKDRIGYSMITDAEEKGFIVPGKSVLIEPTSGNTGIGLAFMAAAKGYRLVLTMPASMSMERRIILKAFGAELILTDPLLGMKGAVQKAEELAAKTPNSYILQQFENAANPKIHYETTGPEIWKGTGGKIDGLVSGIGTGGTITGTGKYLQEQNPNIKLYGVEPTESAILNGGKPGPHKIQGIGAGFIPGVLDVDIIDETIQVSSDESIEMAKSLALKEGLLVGISSGAAAAAAIKVAQRPENAGKLFVVVFPSFGERYLSSVLFHSIKKEAESMVVE

SEQ ID NO: 14831 - protein, 463 aa, Unknown
  Frankia sp. EAN1pec
MDVYDHVTDLVGDTPLVRLTPVIADTVTPVLGKLEYLNPGGSVKDRIALSMVAAAERDGRLTPGGTIVEPTSGNTGVGLAMVAARRGYRCVFTMPDKISEEKRAVLRAYGSEVIVCPTAVAPDDPRSYYSVARRVLSETPGAWSPDQYSNPDNPAAHEASTGPEIWRATDGRVTHFVAGIGTGGTISGTGRHLKAVSGGTVQVIGADPEGSVYSGGSGRPYLVEGVGEDIWPTTYDKSVVDRVEAVSDRDSFLMTRELARRAGILVGGSCGLAVVAALRVARELDAAGTTDACVVVLLPDSGRGYLSKIFNDEWMYDNGFLDPPSDEPTVASVLAHKAAQTSGPPNLVHVHPDETVGAAISYLREYGVSQMPVVRHEPPVRAAEVAGAVLERELLDAVFADRGTVDAPVADHMSPPLPTVGAGEPVSVLVSALGENPAALVLDEGNPTGILTRADLLGFLAVR

SEQ ID NO: 14832 - protein, 444 aa, Neisseria meningitidis
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMSEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 14833 - protein, 853 aa, Pseudomonas syringae
MNTTVFPLNDVKTLIVVGNGMVGHHCVEQLIAGGALERYRIHVFGEETQRAYDRVHLSEYFTGRDAESLAMSEMSVYEQPGLTLHLGVPVLEIDRDRHEIITAEGCFSYDKLILATGSYPFVPPIEGARGNSRLVYRTLEDLDSIRYAATKARRGVVVGGGLLGLEAANALKSLGLEAHVVEFAPRLMPVQLDDLGGAALKARIEALGVGVHLSRATQSISDGKQYRYRMNFANDEFLETDLIVFSAGIRPQDALARQCELALGPRGGIAIDEHCRTSDADIYAIGECAAWNGSVFGLVAPGYQMARGVAAQLCEQDTDAFFGADMSTKLKLLGVDVGSIGDAHGALAGAVSYRFIDEATASYRRLVVSADGKQVLGAVLVGDNSYYDTLLQYAQNGIPLPADPSSLILPRGEGAPTLGADALPATATICSCHNVSKGAVCSAIDNGCTDLAAIKSCTKAATGCGGCTALLKQVFEHELIARGVAVDKSLCEHFAYTRQELYSMVRVEGIETFDELLTRHGKGTHGCDICKPAVGSILASCWNRPITEPSLVPLQDTNDTFMANMQKNGTYSVVPRIPGGEITPDGLIAIGAVAKKYDLYTKITGGQRIDLFGAQLHELPDIWSELIEAGFETGHAYGKSTRTVKSCVGSTWCRYGVQDSVAMALRIEDRYKGLRSPHKLKFAVSGCTRECAEAQSKDVGVIATENGWNLYLCGNGGMRPRHAELFATDLDDQTLIRYIDRFLMLYIRTADKLQRTSVWRETLEGGLDYLKAVIVDDSLGLAAELESQMQLVVDRYECEWANALKDPEKLKRFRTFVNDGRADPDVQFVKERAQRRPARPEELALIPLFKEVV

SEQ ID NO: 14834 - protein, 107 aa, Mesorhizobium loti
MGATVKVDKNNFQADVLNANVPVVVDFWAEWCGPCKQIAPSLEDIATELGAKIKIAKLNIDENPELAAQFGVRSIPTLMIFKGGEVADMKVGAAPKTALSHWINGSL

SEQ ID NO: 14835 - protein, 206 aa, Deinococcus radiodurans
MGWHPLGEHGAPHNSSMTQQTNSQGTQPGAAQEQAIFAGGCFWCTEAVMQDLRGVQKVESGYIGGTVPNPDYRSVCGGQTGHAEAVRVTFDPNQISYRDLLGLFFATHDPTSLNRQGADVGTQYRSALFPLTQEQEQTAREMIEQLGTEDVFGRPIVTSIEPASTFYVAEDYHQNYYKNNPGQGYCMAVISPKVAKLRQYYGDKLR

SEQ ID NO: 14836 - protein, 167 aa, Momordica charantia
MAEESPKSIYDFTVKDIRGNDVCLSQYSGKVLLIVNVASKCGFTDSNYKELNVLYDKYKSQGFEILAFPCNQFARQEPGTNEEIQETLCTRFKAEFPIFDKVEVNGKNAAPIYKFLKLKKGGIFGDGIKWNFTKFLVNREGKVVDRYAPTTPPLNIEKDIQNLLGSA

SEQ ID NO: 14837 - protein, 126 aa, Symbiobacterium thermophilum
MRIALIAHDNRKQDMLKFVKDHKSAFEGHQLFATGTTGKLIREHTGLDVHCFLSGPLGGDQQIGSRVATGEIDMVIFLRDPLTAMPHEPDVQGLLRLCDVRDIPVATNLGSARMFADDLMRLKDVK

SEQ ID NO: 14838 - protein, 345 aa, Synechococcus elongatus
MFLKNYWYPVALAQKVGDRPLSVTLCGEAIALYRDSAGQIHALSDRCVHRGAALSGGWVENDCLVCPYHGWQYDAQGHCRKIPANTEQQRIPFAAKVPHYDAIERYGLVWLFYGDLPEADRPPLPPLPEYDDPAWRTVQGEVTYTTHYTRVTENLMDFAHAPFTHSGSFGAASDPLIEPYKVEQLPDGLRAQTQFTKSAYRGIWKLFNRGDAPRTVTTTITLYMPCIVRTETDLGNGFRFIGYGANLPIDAETTKTFWLTVRTFFTGAWADGDTVRRSLKIIEEDKRIVETQRPKMIPLDDRSETHVAADALQIGYRNLLRQARDRGWAIAESQPADQELVPAAK

SEQ ID NO: 14839 - protein, 334 aa, Synechococcus elongatus
MANLDVALLPNHWYAIAASTDLGSTPIAASLLDQQLVVYRTTAGQVVVLDDRCPHRGASLACGQVKGNAIACPYHGWQFDLDGHCAQIPSQQASARIPQAAKVASYPVQERYGLIWVFTGDRDRAAQTPLWELPEYDQAGWRVVQGQFDWAADYRRVTENGMDVAHSPFVHANSFGASGNEVIADFELEKSDLGAQIWIPIEPKANYRGSFNLLGRKQETPKAGRSGAAFHLPNITRIDIEFGNFHLILVGIHQPISATTTRSHWLHVRNFLTAGWADGGTRKRTAKLFQEDQKIIEGIAPLRDRNEISVASDRLQLYYRQLWQQHHSSLVAQG

SEQ ID NO: 14840 - protein, 264 aa, Pseudomonas putida
MRIALYQGAPKPLDVPGNLQRLRHQAQLAADRGAQLLVCPEMFLSGYNIGLAQVERLAEAADGPAAMTVVEIAQAHRIAIVYGYPERGDDGAIYNSVQLIDAHGRSLSNYRKTHLFGELDRSMFSPGADHFPVVELEGWKVGLLICYDIEFPENARRLALDGAELILVPTANMTPYDFTCQVTVRARAQENQCYLVYANYCGAEDEIEYCGQSSIIGPDGSLLAMAGRDECQLLAELEHERVVQGRRAFPYLTDLRQELHLRKG

SEQ ID NO: 14841 - protein, 253 aa, Pharus lappulaceus
  misc_feature (251)..(251): Xaa can be any naturally occurring amino acid
CELDNIMRLTGITGIVNGMDVSDWDPSKDKYITTNYDATTVLEAKPLNKEALQAEVGLPVNRNVPLVAFIGRLEEQKGPDIMARAIDQLMEENVQIILLGTGKKKFERLFMSAEEKYPNKVRAVVKFNGALAHQIMAGADLLAITSRFEPCGLIQLQAMQYGTPSACASTGGLVDTVIEGKTGFHMGRLNVNCEVVEPADVQKVVTTVKRAINVVGTPAYNEMVKNCMVQDLSWKGPAKNWEKVLLSLGVXGS

SEQ ID NO: 14842 - protein, 306 aa, Hordeum vulgare
IGVCYGMSANNLPAASTVVSMFKSNGIKSMRLYAPNQAALQAVGGTGINVVVGAPNDVLSNLAASPAAAASWVKSNIQAYPKVSFRYVCVGNEVAGGATRNLVPAMKNVHGALVAAGLGHIKVTTSVSQAILGVFSPPSAGSFTGEAAAFMGPVVQFLARTNAPLMANIYPYLAWAYNPSAMDMGYALFNASGTVVRDGAYGYQNLFDTTVDAFYTAMGKHGGSSVKLVVSESGWPSGGGTAATPANARFYNQHLINHVGRGTPRHPGAIETYIFAMFNENQKDSGVEQNWGLFYPNMQHVYPINF

SEQ ID NO: 14843 - protein, 471 aa, Bacillus cereus
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGIPYAADIMNFVIITAVLSVANSGLYANSRMLWAMAKQGMASPAFTKLTKKGVPLNALIFSLIFASLSLLTSIFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQISLKKEVN

SEQ ID NO: 14844 - protein, 939 aa, Wolinella succinogenes
MSEALSGRGNDRRKFLKMSALAGVAGVSQAVGSDQSKVLRPATKQELIEKYPVSKKVKTICTYCSVGCGIIAEVVDGVWVRQEVAQDHPISQGGHCCKGADMIDKARSETRLRYPIEKVGGKWRKTSWDSAMDKIAKQLQDLTQKYGPDSVMFIGGSKCSIEQSYYFRKFAAFFGTNNLDTIARICHAPTVAGVSNTLGYGGMTNHLADMMHSKAIFIIGGNPAVNHPVGMVHILRAKEAGAKIIVVDPHFSRTATKADHYVRLRNGTDVAFMYGMIRHIVKNGLEDKEFIRQRLFGYEEILKECEQYTPEVVEEVTGVPAQQLIEITEIFAKAKPASLIWGMGLTQHTTGTSNTRLAPILQMILGNIGKRGGGTNVLRGHDNVQGASDMGNLADSLPGYYGLDKNAWNHFCGIWKVDFEAMQKRFKTPDMMHKKGFSVSTWRYGVTEEENIPHNAGTKLRALIVVGSGISTIARVDTTKDALDKMDLVVFFDPYFNDAAALTNRKDNLYILPAATQMETSGRVAATNRSYQWRSMVMKPLFECRPDEEILFDLAKRLGFYEEYTRSLGDGKGNFVWPDDATREVAKAIRTVGFQGRTPERLKAHAENWHMFDKFTLRGKGGPVKGEYYGLPWPCWSEKHPGTPNLWDDSIPVMDGGLGFRVRWGDVSPTGESLLASQDSSLPGSKFKGGHSMITDKNVEAITGIALTEEEKAKVAGKTWATDTTNILVEKALAAGLSPMGNGRARAIVWEWTDQIPKHREPIYTIRHDLISQYPTFKDKPNHFRANIRYESRQKEKDWTKEFPLNMLSGRLVAQFGTGTETRSAHYLAEVQPEMFVEIHPETATDLGVKHGDMVWVHGTNGAKILVKARHSYKVNKTSVFLPQNFGGMYQGESLVPYHIAGTEPYVIGESCNTITSDAYDINTSTPETKCGLCRIEKA

SEQ ID NO: 14845 - protein, 160 aa, Glycine max
  misc_feature (99)..(99): Xaa can be any naturally occurring amino acid
  misc_feature (152)..(152): Xaa can be any naturally occurring amino acid
ASSMISSPAVTTVNRAGAGMVAPFSGLKSIAGFPTKKTNNDITSIATIRGKVQFLHVWPPLGKKKIDTLSYLPYLDDAQLPNELEYLLTNVWIPCLEFXMEHIFMYREHYTSPGYYNSRYCTMLKLPMVGCTDASRVIKELLQAKTAYPNGXFIRIIGFD

SEQ ID NO: 14846 - protein, 74 aa, Mesostigma viride
MERQNLIEMEGVITESLPNAMFRVHLDNGFNVLAHISGKIRRNYIRILPGDRVKIELTPYDLTKGRITYRLRKR

SEQ ID NO: 14847 - protein, 182 aa, Dechloromonas aromatica
MSQSAHSFATLAGGCFWCLEAAFEQLDGVVAVLPGYMGGHDPRPTYEAVCRGDSGHAEVVQIEFDPAIIDFETLLTAFFTIHDPTTLNRQGHDVGTQYRSAIYFHDAGQQSAAEAMIARLNAEGVWASPIVTEVSPASAFFVAEDYHHQYFRRNPYQGYCMAVVAPKAMKLRQVFAERIKAG

SEQ ID NO: 14848 - protein, 166 aa, Brassica napus
  misc_feature (12)..(12): Xaa can be any naturally occurring amino acid
KTALPLSTDHKXPDREDEAARIEGAGGKVIRWNGARVFGVLAMPRSIGDRYLKPSIIPDPEVTAVRRVKEDDCLILASDGVWDVMTDEEACEMARKRILLWHKKNAVAGDASLHTDERRGEGKDPAAMSAAEYSSKLALQRGSKDNITVVVVDLKPQRKFKSKPLN

SEQ ID NO: 14849 - protein, 458 aa, Streptomyces coelicolor
MRRTCVIGAGPSGLAASRVLASRGIPFDCYEAGSGIGGLWRYGNDNGMSGVYASLHANISKESMSFSSLPMPDSYPVFPHHTQVLAYLESYAETFGLHGHIGLRTEVTSVRPVEGGGWEVTRRSRGGAEAETDRYTEVVVANGHHWDPRLPDPAVPGAGVFEGSAVHAHAYRSPEPYAGQRVLVVGMGNSGCEIAAEISRSAARTFLSARAVAHVFPKMLLGRPADHWAVSRAAVLPRFLKDPGMALLLRLARGAPALYGLPEPVRRPLAAHPSTSDELLVQLARGAVTAKPGIRSFGRDSVSFTDGSRETVDAVVYATGYSLSFPFLAPAVFAAPDGRTELYLRTVPPRLPGLFFMGLAQPAGAAFPLLEPQAEWIADLIEGEVLLPTPAEMTRSIARARERHDKVYAPSYRHGIEIDICAYRRALRRELRAGRRRARRADARRPDAPRPAPVSDTV

SEQ ID NO: 14850 - protein, 65 aa, Streptomyces coelicolor
MAKKQGAIEIEGTVVESLPNAMFKVELQNGHQVLAHISGKMRMHYIRILPDDRVVVELSPYDLTR

SEQ ID NO: 14851 - protein, 135 aa, Picea mariana
GGSSEEEFSCGEIEVHEVDPRAEDRELKDQLLRKYSGYFSSLKQEFLKKKKKGKLPKEARQKLLEWWNVHYKWPYPSETDKVSLAESTGLDQKQINNWFINQRKRHWKPSEDMQFVVMDSLNPHGASFYMDGTDC

SEQ ID NO: 14852 - protein, 368 aa, Streptococcus pyogenes
MEHKWKLWLFIVGVVLLIGGASVLIQKGQAKAFSQGKPQIPAKKVKSTKVDPNAPVDQKVIYLAGGCFWGVEEYFSQVDGVLDAVSGYANGRGDTTNYQLIHQTGHAETVEVAYDTNRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 14853 - protein, 180 aa, Physcomitrella patens
MASAVVNQSEAAAVRAPSKPVKTYSKENEQLVKQSWEILKKDAQRNGINFFRKVFEIAPGAKAMYSFLRDSTIPFEENPKVKNHARYVFMMTGDAAVQLGEKGAYQVLESKLQKLAATHVNAGVTDDQFEIVKEAILYAIEMGVPDLWSPELKSAWGDAYDMLAEQVKAEMHAQRSAATS

SEQ ID NO: 14854 - protein, 41 aa, Gossypium barbadense
CHTDTSAWNPKHLAFQVLKVEPGTVPVCHFLPRDHIVWVPK

SEQ ID NO: 14855 - protein, 447 aa, Schizosaccharomyces pombe
MSTPYEPEFQQAYKEIVGSIESSKLFEVHPELKRVLPIISIPERVLEFRVTWEDDKGNCRVNTGYRVQFNSALGPYKGGLRFHPSVNLSILKFLGFEQIFKNALTGLPMGGGKGGSDFDPKGKSDNEIRRFSQAFMRQLFRYIGPQTDVPAGDIGVTGFVVMHMFGEYKRLRNEYSGVVTGKHMLTGGSNIRPEATGYGVVYYVKHMIEHRTKGAETLKGKRVAISGSGNVAQYAALKCIQEGAIVKSISDSKGVLIAKTAEGLVPEEIHEIMALKEKRASIADSASLCKKHHYIAGARPWTNVGEIDIALPCATQNEVSGEEAAALIKQGCRYVAEGSNMGSSAEAVEVFEKSRASGEGCWLAPGKAANAGGVAVSGLEMAQNAQFSTWTHAEVDAKLAGIMQNIFEQSTDVASKYCDSGSNNIPSLVDGANIAGFLKVATAMQAV

SEQ ID NO: 14856 - protein, 197 aa, Triticum aestivum
GELGPTSHAPGRHGRGISVVAAEFSHCVHLVSWEKENVSSEALEAARIACNKYMTKHAGKDAFHLRVRVHPFHVLRINKMLSCAGADRLQTGMRGAFGKPQGVCARVAIGQVLLSVRCKPNNAIHATEALRRAKFKFPGRQKIIESRKWGFTKFNRNDYLKFKSEGRILPDGVKAKLLGCHGRLANRAPGQAFLSAA

SEQ ID NO: 14857 - protein, 580 aa, Mesostigma viride
LQSHLADVEKTHLRDLLRDEQRSSSCEVEHNGFFVDYARQRVTAETMNKLMALAKAANMKEKIQAMFAGDRINVTENRAVLHVATRAPKGEVIKVDGVNVVPDVYEVLDKIKSFSEKVRSGEWKGATGKPLKDVVCIGIGGSFLGPAFVHTALRTDHRAPLAASGRRIRFPSNVDPIDVARQLNGLDPETTLVIVVSKTFTTVETMLNARTVRAWITSNICVPDAVSKHMVAVSTDLALVKDFGIDPVNAFGFCDWVGGRYSVTSAVGILPLAIQYGYEHMERFLAGCWDMDTHFRDAPFDKNIPVLLGLIGVWNTQFLQCPTRAILPYCQALAKLPSHIQQLSMESNGKGVAMDGTELPFEAGEVEFGEPGTNGQHSFYQLIHQGRVIPCDFIGIIKSQQSVYLKNELVSNHDELMCNFFAQADALAYGKSAEELVAEGVAPDLVPHKTFTGNRPSSSILLPTLDAYTVGQLLSHYEHRVAVAGFIYGINSFDQWGVELGKVLAGKVRTTMNQARTKGVPITGYNSSTIALMNRYLSGKTKWLYPEPRDVFPSTSRQRVRPEPRRLWPLEGTSNADVGH

SEQ ID NO: 14858 - protein, 319 aa, Prunus mume
MENFPIINLEGLNGEGRKATMEKIKDACENWGFFELVSHGIPTEFLDTVERLTKEHYRQCLEQRFKELVASKGLEAVKTEVNDMDWESTFYLRHLPKSNISEVPDLEDQYRNVMKEFALKLEKLAEQLLDLLCENLGLEKGYLKKAFYGTNGPTFGTKVSNYPPCPNPELIKGLRAHTDAGGLILLFQDDKVSGLQLLKDGQWIDVPPMRHSIVINLGDQLEVITNGKYRSVEHRVIAQTDGTRMSIASFYNPGSDAVIYPAPTLVEKEAEEKNQVYPKFVFEDYMKLYAGLKFQPKEPRFEAMKAVETNISLVPIATA

SEQ ID NO: 14859 - protein, 246 aa, Oryza sativa
MDNQQLPYAGQPAAAGAGAPVPGVPGAGGPPAVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAGGPAGAVGAAGPAAGLPYYYPPMGQPAPMMPAWHVPAWDPAWQQGAAPDVDQGAAGSFSEEGQQGFAGHGGAAAGFPPAPPSSE

SEQ ID NO: 14860 - protein, 473 aa, Oryza sativa
MAERIAASLLPAASPSPAPSPPPPRPRVSAAAAASFPCCSTSAGGLRLRSRPSRFPQKAATTRSGRAGAGARAVVRCMAAAAVAASDAAQLKSAREDIREILKTTYCHPIMVRLGWHDSGTYDKNIEEWPQRGGADGSLRFDAELSHGANAVYVLESFEKKFLQEAGGPKIPMKYGRVDVTAAEQCPPEGRLPDAGPRVPADHLREVFYRMGLDDKEIVALSGAHTLGRSRPDRSGWGKPETKYTDFTKWVILTFLCMHIMKDGPGEPGGQSWTVEWLKFDNSYFKDIKEQRDQDLLVLPTDAALFEDPSFKVYAEKYAEDQEAFFKDYAEAHAKLSDLGAKFDPPEGFSLDDEPAVEEKDPEPAPAPAAAAPPPPVEEKKEAEPTPVPVTVGAAVASSPADDNNGAAPQPEPFVAAKYSYGKKELSDSMKQKIRAEYEGFGGSPDKPLQSNYFLNIMLLIGGLAFLTSLLGS

SEQ ID NO: 14861 - protein, 687 aa, Unknown
  Magnetococcus sp. MC-1
MEEILASLEEILDEAEDDQHGLEALRAKPYPSMAVGGEPTPRFEWADEDDTSEQNRLYMADPFAPDQAEEAGDGAVASEDEIVDLSGMETVAVVEEAVEEAAEEVAEEEAEEVAEEEAEEVAEEEAEEVAEEEAEQAVEEEAEEVAEEEAEEEAEEEAEEVAEEEAEEVAEKEAEEVAEEEAEEVAEEEAEEVAEEEAEEVAEEEAEEVAEEEAEEVAEEEAEEVAEEEAEEVAEEEAEEVAEEEAEEVAEEEAEEVAEEEAEEVAEEEAEEVAEEEGEEVAEEEAEEEAEEEAEEEAEEEAEEVAEEVAEEEAEQAAEEEAEQAAEEEAEEVAEEEAEQAAEEEAEEIAEEEAEEIAEEEAEEIAEEEAEEVAEEEAEEAAEEEAEEAAEEEAEEAAEEEAEQAAEEEAEQAAEEEAEEVAEEEAEQVAEEEAEQVAEEEAEEVAEEEAEEAAEEEAEQAAEEEAEEVAEEDAEEVAEEEAEEVAEEDAEEVAEEEAEEVAEEEAEEVAEEEAEEVVEEEAEEVAEEEAEEVAEEEAEEVAEEEAEEVAEEEAEEVAEEEAEEVAEEEAEEVAEEEAEEAAEEEAEEAAEEEAEEAAEEEAEEAAEEEAEQAAEEEAEQAAEEEAEQAAEEEAEQADEKGTVPDSVNAEAILALAREIAEQMIREQLPELLEKIIREEVERVRRGQ

SEQ ID NO: 14862 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVLVY

SEQ ID NO: 14863 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVQVY

SEQ ID NO: 14864 - protein, 316 aa, Escherichia coli
GTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATCDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGL

SEQ ID NO: 14865 - protein, 316 aa, Escherichia coli
GTTKHSKLLILGSGPAGYTAAVYAARANLQPVLITGMEKGGQLTTTTEVENWPGDPNDLTGPLLMERMHEHATKFETEIIFDHINKVDLQNRPFRLNGDNGEYTCDALIIATGASARYLGLPSEEAFKGRGVSACATSDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGL

SEQ ID NO: 14866 - protein, 314 aa, Leptospira interrogans
MHSLMKPTREPQINLFKKSNPYKAKVISNVLLTPETGTGKRPKKEGEALVHRIVLAIDHSAYPYVIGQSGGVIPPGEDPEKKAKGLADVGYTVRLYSIASPSYSFGMKEDNIEFIIKRDNIYDENGNIQFKGVCSNYMCDLKPGDEVTMTGPSGKKFLLPNTDFSGDIMFLATGTGIAPFIGMSEELLEHKLIKFTGNITLVYGAPYSDELVMMDYLKGLESKHKNFKLITAISREEKNSFDGGRMYISHRVREQAEAVKKILNGGGRFYICGGPKGMEKGVIEEIQKISGNTGTYEEFKHHLEGAHQLFVETY

SEQ ID NO: 14867 - protein, 142 aa, Zea mays
MVTSTTAAAVLSPPSVAGLRLAPSPRARVAFRAARARRSVAARAELSPSLVISLSTGVSLFLGRFVFFNFQRENVAKQVPEQNGKTHFDAGDERAKEFSGLLKSNDPVGFNLVDVLAWGSLGHIVAYYILATSSNGYDPNFF

SEQ ID NO: 14868 - protein, 265 aa, Glycine max
  misc_feature (61)..(61): Xaa can be any naturally occurring amino acid
  misc_feature (74)..(74): Xaa can be any naturally occurring amino acid
MTLFLLRHTHMLRSLAVTIMFWYNNIFVSFIINNLLPYLKVPTGGIPAPGKSQPLGTISAXAPWGSALILPISXYSYIAMMGSKGLTEASKTAILNANYMAKRLENHYPVLFRGVNGTVAHEFIIDLRGFKNTAGIEPEDVAKRLMDYGFHSPTMSFPVPGTLMIEPTESESKAELDRFCDALISIRQEIAEIEKGNADFNNNVLKSAPHPPSLLMADAWTKPYSREYAAFPAPWLRASKFWPTTGNHVVVYITICFSFQEIITM

SEQ ID NO: 14869 - protein, 430 aa, Arabidopsis thaliana
MAQILAASPTCQMRVPKHSSVIASSSKLWSSVVLKQKKQSNNKVRGFRVLALQSDNSTVNRVETLLNLDTKPYSDRIIAEYIWIGGSGIDLRSKSRTIEKPVEDPSELPKWNYDGSSTGQAPGEDSEVILYPQAIFRDPFRGGNNILVICDTWTPAGEPIPTNKRAKAAEIFSNKKVSGEVPWFGIEQEYTLLQQNVKWPLGWPVGAFPGPQGPYYCGVGADKIWGRDISDAHYKACLYAGINISGTNGEVMPGQWEFQVGPSVGIDAGDHVWCARYLLERITEQAGVVLTLDPKPIEGDWNGAGCHTNYSTKSMREEGGFEVIKKAILNLSLRHKEHISAYGEGNERRLTGKHETASIDQFSWGVANRGCSIRVGRDTEAKGKGYLEDRRPASNMDPYIVTSLLAETTLLWEPTLEAEALAAQKLSLNV

SEQ ID NO: 14870 - protein, 127 aa, Dechloromonas aromatica
MRILHTMIRVGDLDKSIAFYTEILGMQLLRRQDYPDGRFTLAFVGYGPEDKEAVLELTHNWDTPSYELGNGYGHVALAVPDAAGACAEIKALGGKVVREAGPMKHGSTIIAFVEDPDGYKIELIQRG

SEQ ID NO: 14871 - protein, 99 aa, Zea mays
SPCQSQSPSPYLALFFFWFGGKGFSPIVRLGPCPGPPIKFFSGGQNVFKFKINPGSVFGVFAPRAKKIFSFFFPPFFPLALWFQQIFMHPPVVTLPFRG

SEQ ID NO: 14872 - protein, 610 aa, Wolinella succinogenes
MCGIAGTLNSSCFSSKKLLAALAHRGPSGHGEFSHQGVNLFHARLSIQDLSPAGAQPMHRHHLSIVFNGEIYNHLELRAKVADYPFSTRSDTETILALFERFGERSLEWMDGMFALAILDQRTHKLFLARDRMGKKPLFYYQEGEEFLFASELNALLTLKPLQIDHAKLSAFLRCGFFPHDGAPYQGVQSLPQGSYAFIDLHHPRPLSPQRYFDLLSLYQAPKIEGFEASKEAVELALKESVKNRLESSDLEVGSFLSGGIDSSLITALASFFTPKLKTFTVAFEGAYDESSLAELVAKRYKTDHTTLHLNPSKLKEEVKGILACYGRPFMDSSAIPSYYVSQEAKKHLTVILNGDGADELFGGYRRYVPMSHGWLKLARPLSLLLPLLPLPKEKKSLYNYLHRLLAMSRKRGLDFYLSATIDSFEDAYAFSPNPHTQTLDQEITQILEDSSLSSLSKMLYLDSQNLLLSDLLPKMDIATMAHSLEGRSPFLGKSLLEVAPRIKDEYKIFGKSTKFILRELAKKYLPHALLEQPKRGFEVPLRAWVEGELKELIFDSLSKNCLSRELIESRFVDALLDKPQDFAPEKRAKMLWSLFSLEVWHEHYQKACE

SEQ ID NO: 14873 - protein, 491 aa, Haemophilus somnus
MESVELLANITPSETRIALVDNGILKEVHIERQAKRGSVGNIYKGRVTRVLPGMQSAFVDIGLEKAAFLHASDIVSHTECVDVDEQKQFVVKDIAQLVHEGQDIVVQVVKDPLGTKGARLTTDITLPSRYLVFMPENSHVGVSQRIESEEERARLKELVLPLCDELGGFIIRTAAEGATETELVQDAEFLKRLWRKVLERRAKYTTRSMLYGELALTQRILRDFIGANFSKIHIDSKLCFSEVKQFTEEFMPELTDKLVLYSGSQPLFDVYSVENAIQTALNSRVNLKSGGYLIIEQTESMTTIDINTGAFVGHRNLEETIFNTNIEATKAIAQQLQLRNLGGIIIIDFIDMQTEEHRDRVLESLRLALSKDRVKTNVNGFTQLGLVEMTRKRTRESLEHILCDECPTCSGRGSVKTVETVCYEIMREIIRVNHLFASEKFVVYASRAVADYLINEESHGLLAELEVFIGKQIQIKTEVYYSQEQFDVVVM

SEQ ID NO: 14874 - protein, 448 aa, Unknown
  marine gamma proteobacterium HTCC2143
MQTDSHASDSIPHLKPIESGFFETLRIMKKSYNSPLEHCQTMQKEHGNAVMQKMGKLNYVHLFGADANHLAVMNPNQILSNKNSWDLIIGRIFTNGLMLRDGDDHRYHRRIMQAGFKAKAMKSYMATMVDLVPDAIADWPTGDGDIMLAYPAFKQLTLDLAATIFLGMDLGDEATKINKAFETCVAASMPKIPVAFPGTILWRGIKAREYMCSFFHSCIAEKRAGNGNDMFSLLCNAKDEEGNQYTDQEIVDHMIFLMMAAHDTTTSTLTSMTYALAKNPEWQERLYQEVQSLEIDQLNYENLDKMVETEWVMKEALRMYPPLSTLPKFSLKEFEYDGRLIPAGAMVITYPIHTHYMDEYWDKPTTFDPLRFSEERSEQKRHASSWIPYSGGAHMCIGLHFAVMQIKLVMFDMLKRYRWSVPADYDMPVQQSPISKPKDGLPISLELR

SEQ ID NO: 14875 - protein, 178 aa, Unknown
  Dehalococcoides sp. BAV1
MNEIAVFGGGCFWCMEAVFSSLSGVTKVESGYAGGTLPNPTYQQVCAGDTGHAEVIRLEFDAALISYTALLDIFFQMHDPTTLNRQGEDVGSQYRSVIFYTTPSQKAQAEKTIKTLDENGAFTKRIVTEVLPLTEFYPAEDYHHNYYASNSSQPYCRFVIQPKLAKLKEHLPKLRKTV

SEQ ID NO: 14876 - protein, 599 aa, Triticum aestivum
MAALVTSQLATSGTVFSVTDRFRRPGFQGVRPRSPADAPLGMRTTGASAAPKQQSRKAHRGTRRCLSMVVRATGSAGMNLVFVGAEMAPWSKTGGLGDVLGGLPPAMAANGHRVMVISPRYDQYKDAWDTSVVSEIKVADEYERVRYFHCYKRGVDRVFVDHPCFLEKARGKTKEKIYGPDAGTDYEDNQLRFSLLCQAALEAPRILDLNNNPYFSGPYGEDVVFVCNDWHTGLLACYLKSNYQSSGIYRTALVAFCIHNISYQGRFSFDDFAQLNLPDRFKSSFDFIDGYDKPVEGRKINWMKAGILTVSPYYAEELISGEARGCELDNIMRLTGITGIVNGMDVSEWDPIKDKFLTVNYDVTTALEGKALNKEALQAEVGLPVDRKVPLVAFIGRLEEQKGPDVMIAAIPEILKEEDVQIVLLGTGKKKFERLLKSVEEKFPSKVRAVVRFNAPLAHQMMAGADVLAVTSRFEPCGLIQLQGMRYGTPCACASTGGLVDTIMEGKTGFHMGHLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 14877 - protein, 470 aa, Unknown
  Photobacterium sp. SKA34
MDYLPIFADLKRRPCLVVGGGDSAWRKTRMLLKAGADVRVIAPSLNADFTAALASQQIKLVGEHFSPSDLDGIFLAIAATERKAINALVYQSANQRQVLVNVVDDTQRCSFIIPSIVDRSPIIVAISSSGKAPVLARLLREKLEALLPQHLGRMATIAGNFRQRLSQTVSSFSARRYFWEQAFNGRFGDLVASGREQEAEQELVALTQQAPPQGQVALIGAGPGDAGLLTLRALQLMQQADVVLYDYLVSDEVMDLVRRDAELVCVGKKAGFHSVPQEETNRLIVHYAQQGKRVVRLKGGDPFVFGRGGEELEVLFDADIPFQVVPGITAAAGATAYAGIPLTHRDYAQTAMFVTGHLKPDGDTLDWLTLARGKQTLVIYMGLMKSSHIQQQLLEHGRGADTPIAIIERGTQKNQKVLKGQLSELAELAKHAASPSLIVVGEVVNLSTKLDWFTKQEQSLQQQDAVVKLA

SEQ ID NO: 14878 - protein, 188 aa, Methanosarcina acetivorans
MEGNEKAEQKNATSEESTDIFENPGEGLEKATFAAGCFWGIEEAFRQVKGVVATAVGYSGGHFEKPTYEQVCTLDTGHAEAVRVIFDPKVVSYKNLLDVFWKIHDPTTKNRQGPDVGKQYRSVIFYHNEEQKAAALASKEELEKAGVFKNPIVTEIVPVSEFYMAEDYHQQYFEKKGFLQNILRSFKK

SEQ ID NO: 14879 - protein, 379 aa, Zea mays
  misc_feature (173)..(173): Xaa can be any naturally occurring amino acid
MEAGGAGSGLNGAVQAKGTGADDGSAKRLPPCCVKARAAAPESEARCHATVVSGWFTEPRSRCGKASKVQYYNNPMWPGEANSLKVEKILYQGKSLYQEVLVFESSTYGKVLVLDGIVQLTDKDECAYQEMITHLPLCSIPSPKKVLVIGGGDGGVLREVSRHSSVESIDICXCKDFFPHLSVGFQDPRVQLHVGDAVEFLRNAPEGTYDAIIVDSSDPIGPAQELVEKPFFDTIARALRPGGVLCNQAESMWLHTHLIQDMLSICRETFKGSVRYAWTSVPTYPSGVIGFLLCAKEGPLVNFLTPINPIEKLEGATKAGREIRFYNSEMHRAAFVLPTFARRELEAYCVSTETEQAEETPAAPLKLTLASRSEIFATS

SEQ ID NO: 14880 - protein, 346 aa, Bacillus clausii
MMEYDVVVIGGGQAGLAVGYYLKKQKRPFLIVDEQNEAGDSWRKRYDSLVLFTPRCYSSLPGLDFSGDPNGYPSKDEMADYLWTYKETFQLPVVYETKVEKLEKTRDRFKVWTSEGKIYDAKQVIIATGAFHTPFIPPLANSIQPGIAQLHAFDYKGPEQIVAGPVLIVGAGNTGVQIAAELVEHHDVVLACGNKPNVLPQSVLGKNVFWWFDKLGLSKATVHSPLGKWLQKRDPIIGNDFYTVRKRAKLKGRLINVTDSKAYFAEGSPVSVQTIIWATGYRNDYSWIDIDGVFDQEQKPIHVRGVTNVNGLFFVGLSWQYKRGSALVKGVGEDAAYMVSQLSKHS

SEQ ID NO: 14881 - protein, 409 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMSVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNI

SEQ ID NO: 14882 - protein, 353 aa, Nicotiana sylvestris
MEVISTNTNGSTIFKSGAIPMNGHQNGTSKHQNGHKNGTSEEQNGTISHDNGNELLGNSNCIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFNDPRVTLVLGDGAAFVKAAQAEYYDAIIVDSSDPIGPAKDLFERPFFEAVAKALRPGGVVCTQAESIWLHMHIIKQIIANCRQVFKGSVNYAWTTVPTYPTGVIGYMLCSTEGPEIDFKNPVNPIDKETAQVKSKLAPLKFYNSDIHKAAFILPSFARSMIES

SEQ ID NO: 14883 - protein, 790 aa, Arabidopsis thaliana
MEMGVMENLMVHTEISKVKSQSNGEVEKRGVSVLENGGVCKLDRMSGLKFKRRKVFAVRDFPPGCGSRAMEVKIACENGNVVEDVKVVESLVKEEESLGQRDASENVSDIRMAEPVEVQPLRICLPGGDVVRDLSVTAGDECSNSEQIVAGSGVSSSSGTENIVRDIVVYADESSLGMDNLDQTQPLEIEMSDVAVAKPRLVAGRKKAKKGIACHSSLKVVSREFGEGSRKKKSKKNLYWRDRESLDSPEQLRILGVGTSSGSSSGDSSRNKVKETLRLFHGVCRKILQEDEAKPEDQRRKGKGLRIDFEASTILKRNGKFLNSGVHILGEVPGVEVGDEFQYRMELNILGIHKPSQAGIDYMKYGKAKVATSIVASGGYDDHLDNSDVLTYTGQGGNVMQVKKKGEELKEPEDQKLITGNLALATSIEKQTPVRVIRGKHKSTHDKSKGGNYVYDGLYLVEKYWQQVGSHGMNVFKFQLRRIPGQPELSWVEVKKSKSKYREGLCKLDISEGKEQSPISAVNEIDDEKPPLFTYTVKLIYPDWCRPVPPKSCCCTTRCTEAEARVCACVEKNGGEIPYNFDGAIVGAKPTIYECGPLCKCPSSCYLRVTQHGIKLPLEIFKTKSRGWGVRCLKSIPIGSFICEYVGELLEDSEAERRIGNDEYLFDIGNRYDNSLAQGMSELMLGTQAGRSMAEGDESSGFTIDAASKGNVGRFINHSCSPNLYAQNVLYDHEDSRIPHVMFFAQDNIPPLQELCYDYNYALDQVRDSKGNIKQKPCFCGAAVCRRRLY

SEQ ID NO: 14884 - protein, 2145 aa, Podospora anserina
MPRNDASSRFSSMTGSSTDSARSNITVKPLPSLPPSASSSSPFAASSNQTSNASRSASHGSRRAAPSRLKTDENGQLSRSFKDSDAQVSPTSTSPCVSPSSITSSNSIREHRMSDLADYRRDLAILDPAGGRASRTQQNNPSSGSLSQIAPWMAAAPTPASSGPLPTSFFNDSTDNLSLSSQTSPGLRNATARPSQTTTGSTESPETLYFTDERRPSIASITTTASSQGSRASGARGGIRKLQGFFGEEFPGRDSSEISLSHPIVGKEHRSHSYSHARPHRDRNYSNATDHGRDASPASRPRTPVPKPEVVPFLYQEADDIARYGEAPVRDILSGPDRERFVNDSSQQNNPPKTSGSGRSGHSIGVHLTGHHHRHNKSNEDPRSLRPTVSREDSTISVPKDRNGSSTMYGTRSRAQSPAPSTTGSYWGHKSGSTDGQTSPGQPKKSFLGRLGRRLKEKDDAPDLKKLGPASQSSLHSRPSRQELSKADGQFARGADGKYQPDVRDGIRPDLARPANGPQTFNKFSLSKKAPRSKTQDDLDEAIGPTDRQDVGTVFHLDTNLNNMDGILSKPAPLTPMNAHEIFDEVGSGKGSISYPSSNGAWNAPDSWAVLRDDDAGAQLPDTEDIGSPPRPEEKQHNYCIRVFRADGTFATLQMPLLTSVSELINQIVKKSYLQDPDKFKLVLKKHDLYKVLQSTDRPLLLQKRLLEQVGFEERDRIEDIGREDNSYLCRFLFYPFTDNSYEVMDQMEFLRSQKNNHIDLSGRSLSAIPVQLYPRANEIISLNLSRNLSLQVPRDFISVCPNLRDIKFNNNEARALPKSFGYASRLTMLDASNNRLESLESAALHNLTGLLKLNLANNKLKQLPREFEAFAVLRTLNISSNLLNNFPPFLAKLENLVDLDLSFNTIQSLPDNVGQMTSLERLVITNNELSGSLPPSFKNLRSLRELDIKYNAISNIDVISQLPKLEILSATRNNISQFSGTFERVRSIKLNWNPITKFEIKAPVPTLKALNLSNAQLASIDESFHNMSNLERLELDKNYFVSLPAHIGNLRRLEYFSIAHNSVGELPPEIGCLTELKRLDVRGNNIRKLPMELWWANKLDYLNASSNVLENFPKPASRAPHPPGETNGNTSFPTGRIGPPTGALSQTPSAEELNDPSRRPSQASSSLLSVGPSPVPGGADRKSSMVSVYGKGGRKTSVISRSTTQSSTALATPTASSRKDSSHTQRLTNTFAGSLRYLYMADNQLDDDCFDQLCMLENLRVLNLSYNDLSDMPQRSIKSWPQLVELYLSGNELASLPADDLEEYSMLQTLHINGNKFTNLPADISRAKKLTVFDCGSNSLKYNIANVPYDWNWNLNPNLRYLNLSGNRRLEIKQSSVPTAAQNREQYTDFGRLTNLRVLGLMDVTVLNSTLPDQSEDRRVRTSGSLAGYMPYGMADTLGSKNEHLSTIDLVVPRFNSNDSETLLGLFDGQALSSGGSKIAKYLQENFGHIFSQELRDLKNTENPADALRRSFLSLNKDLIAAGNTHTEDRSLMVHRGSTAPLVLSREDMNSGGVATIVYIQNQDLYVANVGDVQAMIIKSDSTHVMLTKKHDPADPNERTRIREAGGWVSRNGRLNDLLEVSRAFGYLDLMPAVQSAPNIEKHTIGEHDEMILIATREVWEYLPKDVLVDVTRSVRQDPDPMRAAQKVRDLAMAYGCSNKMTVQMLGVSNLKARRERSRQHKGQSMPVYASLQDDGGSSTGMRRARKARDGPLDSTLGRLDAEVPAPTGLIAIVFTDIKNSTQLWETYPEAMRTAIKNHNELMRRQLRTIGGFEVKTEGDAFMVSFPTATSALLWCFAVQCKLLHLDWPAELYNSVNCQPVYDRDNNLIFKGLSVRMGIHWGEPLSEPDPVTRRMDYYGPMVNKASRISACADGGQIAVSSDFIAEIQRCLEHYQEPTSTAVDLNEDSFATAIRSELRSLSGQGFEVKDMGEKKLKGLENPEFIYSLYPHALSGRIETHSKHEKEQAQDLREIRPAILSPGSELSVEPDDIWSLWRVALRLEMLCSMLEDNSKALQPPETGLLDRMRQRGGEVSEDFLVNFLDHQVSRIETCINTIYMRHLVSQSSIGSNFGALRGPMDEVLKVVAEQFQLVAEYKARYGDLRA

SEQ ID NO: 14885 - protein, 448 aa, Aspergillus nidulans
MFIGGLNWETTDQSLKEYFSQFGEVQECTVMRDSATGRSRGFGFLTFKDPKTVNTVMVKEHYLDGKIIDPKRAIPRDEQEKTSKIFVGGVSQEATEQDFKQFFMQFGRVIDATLMIDKDTGRPRGFGFVTFDSEAAVEAALSRPLEILGKTIEVKKAQPRGNLRDDGDRGRRGRDFRDGSQGGSDGSQQQAGAQGQGVMPGGLTPQMMAQYWQRMQQYFALMQQQMAVAATQGQGMGAMGMAGMNPALMQQMQMKQLQQMQMGNNQQSPSMSPPAQSPTPQSMQNMMNPAMMQQMQQQMPNQGQANNMGGQMGMGGNGSGNMNMGSNYAGGGRGGPGYNAHEQIAFEQQKYEQQQARRAMENRAFSPYQQGGPTSWEGMYDEVPQPNIPTGPQAMNRSSSVGRGQTPQPQGAAPANAPTGPKNAGKPGANYRGGGRGGHRGFHPYARG

SEQ ID NO: 14886 - protein, 319 aa, Nicotiana sylvestris
MEVISTNTNGSTIFKNGAIPMNGYQNGTSKHQNGHQNGTSEHRNGHQNGISEHQNGHQNGTSEHQNGHQNGTISHDNGNELQLLGSSNSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFSDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPT

SEQ ID NO: 14887 - protein, 329 aa, Hordeum vulgare
MGEFFNFLLWQWNSATTLPGVESIGVCYGMSANNLPAASTVVNMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNLFDTTVDAFYTAMAKHGGSNVKLVVSESGWPSAGGTAATPANARIYNQYLINHVGRGTPRHPGAIETYVFSMFNENQKDNGVEQNWGLFYPNMQHVYPISF

SEQ ID NO: 14888 - protein, 1551 aa, Kluyveromyces lactis
MSQNNDSRDEAYVREQFQRYTTKMASNKNSNTDSKCRSTSHLNSLASISSDTSNETLKGNLSAASPTFSSDSTLSTKKLPVLQTLPTSLPNGQHQQGQLFPASSSSSSAISSRKPSVSGSFGTQTPTTAQLKTITSPKLSGALSTRSRSNSLTSSKLFALNQSNDSPSSTSVYPVPPNVASLNSQTASSMSVSTSADQYFPAQQNGSTTTVNLTPTLSSPSIRSLNNSTTSTTKSFKPLQKQYVLNEQLYLSSMKNKKADDYYTRGITSSGNEDDDDFRVDGENDDVDNDLSKLNNGLGSAIFGNNIATTTDKGFHSIDDDELVLMNDKILLERMEWLRSVEPNNPLIENSLNLLNKTGGSTDSLESFSNIETQLALEQLSNNHLVRERLEWQTMLSSVLNGDIVKSEKTKLAKRKPDEILLNHNDLIWLELKAWLNGRTVEDQRKSLEYSKTTADEVFEEILNYKNEKEENPEVVIEEAKILLNKYYKVVGYWKNLPNMNLEKPVTKTSNFVSRIEALNSLINSYEGLQYEIEALKQWTQNDDLDVTFTKDSLDTEGIFKNDRSFAEQIMKEKDIEGIFQKKIFFKHAPWMFKSKLVFLKQQNSIHEMRLPLPVDKLHSLLTFPLRLIQEIISIRLEYARKLKKPTMMMIDQMIDDFSTYIKLSVQIKHTLMEYRSGWSLKVEISDAFDAKVVEAIEFLFKLLHLKLIDSSKNSFKTFKEPDILFAHWENLKNFGCYISGASKVIAQGFVNITIRLLNRLHLYIMEEQRNSVDLVTSDDARKWVVEVIENVGAFKRKTNRFSNVLTKAFQNSVLYNIKDHSMLLERLRNSGHFLIYTGGILEQNGIYLIASEELLGCSDDEIMDIIKSTKIGSDLIPKVEINNSLTIYNPPEDLTLPEAMFVQKERRNGVSYYHLKQDDLTQRVGIRGKGGSSTAPEEEGEELVQLENKLKMLGYVLVFCPTKPMVWNGEMYNLTSEEPLTMEEFGLSVEEDVIVMLNQGSTYALDYQVDRFQHFAGDAISIREKKCAINSIETALQRINKSYFRMTYIVLKNFGSVQKNVTLQTNESVFFNIAYLFVKDFAKNFLLLNVATPETKAIIIRLMIQISIDWLTFVLDECDPANPETFRWCVPAMEFAMRMTNGWNILGIEEKEFKLLKEKIARCMSLLISHFDITGARSREAERIDAQQTRPNFDIDDADDDMILAVNSEMRMNAITDMEKVVKVKRHYSVGKVIDDTDNQSKLLKSLASSISNLSIRWQKRSFIGSGSFGTVYSAVNLDTGDILAVKEIKIQDAKSMKQIFPSLKEEMRVMEILNHPNIVQYYGVEVHRDKVNIFMEFCEGSSLASLLEHGRIEDEMVTQVYTLQLLEGLACLHQSGVVHRDIKPENILLDRNGVIKYVDFGAAKLIAKNGSKRISLDANNKSTGGKDMIGTPMYMAPETVTGQGHGKFGSDDIWSLGCVVLEMVTGRRPWANLDNEWAIMYHVAAGHLPQFPTKSEISSAGRKFISRCLIQDANKRATAMELLLDPWISQIRNIAFGGNAESFNNETHN

SEQ ID NO: 14889 - protein, 471 aa, Unknown
  Candidatus Protochlamydia amoebophila UWE25
MTNPSIVWFRQDFRLEDNPALNAATQKGGPVIPVFNWVFNPEKEWQLGGASQWWLYYSLISLKNDLSELGLSLIIRKEDPLKSLLEIAHETGADTVYWNRRYEPMLIQDDAKIKTELQKQGIKAHSFNGNLLFEPWTIANKQGKPFQVFTPFWNQCLKLNDPEVPLPVPHSLKKFVGQLQTESIDSLNLLPKIKWDKGLKEVWSPGAKSAKALLKKGLTGVIDQYLDIRDLPDHDGTSLLSPYLHFGEISPRMIWQAVKENSTSKGAEGYLRQIGWREFAHHLLYHFPETPQKPLRSQFNSFSWKNDKQNLKAWQKGQTGYPIIDAGMRQLWKIGWMHNRVRLIVGSFLVKDLMIHWIEGAKWFWDTLVDADLANNTMGWQWIAGCGADAAPYFRIFNPITQGEKFDPEGNYVKKWVPELINLPKEWLHQPWEAPEEILRQSGIELGINYPKPIVNHAKAREEALQAYSRL

SEQ ID NO: 14890 - protein, 430 aa, Nicotiana sylvestris
MEVISTNTNGSTIFKNGAIPMNGHQSGTSKHLNGYQNGTSKHQNGHHNGTSEHRNGHQNGISEHQNGHQNGTSEHRNGHQNGTSEHRNGHQNGISEHQNGHQNGTSEHQNGHQNGTSEQQNGTISHDNGNELLGNSNSIKLGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPINPIDKETTQVKSKLAPLKFYNSDIHKAAFILPSFARSMIES

SEQ ID NO: 14891 - protein, 616 aa, Actinobacillus pleuropneumoniae
MKAIKQCSQSYVNWVLRLGRGKAALLGFFVLASCAIVAQSLLTYLFTGGILAQDILRSISFGLISAPFVIYFFNLIVEKLEKSRIQLEQSVYDLGILREQDAFLNATLEKNNRDKSVLMATISHELRTPLNGIIGLSRILLEGELTDQQREYLKTINISAVSLGHIFSDIIDLEKIDSRRVELFRKEIEFSQLISDISNFGNLMAEQNKIKFHIDYSDDLPNFIYVDNARLSQILWNLVSNAVKFTPAGGDIYLSVKRIDNDHFSFSLRDTGIGIPKHEQRKVFAMFYQAENSQERKAQGSGIGLAISKRIAKLMGGDLTLRSEMGKGSTFTLTIQADPVEAKKSVKINAHALKVLLVEDIEVNVVVARAMLEKFGCDVDVAMTGAQAFELFERNSYDLILLDIQLPDMTGFDIAQRLRERYENEEVDYLPLLVALTANIMQTKEEYQQQGMDDVLRKPLSLEALSECLNHYFNSDFSEKTAEIPPLVETEETLNLPYDRKILSEFIEVMGAKAVLANFALFAKLMPEYLANLQHYLTEWQATDSPEMRKCTADEAHKIKGALASVSLKRLQEVAQLAQSDNGEVWEQHIAQWVFQIAQQWQADLALAENWVKENY

SEQ ID NO: 14892 - protein, 537 aa, Streptococcus dysgalactiae
MQKQWWHKATIYQIYPRSFKDTSGNGIGDLKGITSQLDYLQKLGITAIWLSPVYQSPMDDNGYDISDYEAIAEVFGNMDDMDDLLAAANERGIKIIMDLVVNHTSDEHAWFVEARENPNSPERDYYIWRDEPNNLMSIFSGSAWELDEASGQYYLHLFSKKQPDLNWENAHVRQKIYDMMNFWIAKGIGGFRMDVIDLIGKIPDSEITGNGPRLHDYLKEMNQATFGNHDVMTVGETWGATPEIARQYSRPENKELSMVFQFEHVGLQHKPNAPKWDYAEELDVPALKTIFSKWQTELKLGEGWNSLFWNNHDLPRVLSIWGNDSIYREKSAKALAILLHLMRGTPYIYQGEEIGMTNYPFKDLTEVDDIESLNYAKEAMENGVPAARVMSSIRKVGRDNARTPMQWSKDTHAGFSEAQETWLPVNPNYQEINVADALANQDSIFYTYQQLIALRKDQDWLVEADYHLLPTADKVFAYQRQFGEETYVIVVNVSDQEQVFAKDLAGAEVVITNTDVDKVLETKHLQPWDAFCVKLSV

SEQ ID NO: 14893 - protein, 429 aa, Triticum aestivum
  misc_feature (367)..(367): Xaa can be any naturally occurring amino acid
  misc_feature (377)..(377): Xaa can be any naturally occurring amino acid
  misc_feature (417)..(417): Xaa can be any naturally occurring amino acid
MAPEPEDDIMAEKNPRPLDEDDIALLKTYGLGPYSTSIKTAEKEIKELAKRINDLCGIKESDTGLAPPSQWDLVSDKQMMQEEQPLQVARCTKIINPNTDDAKYMINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIIFFDEVDAIGGARFDDGAGGDNEVQRTMLEIVNQLDGFDARGNIKVLMATNRPDTLDPALLRPGRLDRKVEFGLPDLEGRTQIFKIHTRTMNCERDIRFELLXARLCPNATGXADIRSVCTEAGMYAIRARRKTVTEKDFLDSVNKVIKGYQXKFSATPKYMVYN

SEQ ID NO: 14894 - protein, 371 aa, Archaeoglobus fulgidus
MAIYAFPEFDGESRRASRIYASARYPSRQEGNVFFDSEEVPNLKYADEMPLKIRNFYSVVAFRPSHIFLSRDVLGGRPLYYGSDMSISSFKSYIDGEVYEVMPGEVVKMDYTGEILERRKYAFEDVFRVGREDVNEMADRILNSLSSYKPRVGCIAFSGGVDSSLLAALYDAPLVSVTASDAEEEWLKTAARMLGKEIEILKVGESAIREVVDTVRKTIETGDFLQLSIAVPVYLTMQFAKSLGFTEIIFGQGADELFGGYKRYEGLSEHELEDALVKDLKSIGESNLVRDCKLAYKNEIKLVTPYLCWDVIDAALKIPPEYKVRREGGKVVRKYILRKIAEKFLPEEIAWRDKKAIQYSTGIAKILKKCL

SEQ ID NO: 14895 - protein, 302 aa, Leuconostoc mesenteroides
MKFAMIGLGKMGLNLVKNAVDNGHEVVAFDLNADFVKEATDYSASVEAASDIDDMLSKLPSPKAVWVMVPAGVPTNSTIDTLIEKMDKGDIIIDGGNSNYKDNLEQNKRTSAAGIKFFDAGTSGGMNGARNGGNFMIGGDDAEAWKIIEPLFKSISEEDGYLYTGRLGSGHYLKMVHNGIEYGMMQAIAEGFEVLEASQFDYDYEAVSKLWNHGSVIRSWLMELAEEQFAKDPHLDAIAGRMHSSGEGKWTVQESLDLDVPAPVIYLSLAMRYRSLQDDTFTGKVVSALRNGFGGHAMDAAK

SEQ ID NO: 14896 - protein, 318 aa, Prochlorococcus marinus
MEIIESDVVIIGGGPAGCTCALYTSRSNLKTVILDKNPSVGALAITHQIANYPGVPVDISGEKLLTLMRDQAVQYGTDYRRAQVFGIDATGEWKMVYTPEGTFKAKALVLASGAMGRPASFKGEADFLGKGVSYCATCDGAFYKNREVAVVGVNKEAIEEATVLTKFASTVHWITSSDPKSDNEEAMELMDNSNIKHWSRTRLLEILGDDLGVNGVVVKNKQEENPINLNLDGVFVYMSGSKPITDFLGDQIALKEDGGVIVDDFMSTNSDGVWAIGDIRNTPFKQAVVAASDGCIAAMSIDRYLNSRKNIRVDWIHS

SEQ ID NO: 14897 - protein, 554 aa, Unknown
  Shewanella sp. MR-7
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNFYVASEMKALMPVCKTVAEFQPGQYLYSTTGEPVQYYTRDWQSFDAVKDNAASQEELREALEAAVKRQLMSDVPYGVLLSGGLDSSVISAITQTFAKRRIEDDDQSGAWWPQLHSFAVGLKGAPDLAAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLASAAETVPGGKSVACSTPEALAWDESLRGIIDPSGRAVRSVHAASY

SEQ ID NO: 14898 - protein, 593 aa, Rhodobacter sphaeroides
MRMTTEEAFVKVLQMHGIEHAFGIIGSAMMPVSDLFPKAGITFWDCAHETNAGLMADGFTRSTGKMSMAIAQNGPGVTGFVTPVKTAYWNHTPLLLVTPQAANKTIGQGGFQEMEQMRLFADCVCYQEEVRDASRIPEVLNRVILQAWRNSAPAQINIPRDMWTQVIDVELPQIVAFERPAGGEEAVAEAARLLSGARFPVILSGAGVVLSGAIPDLARLAERLDAPVASNYQHNDSFPGSHPLAVGPLGYNGSKAAMELIARADVVLALGTRLNPFSTLPGYGIDYWPREARIIQVDINADRIGLTKKVTVGIQGDAAKVARAILAQLGEGAGDAGREERRHLVAQTKSRWAQELSSLDHEEDDPGTEWNAGARTRDADLMSPRQAWRAIMQAVPAEAIVSSDIGNNCAIGNAYPSFEAGRKYLAPGLFGPCGYGFPAILGAKIGNPDTPVIGFAGDGAFGISMNEMTACGREDWPAITMVIFRNYQWGAEKRNTTLWYDNNFVGTELDRDTSYAAIARACGAHGVQVRSQSELTAALHEAVERQMKARETTFIEVLLNQELGEPFRRDAMKKPVVVAGIDPADMRPQKGAA

SEQ ID NO: 14899 - protein, 327 aa, Agrobacterium tumefaciens
MQREKIVVIGAGAFGTALAVVIALENRHDVTLLGRDPSLMADLRNERVHEAALPGVELPDALGFSAEPDVLAGASIVLFAMPSQAHADAAQHYGPYLASDSIIVTCAKGIDRNSGRLLTELLETELPHHPIAVLSGPGFAADIARGLPTAMAIAAEDATVAERLATTISGKTFRLYASTDRIGVQLGGALKNVLAIAAGIVEGAGLGDSARAALISRGLAEMSRLIVAMGGKADTVRGLSGLGDLVLTATSHQSRNLRFGIALGRGEGKDMSGGLVEGAFAAAVAARLGEHHAIDMPVTEAVAAIIDGNLDVASAMQQLMTRPITTE

SEQ ID NO: 14900 - protein, 341 aa, Salinibacter ruber
MSSITLFGAGSWGTAMSVHLASAGRDVVLWARRPEVADEIRRTSHNPTYLPELLIPSSVYITTDLEKAAEASDLWGMAVPSQQLRGRAEHLRPHAHSGVRLVALSKGIENETLLTMSQVLDDVFESVPSDQIGALYGPSHAEEVAEGRPTAVVAAAPDEGEARHIQKVFMTERLRVYMNTDVLGVEIGGSAKNVLAIAAGIADGVSYGDNAKAALVTRGLAEIRRLGQALGADPQTFAGLAGIGDLVVTCMSPHSRNRYLGEQISTGKSLDEVLNDMAMVAEGVRTTRSVYNLAKHHGVEMPITEAVHAILFDDKSPRKMVKRLMTRSAKHENWLPTTLQQ

SEQ ID NO: 14901 - protein, 356 aa, Medicago truncatula
MAKKSQKQIEKDDNASNDNDNLNPSNTVTTKAKRTRKSVPRTSPPQRSSIYRGVTRHRWTGRYEAHLWDKNCWNESQNKKGRQGAYDNEETAAHAYDLAALKYWGQDTIINFPLSNYQKELIEMESQSREEYIGSLRRKSSGFSRGVSKYRGVARHHHNGRWEARIGKVFGNKYLYLGTYATQEEAATAYDMAAIEYRGLNAVTNFDLSRYIKWLKPNNNNNDDNNKSNINLCDINSNSSANDSNSNEELEFSLVDNEISLNNSIDEATLVQPRPTSATSALELLLQSSKFKEMVEMASMTSNVSTTLESDQLSQCAFPDDIQTYFEYENFNDTMLEDLNSIMPTFHYDFEGAEVL

SEQ ID NO: 14902 - protein, 731 aa, Arabidopsis thaliana
MEPTEKPSTKPSSRTLPRDTRGSLEVFNPSTQLTRPDNPVFRPEPPAWQNLSDPRGTSPQPRPQQEPAPSNPVRSDQEIAVTTSWMALKDPSPETISKKTITAEKPQKSAVAAEQRAAEWGLVLKTDTKTGKPQGVGVRNSGGTENDPNGKKTTSQRNSQNSCRSSGEMSDGDVPGGRSGIPRVSEDLKDALSTFQQTFVVSDATKPDYPIMYASAGFFNMTGYTSKEVVGRNCRFLQGSGTDADELAKIRETLAAGNNYCGRILNYKKDGTSFWNLLTIAPIKDESGKVLKFIGMQVEVSKHTEGAKEKALRPNGLPESLIRYDARQKDMATNSVTELVEAVKRPRALSESTNLHPFMAKSESDELPKKPARRMSENVVPSGRRNSGGGRRNSMQRINEIPEKKSRKSSLSFMGIKKKSESLDESIDDGFIEYGEEDDEISDRDERPESVDDKVRQKEMRKGIDLATTLERIEKNFVITDPRLPDNPIIFASDSFLELTEYSREEILGRNCRFLQGPETDLTTVKKIRNAIDNQTEVTVQLINYTKSGKKFWNIFHLQPMRDQKGEVQYFIGVQLDGSKHVEPVRNVIEETAVKEGEDLVKKTAVNIDEAVRELPDANMTPEDLWANHSKVVHCKPHRKDSPPWIAIQKVLESGEPIGLKHFKPVKPLGSGDTGSVHLVELVGTDQLFAMKAMDKAVMLNRNKVHRARAEREILDLLDHPFLPALYASFQ

SEQ ID NO: 14903 - protein, 405 aa, Photobacterium profundum
MGGVLGMILAGGEGSRLRPLTDSRTKPAVPFGGSYRLIDFALNNFVNADFLKIYVLTQFKSQSLYVHMKKGWNITGITDRFIDPIPAQMRMGKRWYDGTADAIYQNLSFIELAEPEHVCIFGSDHIYKMDIKQMLNFHKEKEAELTVSALRMPLSEASAFGVIEVDENGCMVGFEEKPTNPKSIPGDPENALVSMGNYIFNKDTLCTELEEDAAKEDSSHDFGKDIIPKLFPLGKVYVYDFTTNIIPGEKNTGYWRDVGTIEAYWQAHMDLLSEDAPFSLYNRQWQLHTHYPPLPPATILDSENSKVDINNCMISAGSYIRGAQIHKSILGFRTNVDHNTMISESVILGDVKIGANCSIRKAIIDKNVHIAPGTVIGENPEEDKKNYHVSDEGIVVIPKGAKIGY

SEQ ID NO: 14904 - protein, 446 aa, Burkholderia xenovorans
MSKNDLADLLRVGPETTMGKFMRQYWLPAVLSHEVKADGDPVRLMLLGEKLIAFRDSSGRVGVLDHRCPHRCASLFVGRNEENGIRCVYHGWKFDVDGNCVDMPSVPARLDFKEKVHARAYKAVERNGLIWVYMGENQNNPPPLPAIEANMIPGSKIWCLQRQCNWLQALEGDIDTSHVGFLHVGALQPEDLPEGSPLRPTVLNRAPEYRVQNAEWGATYGAYRLAEDGRMSWRAAQFMFPFWTMTPNILFSTRAIARAWVPMDDTHVMLFDITGGVDEGNPFFTTKLKNGEPMYEKIRRKPNGTGWYDRWLPVDGLQNDWGIDREAQRNMIHYTGIDNPSMQDQAITESMGPITDHSFEHLAPTDQMIAFVRRRLTQALRNFRDDSAPAPCAFSPETYFGARSGAFWADPVVEFSTAYRVELEKAQRWPANPDGSAVEREPEVAR

SEQ ID NO: 14905 - protein, 380 aa, Unknown
  Polaromonas sp. JS666
MAKKDYYDTLGVPKNASDDDIKKAYRKLAMKHHPDRNQGDKSKVSEEKFKEAKEAYEVLSDENKRMAYDQYGHAGVDPNMRGGGPGAEGFGGFAEAFGDIFGDVFGGQRGGQQRGGRQVYRGGDLSYAMEITLEEAAHGKEAQIRIPSWDDCNTCHGSGAKPGTKVVTCTTCHGHGVVQMRQGFFSVQQTCPQCKGTGKLIPEPCVACHGVGKTKNNKTLEVKIPAGIDDGMRIRSTGNGEPGTNGGPPGDLYIEIRIKKHEIFERDGDDLHCAVPISFTTAALGGEIEVPTLAGKAAIDIPEGTQAAKQFRLRGKGIKGVRSSYPGDLYCHITVETPVKLTEHQRKLLKELDESLKKGGARHSPSEEGWADKLKSFFSA

SEQ ID NO: 14906 - protein, 183 aa, Pseudomonas syringae
MNIRFVSIPLLLLAMSGAAMAADCPPLLQGELPKLRAKENIDLCKRFAGKPLVVVNTASFCGFAPQFKGLEELSQRYKGQGLEVLGVPSNDFKQEAKDGEETAKVCYVNYGVTFTMTEPQAVRGDDATHLFKVLAEQSSAPRWNFYKYVVDRQGKVIANFSSMTKPDDPELIAAIEKAIASKP

SEQ ID NO: 14907 - protein, 433 aa, Burkholderia xenovorans
MTDLADLTCVGPGTPMGTLMRQYWVPAAKSSELKRDGDPMRLMLLGEKLIAFRDSEGRVGVLDHRCPHRCASLFLGRNEESGIRCVYHGWKFDVAGRCVDMPSVPPHQDFKDKVHAKAFRTAERNGLVWVYMGDAAEPPPLPAIEANLVADCEIWCLQRDCNWLQALEGDIDTSHVGFLHVGSLKPDDLADDHPMRPTVLDRAPEYAVTNTAWGTMYGGYRPNDDGQRSWRVAHFMFPFWTQTPNNRFSSRAIARAWVPMDDEHSMLFDITCGVDEGNPAYSSTRKTGEPLFAPFEYAPATTDWFGRWRCVDDRRNDWGIDRELQRNGSQYTGIPNITMQDQAVTESMGPIIDHSYEHLAPTDQMIARTRRRLLLATQALSEQGTLPPGAQDSDVFFGARAGSFLCDPGLPFETAYATQLETATRWAGDKVVS

SEQ ID NO: 14908 - protein, 62 aa, Nicotiana sylvestris
GVIGYMLCSTEGPEVDFKNPINPIDKETTQVKSKLAPLKFYNSDIHKAAFILPSFARSMIES

SEQ ID NO: 14909 - protein, 359 aa, Adiantum capillus-veneris
MGLSELAQNISFQGPSFSKTAACLHFSKSLPGLHCSLPAGAFASSTASHSRSLCYPPFFLASSRSHVAFTARRCPPLYDDFIEFAIREVGQSTCLSPFPLQEGLKEVLAEDGKTTLCSNAFQSSKMRLFRIASLDGGENMQVLNLAIFPNLEYDLPIFCADFFSTSTKHIIVLDLNPLYDAEKNKWYKEKYYKGLIPMVNKYTEVLPWGQQLTTESLQFFSPIVIWTKLESRQDVQEKLFSAFKDYIQVWLKMMEGAEATSDSAEVLRNQQAQHRYLLWRATKDPGRPLLHRLFGQAWCEMYIHDFLFNGVTTLGAEKFLDYFPEYSCADGSIRKERSVVGKSCIHRPWDEHGNFTMSL

SEQ ID NO: 14910 - protein, 364 aa, Glycine max
MVKSNENGSGSVSVPPFLKKCYDMVEDRNTDSIIRWSDGGDSFVISDITQFSVTLLPTYFKHNNFSSFIRQLNIYGFRKIDTDCWEFANENFVRGQKHLLKNIRRRKHPHSADQQKALPQQDNCDEPSQEAPYHGLWKEVENLKLDKNSLTQELVKLRQHQESAENKLLLLSDRLQGMEKHQQQMLSFLVMVVQSPGFMVQLLHPKENNWHLAESWNILDQDKQDDKPVASDGMIIKYKPPVGEKLKPVVPLSPGFEKQTEPELSAEGLKDLCVSSEFLKVLLDEKLSPLENHSPFLLPDLPDDGSWEQLFLGSPFMGNIQDSNKESEGHTNGGMEMEPTISETPNENSRTFESMIVEMEKTRE

SEQ ID NO: 14911 - protein, 667 aa, Arabidopsis thaliana
MKQRSLFSVLCFFFISFGVASVSAQTCTTDKGTFRPNGTYDVNRRLILSSLPSNVTDQDGLYYNGSIGQQPNRVYAIGMCIPGSTSEDCSDCIKKESEFFLKNCPNQTEAYSWPGEPTLCYVRYSNTSFSGSADLNPRNWLTNTGDLDSNLTEFTKIWEGLMGRMISAASTAKSTPSSSDNHYSADSAVLTPLLNIYALMQCTPDLSSGDCENCLRQSAIDYQSCCSQKRGGVVMRPSCFLRWDLYTYSNAFDNLTVASPPPEPPVTVPQPAGDQDNPTNNDSKGISAGVVVAITVPTVIAILILLVLGFVLFRRRKSYQRTKTESESDISTTDSLVYDFKTIEAATNKFSTSNKLGEGGFGAVYKGKLSNGTDVAVKRLSKKSGQGTREFRNEAVLVTKLQHRNLVRLLGFCLEREEQILIYEFVHNKSLDYFLFDPEKQSQLDWTRRYKIIGGIARGILYLHQDSRLKIIHRDLKASNILLDADMNPKIADFGLATIFGVEQTQGNTNRIAGTYAYMSPEYAMHGQYSMKSDIYSFGVLVLEIISGKKNSGVYQMDETSTAGNLVTYASRLWRNKSPLELVDPTFGRNYQSNEVTRCIHIALLCVQENPEDRPMLSTIILMLTSNTITLPVPRLPGFFPRSRQLKLVSEGSESDQYTSKSSSFSS

SEQ ID NO: 14912 - protein, 1104 aa, Emericella nidulans
MPLLDGPRNGETVTASAHNGIPIIDGVDPSTLRGDIDQDPNRRQKIVVVGLGMVAVAFIEKLVKLDSERRKYDIVVIGEEPHIAYNRVGLSSYFEHRKIEDLYLNPKEWYGSFKDRSFDYYLNTRVTDVFPQHKTVKTSTGDIVSYDILVLATGSDAVLPTSTPGHDAKGIFVYRTISDLERLMEFAANHKGQTGVTVGGGLLGLEAAKAMTDLEDFGSVKLIDRNKWVLARQLDGDAGSLVTKKIRDLGLEVLHEKRVAKIHTDDDNNVTGILFEDGQELDCCCICFAIGIRPRDELGGSTGIQCAKRGGFVIDESLRTSVNDIYAIGECASWENQTFGIIAPGIEMADVLSFNLTNPDKEPKRFNRPDLSTKLKLLGVDVASFGDFFADRDGPKFLPGQRPSAESIGAADPNREEEPQVKALTYRDPFGGVYKKYLFTMDGKYLLGGMMIGDTKDYVKLNQMVKSQKPLEVPPSEFILGAQSGGEENADDLDDSTQICSCHNVTKGDVVESVKSGTCKTIADVKSCTKAGTGCGGCMPLVQSIFNKTMLDMGQEVSNNLCVHIPYSRADLYNVIAIRQLRTFDDVMKSAGKCPDSLGCEICKPAIASILSSLFNPHLMDKEYHELQETNDRFLANIQRNGTFSVVPRVPGGEITADKLIAIGQVAKKYNLYCKITGGQRIDMFGARKQDLLDIWTELVDAGMESGHRYAKSLRTVKSCVGTTWCRFGVGDSVGMAIRLEQRYKSIRAPHKFKGAVSGCVRECAEAQNKDFGLIATEKGFNIFVGGNGGAKPRHSELLAKDVPPEEVIPILDRYVIFYIRTADKLQRTARWLESLPGGIEYLKDVVLNDKLGIAAEMERQMQELVDSYFCEWTETVRNPKRRKYFQQFANTDETVENVEIVKEREQVRPTYWPKDGANEDFKGHQWSSLSWQPVIKADYFSDGPPAISSANIKRGDTQLAIFKVKGKYYATQQMCPHKRTFVLSDGLIGDDDNGKYWVSCPYHKRNFELNGEQAGRCQNDEAMNIATFPVEEREDGWIYMKLPPVEELDSVLGTEKWKVKKGEAVDPFEAYDKKYSGMKGKRAGAKGIEGSKPTRSPSNTIDW

SEQ ID NO: 14913 - protein, 409 aa, Zea mays
MQFALALDTNSGPHQIRSCEGDGIDRLEQLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHSGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKDAFISDGCLLRECNI

SEQ ID NO: 14914 - protein, 301 aa, Zea mays
VPVGGCYRLIDIPMSNCFNSGINKIFVMSQFNSTSLNRHIHRTYLEGGINFADGSVQVLAATQMPEEPAGWFQGTADSIRKFIWVLEDYYSHKSIGNIVILSGDQLYRMNYMELVQKHVEDDADITISCAPVDESRASKNGLVKIDHSGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKDAFISDGCLLRECNI

SEQ ID NO: 14915 - protein, 409 aa, Zea diploperennis
MQFALALDTNSGPHQIRSCEGDGVDRLEQLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKNAFISDGCLLRECNI

SEQ ID NO: 14916 - protein, 615 aa, Coccidioides immitis
MLLTSIAEDDDHNMAVESCDEDDAPQEKGTLEDGPEGRLPEDRAIDNFLQPLVIEDAKLYQLACCFSKVYEKLAKNSDQQFLPTPVTRLPTGQETGRYLAIDVGGSNLRVAFIELLGEAADQIDGGSDEEKSRETLRKAQRNRVRRSLEKAWPIEERLKTDKAEDLFLWIGDCMAEVVADSLTAELADGAQIPEELEMGITFSFPMMQESLSEAILMPMGKGFKWVDSTDLNLGKILLAGYERHTRRPYGSNEPSVKRRKLFALPKLKIAAITNDTVATLASLAYLVKSLPNSRVAMGIIVGTGCNATIPMKLSDLHESKAIQVSSHDANASETIVNTEWTINGAAPPLRELNVTTVWDSILDSQCARPGFQPFEYMTGGRYIGELVRIIFYDYLTSIVGLPKKDLPAILVQGYALSTTYLSSVVANTPSDSALAAKLGATLPPPESSSWNWDIATARAFRKVARAVQTRSAALIASAVVGLLACNKEIKLRHDGATNPRRASNIIVPEFNASTDTLTDVYRPKISNTTNDINNSEISAAVEVEGWQSGPEELVVAYTGGIIQHYPHFKEACQSFIDRLVIWDGPQESGKSVFLREASDGGIIGAGVLAGMVSSS

SEQ ID NO: 14917 - protein, 274 aa, Unknown
  Bradyrhizobium sp. BTAi1
MPTIIITGASDGIGAAAARQLKANGHNVVLVGRSKAKTEALARELNAPFHLADYTQLADVQRLAGELLDHGRIDVLANNAGGIMGQRALTSDGFEMTFQVNHLAPFLLTRLLLERLIASRAKVIQTASAAANIFGRNFDVDDLNNERGYTPQGAYGYGKLENILFTRELDRRHRADGIAAVSFHPGIVRSNFANDTTHLMRLFYHSPLKYLITISPERSAQRLTWLAESAPGTDWQLGECYSGRKPMPVAFKDDGTAARRLWEHSETFVKPWLG

SEQ ID NO: 14918 - protein, 322 aa, Saccharum arundinaceum
MAPALSFPIIDMGLLGGEERPAAMELLRDACENWGFFEILNHGISTELMDEVEKLTKDHYKRVREQRFLEFASKTLKDAEGVKAENLDWESTFFVRHLPESNIAEIPDLDDEYRRVMKRFAGELEALAERLLDLLCENLGLDKGYLARAFRGPSKGTPTFGTKVSSYPPCPRPDLVNGLRAHTDAGGIILLFQDDRVGGLQLLKDGEWVDVPPMRHSIVVNLGDQLEVITNGRYKSVMHRVVAQPDGNRMSIASFYNPGSDAVIFPAPELVKVEEAAAETYPRFVFEDYMKLYVRHKFEAKEPRFEAFKSMETSSSNCIAIA

SEQ ID NO: 14919 - protein, 407 aa, Pisum sativum
MATTSVVPANRGRTVISNEDMDFETTEGVKAIATFEGMGIKEDLLRGIYAYGFEKPSAIQQRAVAPIIQGRDVIAQAQSGTGKTSMIALTVCQVVDTSVREVQALIVSPTRELATQTEKVILAIGDHINIQAHACIGGKSVGEDIRKLEHGVHVVSGTPGRVCDMIKRRTLRTRAIKLLVLDESDEMLSRGFKDQIYDVYRYLPPDLQVCLISRTLPHEILEMTNKFMTDPVRILVKRDELTLEGIKQFFVAVEKEDWKFDTLCVIFMILSPSLKLLYSVNTKRKVDWLTEKMRNNNFTVSSMHGDMPQKERDAIMGEFRAGTTRVLITTDVWARGLDVQQVSLVINYDLPNNRELYIHRIGRSGRFGRKGVAINFVKSDDIKILRDIEQYYSTQIDEMPMNIGDLI

SEQ ID NO: 14920 - protein, 555 aa, Mycobacterium smegmatis
MTDDGYTVGDYLLDRLAELGVTEVFGVPGDYQLEFLDHVVAHPRITWVGGANELNAGYAADGYGRLRGMAALVTTFGVGELSAANAIAGSYAEHVPVVHIVGAPSKDSQAARRIVHHTLGDGDFEHFLRMSREITCAQANLVPATATREIDRVLSEVHEQKRPGYLLIATDVARFPTEPPTAPLPRHSGGTSPRALSLFTEAATQLIGEHRLTVLADFLVHRMGCVEALNKLLTADTVPHATLMWGKSLVDESSPNFLGIYAGAASEGSVREVIEDAPVLVTAGVLFTDMVSGFFSQRIDPARTIDIGVNQSVVAGQVFAPLDMAAALDALASILAERGIESPALPPAPAPQRPAAPPRDAVLTQEALWDRLAEALTPGNVVLADQGTSFYGLAGHRLASGVTFIGQPLWASIGYTLPAALGAGLADRDRRTVLLIGDGAAQLTVQELGAFGREGLTPVVVVVNNNGYTVERAIHGVTARYNDITAWRWTELPAALGVPDALTFRCATYGELDDALTVAAETQDRMVFVEVMLERMDIPPLLGELAQSASAANAK

SEQ ID NO: 14921 - protein, 385 aa, Methanothermobacter thermautotrophicus
MTAKRIADGVYYTGTIDWDRRTFDELVTLPRGTSYNSYLISGTSATALIDTTEPSRAAELLRTLEEMDADIKYIVSQHAEQDHSGTIPELLEIYPEAEVIGTPACIELLQELLRINGNFREVKDGESLSLGDRTLRFIVTPWVHWPDTMVTYLEEDGILFTCDFFGSHIATSDIMETPDDFLREAKRYYAHIMMPFSQMVASNLRKISELEVSMIAPSHGPVISEPGLIMDAYDTWTSGGDGVVIAYTTMHGSTRVMVERLTEKLMELDVSVRPVNVAEHDTGEFLTELVDASVLVVASPTVLTRPHPAIASVLYLVNALRPPLRHVAVMGSYGWGSLIESEVRKLLSNLNVEYLESVLVKGLPVEEDLQRVDELAMKIKGVNEW

SEQ ID NO: 14922 - protein, 261 aa, Solanum tuberosum
MAAGRWNLEGCTALVTGGSRGIGYGIVEELASLGASVYTCSRNQKELNECLTQWRSKGFKVEASVCDLSSRSEREEFIKNVANHFDGKLNILVNNAGIVIYKEAKDYTMEDYSLIMSINFEAAYHLSVLAHPLLKASQRGNVVFISSISGASALPYEAVYGATKGAMDQLTRCLAFEWAKDNIRVNGVAPGVIASSMVEMTIQDPEQKENLDKLIDRCALHRMGEPKELAAVVAFLCFPAASYVTGQIIYVDGGFMANGGF

SEQ ID NO: 14923 - protein, 590 aa, Salinibacter ruber
MSPSFPLHGAHPHDDAVTFCVWAPAADAVTLALGGGPSLPLSETEDGLFACTTDAAGPGTRYRFRLGDEGPFPDPAARFQPEGVHGPSEVIAPDAYEWGDADWNGIPREDLVVYELHVGAFTEAGTFDGVREQLAYLRDLGVTAIELMPVHDFPGARNWGYDPAAWFAPAHTYGRPEALRRLVDAAHQTGLAVILDVIYNHLGPDGAYANAFGPFLTDTSETPWGPAINLDGDGAAGVRRFFLDNALHWLREYHVDGLRLDATHALRDESDPHFLAELSAAVGEHVDGPERHLIAEDRRNLNRLVQPRDDGGYGLDAVWSDDLHHQLRVLTAGDTEGYYRDYQDTTAADIATSIRDGWFFRGEHSEHLGEPRGTDPGPVARTECVVFIQNHDQVGNRPTGNRLTGDVSPATYRALSVLLCVVPEVPLLFMGQEWAASTPFQFFTDHDEELGPSVTEGRRDEFADFSGFEGAVPDPQAPVPFERSVLDWEEPTRPPHDGVLALYHDLLALRPRLGDELTVEAPSDTTLRLERPPIHVAVNLEGTADLDLASGTSVLLHTEQAGYTPAPRPPAFTVETVSFSRPGAVVVRAE

SEQ ID NO: 14924 - protein, 308 aa, Rhodobacter sphaeroides
MRKMIVGGAQMGPIQQADSRETVVARMMELMRKAHAEGVKMLVYPELALTTFFPRWYAEDRAEMDRWFESEMPNGATQPLFDLAREMGMAFTFGFAELTPDGHHFNTSILTDAQANIVGTYRKVHLPGHVEFDPERTHQHLEKRYFEPGDLGFNVWRNEGVVMGMAICNDRRWPETYRELGLQGVELVTIGYNTPSVNSQKGAEGLRQRLFHSDLSMQAGAYQNSTYVVGVAKAGTEDGHHLMGGSIIVDPDGEVIARAETEGDELIFAECDFDRCTFGKATVFDFARHRRIEHYQRIGRQTGVIVPV

SEQ ID NO: 14925 - protein, 558 aa, Chromobacterium violaceum
MAKGDGKVYNIPRTDLPLGPLSISAYLKKFLSLDVKLIDFNAEVNALDAVPFDCFEALCRHFFQQIRDFQPDFVGISSLFSPSFPNFMDCGRVAKEVWPDSIVVGGGNIPTNSYEQIYRDMGCTFFDGLCFGEGEKPMLHLLESDDPRAFLASSDTWITRGKVMGEELFAPKHDFIDDLDEIPFFDYDLCDIDKHEINQVVASYHNLDKTRGFHVMTSRGCPFLCTFCASHRTHGRSMRYHSLERVREDFTRLVEKYNAATVIFQDDHLMADSDRVYKILDIVKSLKLHSVYQNGLTLYALDRPMLEAFWDAGVRHLVLPVESGSEKVLKKQMRKPLKMKISERVAKDCRELGIYTNTNILIGMPGETKADLEDARRNLREIASNWFNIACASPIVGSEIHEISKAKGYIKINDLGSDYRTAVINTEDFSAEFIQEYQYFMNLDLNFVHNYDLRCGNYAWAERGLKNVLRLKSDHAFAHYYLAQCYRGLGQAELADQHYASYLESIKTPFWGRWAWIFGLEGINPDDWSDADYGLLADILHPPAMTETDDSRIIAASA

SEQ ID NO: 14926 - protein, 546 aa, Chlorobium tepidum
MKILMIQPNYHSGGAEIAGNWTPSWVAYIGGALKQAGFNQVKFVDAMADDLPDETIEEIIRKNQPDVVMTTNITPSIFKAQDIMKIAKKVNKNIRTIMGGIHSTFMYPQVLTEAPETDYVVRGEGEEVTVNLMKAIAAGNDKETRSEITGIAYIDENGKVFATAAHPVIEDLDTLSPDWSLYDWDKYIYTPLNCRLAVPNFARGCPFTCTFCSQWQFWRRYRARSPKNFVDEIEILVKKYKVGFFILADEEPTINKQKFVSLCQELIDRKLDVTWGINTRVTDIMRDEDLLPFYRKAGLVHVSLGTEAASQMNLNRFRKETTIEENKYAIKLLQKNGIVAEAQFVMGLEHETPETIEETYQLCKDWDPDMANWTIYTPWPFSDLFKELGDRVEVRDYSRYNFVSPIIKPDNMEREDVLKGVLKSYGRFYARKTFFSYPWIKDPYVRKYMLGCLKAFAKTTLTKRFYDIDRVKTKNRKIEIDLGFDQSRILTQEEAKNLKERRPEMIADMSFGLKEAGYQREHDEHNWDEFDESTIRDRTSSTVRNC

SEQ ID NO: 14927 - protein, 649 aa, Photobacterium profundum
MFAKLAQAYPLGATLCDQGCNFSIHSTDNQEIKLVLFDIENKKTIIDFDHTHLDIHYTFVPNIKAGQVYGFQIKDKHNERLILDPYAQALNQTPFYVEPFTAEESWKFTKSVVIDHQFDWQNTVFPQVPYEETILCETHVKGFTQLQEHIEEQYRGTYLGLCQPAAIEFYKEQGITSLQLLPVTSCMSEPHLLKMDKVNFWGYNSLCFMAPEPRYAMSDAVTEMKTMVRELHKEGIEVIMDIVFNHTAEGGEGGPKFHLKCLDKHYYLLDSNKNHHNYTGCGNTVDLTYQPSLTLVIDTLRHWVTHYQIDGFRFDLAATLGRNGHRFDSQSAFFKAIEQDPILQKVKLIAEPWDVGPDGYQLGNFPRGWNECNDKFRDTVKSHWLGDKNNIKEFATRLMGSRDFFSAGGWPDKLPVNFISYHDGFTLQDLVSYNHKHNEANGERNLDGHGDNRSFNHGVEGKTDNLSVLYKRERQKRNLMTTLLFSFGIPHLLAVDSLSHTQGGNNNAYCQDNEISWANWILSPDNISFKNWLAGMVKARKEVMSPFIRAFSGRERGHHRIRWNHSNGKLMNTDDWQNLEAFALYLGLYKNGKELLFLINSSTIPTRYRLPAGGKWRIICDTSESVLGNRQTQTTYMQSTQSITILSRE

SEQ ID NO: 14928 - protein, 264 aa, Solanum tuberosum
MAELREKWSLKGTTALVTGGSKGIGYAIVEELANFGARVYTCSRNENELQECLDIWRKKGLKVEGSVCDLLSRTEREKLMKTVEDVFDGKLNILVNNAGVAIHKEAKDFTKEDYNIIMGTNFEAAYHLSQIAYPLLKASQNGNVIFVSSIAGFSALPSLSLYSASKGAINQMTKNLACEWAKDNIRVNSVAPAVILTPLVETAIKKNPQQKEEIDSFVVKTPLGRAGKPEEASAVIAFLCFPAASYITGQIIWADGGFTANGGF

SEQ ID NO: 14929 - protein, 372 aa, Silicibacter pomeroyi
MTCPEQAIEHDDMNVVVDVEKCKFCMDCIPVCPTGSIDNWRVVDTPYSLEDQYGWMDLPPQEDVAGDEAGLEALDDAMAALLAEAHKGAGGKSRAPATASKPTINLYTLGKPAEARVTGNYRLTAESSDSDVRHIILDFGGQPFPVLEGQSIGIIPPGTDEAGNPHLPRLYSVSSPRDGERPNFNNLSLTVKREPHGICSNHVCDLKPGDTVRVTGPFGATFLMPSDPAAHLLMICTGTGSAPFRAFTMRRQRESPKLRNSLTLVFGARRPQELPYFGPLAKVPEQFMAKHFAFSRQDGAPKHYVQDRLRAEADRVGELLADPLTHVYVCGLKAMEQGVEEAFKDIARAQGIDWTGLRDRMRDEGRYHVETY

SEQ ID NO: 14930 - protein, 405 aa, Physcomitrella patens
MALVSSRCGAGGHSLCSRQALETNKVNGRSGSTVIVGGALWSSIGKSCTGAACFVPSAVCVRRGRVVCHGNAWVLRRDQKGGPRGVCLHGDKHTRARNVEIAALNRKDLDACGSGVAEGLFDKFLEYAVRAVEQRADISPLPCQGEFQNMVAADGQSVVKNVAFESTKFRLFRCATINGGDNMQVLNVAICARPEYDLPIFCADFFSTARMNIVVLDLNPLYNTEQRPEYKEKYYSRILPLGNKYAELLPWGDKLTAESIQFFSPIVLWTRPASREEIQETVFRAFKDYLDAWLDMADKANPSNDAYEIAENQESHHRYLMWRATKDPGRYLLMRLFGEPLCERYITEFLFNGVNTLGTKTFLDYFPEYRGVDGSIIKQRSVVGKAYAERPWNKDGTFAPMLHEV

SEQ ID NO: 14931 - protein, 263 aa, Brassica napus
MCGILAVLGCTDDSQAKRVRVLELSRRLRHRGPDWSGIYQHGDNYLAHERLAIVDPDSGDQPLFNEDKTIVVTVNGEIYNHEELRKDLKNHKFRTGSDCDVISHLYEEHGENFVDMLDGVFSFVLLDTRDNSFMVARDAIGVTSLYIGWGLDGSVWISSEMKGLHEDCEHFEVFPPGVLYSSKSGGFKQWYNPPWYNESVPSTPYEPLAVRHAFEAAVTKRLMSDVPFGVLLSGGLDSSLVASITARHMASTKAAKRWGSQPP

SEQ ID NO: 14932 - protein, 482 aa, Pseudomonas syringae
MQLIWLRSDLRVHDNTALTAAMERGPTLAVYLLSPAQWRSHDDADCKVDFWLRNLVELEKALGALNVPLLIREADTWDQAPEVLSTLCTQLKIEGLHLNQEYGINETRRDQAVQKALEKAGVQVTSYLDQLLFKPGSILTKTGNYFQVFTQFKKVCYNRMHQAMPQPVRTPKAQQSLSIKSDSIPDQVEGFATPSKALRDLWPAGEAEARRRMATFADAQISYYKTERDFPAKPGTSQLSAYLAAGVISPRQCLHAALGSNQGEFETGDVGTVTWINELLWREFYKHTLVGYPRVSRHRAFRPETEALKWRDAPEELLAWQEARTGLPIIDAAMRQLLETGWMHNRLRMVVAMFLTKNLLIDWHEGERFFMRHLIDGDLASNNGGWQWSSSTGTDSAPYFRIFNPLSQSERFDPEGVFIKRWLPELADLNKKQIHDPASIGGLFGAADYPKPIVDLSKSRARALAAFKALPARQPAAGIEHD

SEQ ID NO: 14933 - protein, 296 aa, Capsicum annuum
ISKKQDEGVVVNKFRPKEPYIGRCLLNTKITGDDAPGETWHMVFSTEGEIPYREGQSIGVIADGVDANGKPHKLRLYSIASSALGDFGDSKTVSLCVKRLVYTNDKGEEVKGVCSNFLCDLKPGADVKITGPVGKEMLMPKDPNATVIMLGTGTGIAPFRSFLWKMFFEKHDDYKFNGLAWLFLGVPTSSSLLYKEEFEKMKEKAPENFRLDFAVSREQTNEKGEKMYIQTRMAQYAEELWTLLKKDNTFVYMCGLKGMEQGIDDIMSSLAAKEGIDWADYKKQLKKAEQWNVEVY

SEQ ID NO: 14934 - protein, 141 aa, Pinus pinaster
MAPKAAEKKPAEKKPVAEKAPAEKKPAPKAEKKLPKEGGDKKGKKKHKKSVETYKIYIFKVLKQVHPDIGISSKAMGIMNSFINDIFEKLASEASKLARYNKKPTITSREIQTAVRLALPGELAKHAVSEGTKAVTKFTSA

SEQ ID NO: 14935 - protein, 287 aa, Triticum aestivum
  misc_feature (146)..(147): Xaa can be any naturally occurring amino acid
  misc_feature (205)..(205): Xaa can be any naturally occurring amino acid
MGTLIGHVAPGAGFLLIGLWQLFNHIRLFVLRPSYYAAPLWFPARGVRHLELILIIVGTSASILMELVIGPAKHQPFDDDGTIPSDHLHNFEHASVSLALLAFAAVTIHMDRVRAPMRDAVSQLAAAAAFAQELLVFHLHSTDHMXXMEGQFHWLLQTVIAVTLATTLLGIRYPRSCVVSLVRSASLVLQGVWLIVMAVTPRTPXNLQFSWYLTGTMVFVVVLYLQVSRLYPEEPQYLPLVKGRHAGGRFSIGDDREDDDDEEDLEATKRGYGHVVSGGTKPMEVER

SEQ ID NO: 14936 - protein, 409 aa, Zea diploperennis
MQFALALDTNSGPHQIRSCEGDGIDRLEQLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKDAFISDGCLLRECNI

SEQ ID NO: 14937 - protein, 802 aa, Unknown
  Frankia sp. EAN1pec
MAVSVVPMIRPGSATPLGVWWDGEGVNVAVVAPGADAVDFCVFDGQDGSGGQDGSGATGRTGLGTGPAPGTDGGAETTSGGETRYRLPERDGGVWHGYIPGVGPGQAYGLRAHGPYAPGRGERYNPAKLLLDPYARRVTGSFVPHPAVHGYVAGDPYGQDPDNRDSAPYVPKGVVTGPVTRPPAGSVAGSAAGSVTGPDPAANRPRTAWADTILYELHVRGFTMLHPGVPERLRGTYAGLAHPAVVDHLLRIGVTAVELLPVHAHISETTLLENSRSNYWGYNTLAFFAPHPGYAATDDPVAEFRAMVAALHDAGIEVLLDVVYNHTAEGSERGPTLSLRGLDNIAYYRVEPTDPRRYRDVTGCGNTVDATSPHVVRLICDSLRYWVSEMGVDGFRFDLATALARSPDGFEPAAPLLTAIQADPLLSSVKLIAEPWDLGWGGYQVGAFPAPWAEWNGRFRDTLRDIFSDRTGSVADLGYRITGSSDIYEHSGRRPWASVNFVTAHDGFPLADLVSYNEKHNEANGEGNRDGESENRSSNHGAEGPTDDPKILTNRRRARRALISTLLLSAGVPMLLAGDELGRSQGGNNNAYCQDNAVSWLAWPNGTAGTPEAGGPGDGPASEVPASEVPAADPAGPDPALVTLVGGLSRLRRAAPVLRRQRFFRGGAPTPQRLPDITWFRQDGVVMSAADWNAPQVAILVAHLAGEGIEWTDAAGTPVTGESLLLVIHPEGEDRTVVLPGAPWATWYDLLLDTAADDLAGFPDTITEPRRTLAAGAQLDVAGRTVLILRALGGSDRSVAAE

SEQ ID NO: 14938 - protein, 263 aa, Vicia faba
AHIITAVIGSGVLSLAWAIAQMGWVAGPAVLLAFSLITYFTSTLLADSYRSPDPVHGKRNYTYSEVVRSVLGGRKFQLCGLAQYINLVGVTIGYTITASISMVAVKRSNCYHKHGHEAKCYTSNNPFMIVFACIQIVLSQIPNFHKLSWLSILAAVMSFAYSAIGLGLSVAKVVGGGPAVRTSLTGVQVGVDVTGTEKVWRMFQAIGDIAFAYTYSNVLIEIQDTLKSSPPENQVMKRASLIGVLTTSMFYMLCGCLGYAAFG

SEQ ID NO: 14939 - protein, 566 aa, Escherichia coli
MEMLSGAEMVVRSLIDQGVKQVFGYPGGAVLDIYDALHTVGGIDHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVWPESVSMRSYNPTTTGHKGQIKRALQSVVAVKKPVVYVGGGAITAGCHQQLKETVEALNLPVVCSLMGLGAFPATHRQVLGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRARQCLKYDTHSEKIKPQAVIETLWRLTKGDAYVTSDVGQHQMFAALYYPFDKPRRWINSGGLGSMGFGLPAALGVKMAFAEETVVCVTGDGSIQMNIQELSTALQYELPVLVVNLNNRYLGMVKQWQDMIYSGRHSQSYMQSLPDFVRRGAYGHVGIQISHPHGWKANLARRWNRCAIIAWCLLMLPSMAASTSTRCRFAGAEWMKCG

SEQ ID NO: 14940 - protein, 261 aa, Vicia faba
AHIITAVIGSGVLSLAWAIAQLGWIAGPSMMLLFSFVTYYTSTLLSACYRTGDQLNGKRNYTYTDAVRAYLGGFKVKICGLVQYVNLFGVAIGYTIAASISMMAIKRSNCFHSSGGKDPCHMNGNLYMISFGIVEIFFSQIPDFDQLWWLSTLAAVMSFTYSTIGLGLGVGKVIENKGIKGSLTGITVGTVTQTQKVGRSFQALGNIAFAYSYSMILIEIQDTIKSPPSESKTMKAATLISVVVTTIFYMLCGCLGYAAFG

SEQ ID NO: 14941 - protein, 394 aa, Actinobacillus pleuropneumoniae
MLKQIQKFLKLEAASGILLLVSALLAMIFANTDLNQLYFSFLQTEVAIKFGAFSIDKPLLMWVNDGFMAVFFILVGMEVKRELFEGSLSSYQKAIFPAVAALGGMVVPALVYWFINQNHPEYQSGWAIPMATDIAFALGIVALLSKQVPPALKVFLLALAIIDDLGAIIVIALFFSHEMSMQALTIASIAIVILVAMNRYKVTGLINYAIIGTILWASVLKSGVHATLAGVIIGFCIPLRGKNGEAPLHHLEHALAPWCSFAILPLFAFSNAGVSLEGMSLDKLASPLPLGVALGLIIGKPVGVFLFSYVAVLLGIAKVPEGINLKQIFAIAVLCGIGFTMSMFIAGLAFGEEEASENMLALARLGILMGTFVSAIIGYFLLKITTKPSLMKAA

SEQ ID NO: 14942 - protein, 234 aa, Escherichia coli
VKELLEAGVHFGHERKRWNPKFARYIYAERNGIHIIDLQKTMEELERTFRFIEDLAMRGGTILFVGTKKQAQDIVRMEAERAGMPYVNQRWLGGMLTNFKTISQRVHRLEELEALFASPEIEERPKKEQVRLKHELERLQKYLSGFRLLKRLPDAIFVVDPTKEAIAVREARKLFIPVIALADTDSDPDLVDYIIPGNDDAIRSIQLILSRAVDLIIQARGGVVEPSPSYALVQ

SEQ ID NO: 14943 - protein, 1118 aa, Hordeum vulgare
MDCLRLAVAAAALLLAALAAAADDAQLLDEFRMALPSQAPLEGWTAREGACRFPGAVCRGGRLTSLSLAAVTLNADFRAVANTLLQLSAVERLSLRGANVSGALAAARCGGKLEELDLSGNAALRGSVADVAALAGSCGALRTLNLSGDAVGAAKPAGGGGGGQGFAALDALDLSSNKIAGDADLRWMVGAGLGSVRWLDLAWNKISGGLSDFTNCSGLQYLDLSGNLIAGDVAAAALSGCRSLRALNLSSNHLAGAFPPNIAGLTSLTALNLSNNNFSGEVPADAFTGLQQLQSLSLSFNHFSGSIPDSVAALPDLEVLDLSSNNFSGSIPDSLCQDPNSRLRVLYLQNNYLSGSIPEAVSNCTDLVSLDLSLNYINGSIPESLGELSRLQDLIMWQNLLEGEIPASLSSIPGLEHLILDYNGLTGSIPPELAKCKQLNWISLASNRLSGPIPSWLGKLSNLAILKLSNNSFTGKIPAELGDCKSLVWLDLNSNQLNGSIPPELAEQSGKMTVGLIIGRPYVYLRNDELSSQCRGKGSLLEFSSIRSEDLSRMPSKKLCNFTRMYMGSTEYTFNKNGSMIFLDLSFNQLDSEIPKELGNMFYLMIMNLGHNLLSGAIPTELAGAKKLAVLDLSHNRLEGQIPSSFSSLSLSEINLSSNQLNGTIPELGSLATFPKSQYENNSGLCGFPLPPCESHTGQGSSNGGQSNRRKASLAGSVAMGLLFSLFCIFGLVIIAIESKKRRQKNDEASTSRDIYIDSRSHSGTMNSNWRLSGTNALSINLAAFEKPLQKLTLGDLVEATNGFHNDSLIGSGGFGDVYKAQLKDGRVVAIKKLIHVSGQGDREFTAEMETIGKIKRRNLVPLLGYCKIGEERLLMYDFMKYGSLEDVLHDRKKIGVRLNWAARRKIAIGAARGLAFLHHNCIPHIIHRDMKSSNVLVDENLEARVSDFGMARMMSVVDTHLSVSTLAGTPGYVPPEYYQSFRCTTKGDVYSYGVVLLELLTGKPPTDSTDFGEDHNLVGWVKMHTKLKITDVFDPELLKDDPTLELELLEHLKIACACLDDRPSRRPTMLKVMTMFKEIQAGSTVDSKTSSVATGLSDDPGFGVMDMTLKEAKEEKD

SEQ ID NO: 14944 - protein, 259 aa, Vicia faba
AHIITAVIGSGVLSLAWSTAQLGWIGGPVALLCCAIVTYVSSFLLSDCYRNPDPVTGKRNYSYMDAVRVNLGNKRTYLAGFLQFLVLYGTGTAYVITTATSLKAIMRSNCYHKEGHQAPCSYDANLYMMLFGLVQIVMSFIPDLHNMAWVSIVAAIMSFTYSFIGLELGIVTVIENGTIMGSVTGVEPANRADKIWLIFQALGDISFSYPYAILLLEIQDTLESPPPENQTMKKASMVAIFITTFFYLCCGCFGYAAFG

SEQ ID NO: 14945 - protein, 281 aa, Gossypium hirsutum
MQLETYWMLQMKAVTSVRKCEVSSLGFSFNLYINTCRVKTFVTLKRNLTMAKSDAEVKVLGTWASPFVMRVRIALNIKSVAYEFLQERLWEGKSELLLKSNPVHRKVPVLIHGDDTICESLIIVQYIDEVWPSVPILPSDPHERAAARFWAAYLDDKWFPSLRAIGMAEGEDARKAAIGQVEEGLMLLEEAFGKCSQGQALFGKDQIGYLDITFGCFLGWLRVTEKMSGIKLLNEINTPALLKWANRFCNDAAVKDVMPETEKLAEFAKMLRGRVRATPTS

SEQ ID NO: 14946 - protein, 336 aa, Pyrococcus horikoshii
MEVKEMFSLGGGLGRSKVDESKVWDVIIIGAGPAGYTAAIYAARFGLDTIIITKDLGGNMAITDLIENYPGFPEGISGSELSKKMYDQVKKYGVEVIIDEVIRIDPAECAYYEGPCNFVVKTANGKEYKAKTIIIAVGAEPRKLNVPGEKEFTGRGVSYCATCDGPLFVGKEVIVVGGGNTALQEALYLHSIGVKVTLVHRRDKFRADKILQDRFKQAGIPAILNTVVTEIKGTNKVESVVLKNVKTGETVEKKVDGVFIFIGYEPKTDFVKHLGITDEYGYIPVDMYMRTKVPGIFAAGDITNVFKQIAVAVGQGAIAANSAKEFIESWNGKTIE

SEQ ID NO: 14947 - protein, 162 aa, Zea mays
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMWGPEMRNAWGEAYDQLVAAIKQEMKPSE

SEQ ID NO: 14948 - protein, 250 aa, Pseudomonas aeruginosa
MTVYFIGAGPGDPDLITVKGQRLIRQCPVILYAGSLVPQALLEGHQAGQVVNTAELDLEQIVELLAQAHRRGLDVARVHSGDPSLYGAIGEQIRHLRELGIPYEIVPGVTATAACAALLGCELTLPEVSQTLILTRYAARTKMPEGESLGDLARHRATLAIHLGVAHLAKIVEELLPHYGADCPVAVIHRASWPDQEQVRGTLGDILPKVAARNFRRTALILVGEVLAAEGFADSSLYRAEHRHLYRPGE

SEQ ID NO: 14949 - protein, 411 aa, Nicotiana plumbaginifolia
MNALAATNRNFKLASRLLGLDSKLEQCLLIPFREIKVECTIPKDDGSLATFIGFRVQHDNARGPMKGGIRYHPEVDPDEVNALAQLMTWKTRVANIPYGGAKGGIGCSPSDLSISELERLTRVFTQKIHDLIGVHTDVPAPDMGTNPQTMAWILDEYSKFHGYSPAVVTGKPIDLGGSLGRDAATGRGVLFAAEALLRDHGKSIAGQRFVVQGFGNVGSWAAQLITEQGGKIVAVSDITGAIKNKNGIDIASLLKHVKENRGVKGFHGADSIDPNSILVEDCDVLIPAALGGVINRDNAKDIKAKFIVEAANHPTDPEADEILAKKGVVILPDIYANSGGVTVSYFEWVQNIQGFMWDEERVNTELKDYMNRGFKDVKDMCKTHNCDLRMGAFTLGVNRVARATTLRGWEA

SEQ ID NO: 14950 - protein, 313 aa, Paucimonas lemoignei
MTSCCGAVAKTRWRNVPDPCENTAYLPGHPLPAALKATADFSLALDHVAQGDGLLIAATSVAGLRPLAQQLQGKAIPNLVWLCKGLEEGSGLLPHQVVREVLGTQLPAGVLSGPSFAQEVAQGLPCALVIAAEDAALRELVVAAVHGPAIRVYSSDDVVGVEVGGAVKNILAIATGILDGMSLGLNARAALITRGLAEITRLGIALGARAETFMGLAGVGDLILTCTGDLSRNRKVGLGLAQGKPLETIVTELGHVAEGVRCAAAVRNLAQQLQIEMPITNAVAGILFDGHSPRATVEQLLARHPRDESISAS

SEQ ID NO: 14951 - protein, 1095 aa, Unknown
  Shewanella sp. MR-7
MKRMLINATQSEELRVALVDGQQLYDLDIESPGHEQKKSNIYKGKITRVEPSLEAAFVDYGAERHGFLPLKEIAREYFPKGYSFQGRPNIKEVVSEGQEVIVQIDKEERGNKGAALTTFISLAGSYLVLMPNNPRAGGISRRIEGDERTELKEAMADLEVPAGMGLIVRTAGVGKESAELKWDLKVLQHHWAAITEAAQSRNAPFLIHQESNVIVRAIRDYLRRDVGEILIDHPRIYEEAKQHIALVRPDFVERVKLYEAEVPLFTHFQIESQIESAFQREVRLPSGGSIVIDPTEALTSIDINSARATKGGDIEETALNTNLEAADEIARQLRLRDLGGLVVIDFIDMTPVRHQREVENRLRDAVHHDRARVQLGRISRFGLMEMSRQRLRPSLEESAAHICPRCHGQGTIRSTESLALSILRLMEEEAIKENTSQIEAIVPVDVAAFLLNEKRKAIRITEQRHDVEVYVIPDPHMMTPDYRVIRHRTDDEIDESSYKRIEQPEAKLYEPRKLERTAAPAPALKGFTAPQKVEQAAAPVANKVEATEPGFFSKLFSAIGAFFSSSDKPAAEKTTETKKSDSQTANANRRNRRNDTRRTRNNQDADKAKEGTREPRTRNAKKAADAPQAQERPAREKDENAKRTKPEPKSRNQAPKEVVAESQDDTPKQEVARERRQRRNMRRKVRIDNANETTEAPIQEEVVLAEVAAVNAANTEVAVETQAETKAPRSRRQPRKETAVANETAEATDAVSQVEASTEVTADKPVVENRADAPADVTEVKTEAETDADNAELSADADDKAKRESRDGQRRSRRSPRHLRAAGQRRRRDEDEQGASAPAQFVPNDALGEAQDYPAPTAQTAEAAETTEAKAIEVAAEPTVTSPAAVVETADVIVVAETTANNAVETEVIETVATEQVAEIKAEVAVTEAPAHTAVNNKPETSVKAKEVAVEPAKTVEAVTEAIVIHAETPVAQAKAETVAVEAVAPEVEKAEVKEAVKSVASAPMAKPAPIVKPQAKPVVTQAVAAPAAETVVSKPKAASRFGSMVSSEMTKPTVEVRTQVEVPKGREYDNTASAEVTAPKLKQSNSAESDMARP

SEQ ID NO: 14952 - protein, 538 aa, Haemophilus influenzae
MKIYLRFVWILIIILNFLLNLFITTNGVIIVNAFKKSLIVAASFASLSLFNSATAELVYKPLEQPVEPAKPDLKIESVNEKFAEKYPNQYNSWRSTANGDGENIIYADEENPRLIVLWGGYAFAKEYNAPRGHFYAVTDVRNILRTGAPKTANDGPQAMACWTCKGPDVPRLIAEWGEKDYFNAKWAKGGPEIVNSIGCADCHDTTSKDFAEGKPALRIARPHVLRALDALEKATAEKDKAEGRPHNNLSFNTAARTEKRAEICANCHVEYYFAGDIKQVTFPWDNGQTADDIEKYYDDIGFTDWTHSLSKAPMLKAQHPDFEIWSLGMHGKNGVTCVDCHMPKVQGADGKVYTDHQIQNPFDAFDHTCANCHDQSKEKLRDIVTSRKKEVKDVMGRLEDQVVKSHFEAKAAWDAGATKEEMEAALMDIRHAQWRWDYTAASHGGHMHAPEVVLRVLASGLDKVADARTKLAVILTKHGVKTPVQIPDISTADKAWKVMGIDIEKERKAKEEFLKTVVPQWEQQAREKGLLVDPPAQK

SEQ ID NO: 14953 - protein, 236 aa, Nicotiana tomentosiformis
MTRRYWNINLEEMMEAGVHFGHGTRKWNPKMAPYISAKRKGIHIINLTRTARFLSEACDLVFDAASRGKQFLIVGTKNKAADLVEWAAIRARCHYVNKKWLGGMLTNWSTTETRLHKFRDLRMEQKTGRLNRLPKRDAAMLKRQLSRLQTYLGGIKYMTGVPDIVIIVDQHEEYTALRECITLGIPTIYLTDTNCDPDLADISIPANDDAISSIRLILNKLVFAICEGRSSYIRNP

SEQ ID NO: 14954 - protein, 241 aa, Methanothermobacter thermautotrophicus
MMLMVVYLVGAGPGDPELITLKAIRVLEGADVVIYDRLAGEEILRYAPDDARLIYVGKRAGEHHRTQDEINRILVEEGKKHETVVRLKGGDPFVFGRGGEEILALKEAGIPYRVIPGVTSAVGVPTSVGLPVTHRGVATSFTVVTGHEDPSKPAKQVHWDYNADTLIILMGVGNIRENMEEIMKHRPADTPVCVIESGTLDDERIILGTLGDIADKDLRPPGIIVVGDVVNVYREIRGTEK

SEQ ID NO: 14955 - protein, 113 aa, Allium cepa
  misc_feature (112)..(113): Xaa can be any naturally occurring amino acid
EKKLPAKESSTTADKKKKRKSKSVETYKIYIFKVLKQVHPDIGISSKAMGIMNSFINDIFEKLAQESAKLARYNKKPTITSREIQTSVRLVLPGELAKHAVFLGTRRWLKFXX

SEQ ID NO: 14956 - protein, 143 aa, Arabidopsis thaliana
  misc_feature (124)..(124): Xaa can be any naturally occurring amino acid
RTLASSMLSSATMVASPAQATMVAPFNGLKSSAAFPANRIANTYITSIISSCVTVNCMQVWPPIGKTKFETLSYLPDLTDSKLAKEVDYLIRSKWIPCVEFDLKHGFVYREYCNSPGYYDGRYXTMSNLPLFGCTDSAQLLNE

SEQ ID NO: 14957 - protein, 431 aa, Bifidobacterium longum [sequence omitted]

SEQ ID NO: 14958 - protein, 577 aa, Chromobacterium violaceum
MHLNDALAQQPDIAAVHCHHEQACGIAAEAYGRLAERTGVAMVTTGPGATNILTPVAGAWIESLPLLVISGQVKRADLLQGSGLRQKGVQEVDVVSMAKPVTKYAVTVTDPQAIRQHLEEALYLAHSGRPGPVWLDIPLDVQAAPIDPATLPGWQPEGETAPAAQDHVAAIADLLKQAERPLILAGHGVRIAGGADALRRLSETLQVPVAATWNAMDLMPWDSPLCAGRPGVVALRPGNFAVQNCDLLIAIGTRLDNILTAYNPKGFARAARKVVVDVDAAEIAKLEMEIDLPLAMDAKACLEGLLAAVERLPKAKWQSWLDRCADWKRRYPVQDGAPFPTSGQISHYHFVDALSDAAPENTLISTGSSGLAVEVFYTVFRNKPGQRVFLTSGLGSMGYGLPAAIGACLGNGSRPMIALESDGSLQLNLQELATLKALRLPIRLFIMNNNGYASIRNTQRNYFDSRYVGTGPEAGVLIPDLLELAEAYGLPAVRIERVEELAEGLAKVMAHPGPILCDVRLNENETLQPKAAALPQPDGSMLSMPLEDMSPLLPLEQLRAEMLIPLLPASEAAKRGV

SEQ ID NO: 14959 - protein, 666 aa, Neurospora crassa
MDGSLMAALPQGQDVIRVISTGGVTKVVKIAECNTCEEVMRVTLRKFGLREDHERNYCFWVLAGVDPDPNQCRRLGDTELWRVIKDHTRPERNRLILRRVPSGEPGKAELERAAAIAMEEAQQTHRPPIEPSDKRSQLKLQKVLGVGWEDLQQQPPLSPMSYQDRERNVSNAARDLERPAPLETPRAMPRRTQALRQFGGLRPPSELIASDLTSYFPDHSREAIDRTARLSMRRSARLSRVNHRLSVASTLSFASSIQDAPPIPTIADSWLTASNQIAKVRPRDVLPRAPHGYRDSVASSVLDTLQEEGSPTEPNRRSFVPFSDSGSDTAAVSVIDPDGNIVRHSYYDSGTNNSADSAVIQEALAEDGEDAADKELQTFLAGDAWDDSMWMKGSLIGQGSFGSVYLALHAITGELLAVKQVETPAPGADSKNDARKKSMIEALKREITLLRDLQHPNIVQYLGCSSSAEYLNIFLEYVPGGSVQTMLDQYGALPESLVRSFVRQILQGLSYVHNRDIIHRDIKGANILVDNKGTIKISDFGISKKLEATNILNGANNNKHRPSLQGSVFWMAPEVVKQTSYTRKADIWSLGCLVVEMMTGTHPFPDCTQLQAIFKIGGSKASPTIPDNASEEAKQFLAQTFEIDHNKRPSADELMLSPFLTPVPGT

SEQ ID NO: 14960 - protein, 306 aa, Parvularcula bermudensis
MALPEFTMRQLLEAGVHFGHQTHRWNPRMREYIFGDRSGIHIIDLSQTVPLLHQALVKVRDIVAGGGRVLFVGTKRQAQQPVAEAAGRCAQYYMNNRWLGGTLTNWETVSNSIQRMRVIEESLEAEARGFTKKEQLNMTRERDKLELSLGGIREMGGLPDLMFVIDVNKEDIAIKEAKKLGIPVVAVVDTNCSPEGVDYIIPGNDDASRAISLYCNLVADAVIDGLSASALEFGEDLGELEELPDETALAEAEVMDPAATEASEGVALGAEDQGAVTNAEGEEVLAQELDAQAREAEKDQEPAPSS

SEQ ID NO: 14961 - protein, 639 aa, Zea mays
MSLSCWRVRFPGADVREAGRGREGMQRSRKALLRRTAAAQVQSAVAEAAGNGRKRRLYGFSVSLVVTLWVAVLLLHSLVGHGDGQRDGGGSGVDITFIEPALNGGPVNSAVQEVHGENLAVPGDTCVGSVENAVLPEDTLVQAAQLCSNDEARSENTEALTKNNQVELSGDQCGYLPQPDFDSGVQPGEKVESEDLPRPPRLSRVAPPDLDEFKTRAIAERGPGISSQPGNVIHRREPSGKLYNYAAASKGAKVLDFNKEAKGASNILDKDKDKYLRNACSAEGKFVIIELSEETLVDTIAIANFEHYSSNPKEFELLSSLTYPTENWETLGRFTAANARLAQNFTFLEPKWARYLKLNLVSHYGSEFYCTLSMLEVYGMDAVEKMLENLIPVEHKKTEPGGKLKEPIEQIPLKESAGGKESSQEPLDEDEFELEDGKPNGHGDPSKNGASDPVSETRTLQAGRIPGDTVLKVLMQKVQSLDVSFSVLERYLVELNNRYGQIFKDFDSDIDSKDALLEKIKTELKNLESSKDSIMNEIEGIISWKVVASSQLNQLVLDNALLRSEFETFRQKQADMENRSLAVIFLSFVFACLALAKLSIGIMSRFCRFYDFEKFHNVRSGWLVLLLSSCIISTILIIQ

SEQ ID NO: 14962 - protein, 191 aa, Unknown
  Fragaria x ananassa
MASSTTNNPALDLDSDTPENPGHELAQFASGCFWGSELRFQRVVGVIKTEVGYSQGHVHDPNYRLVCSGTTNHSEVVRVQFDPQVCPYSDLLSVFWSRHDPTTLNCQGGDVGTQYRSGIYYYNEEQDCLAKKSKEAKQKEFKDKRVVTEILPAKRFYRAEEYHQQYLEKGGGNGNKQSAQKGCNDPIKCYG

SEQ ID NO: 14963 - protein, 272 aa, Oryza sativa
MPPPSPPLFLSLPSPPPPPLPHLLPSHRPAAALTLAPALSSRRVSSVCPVASQRHSDYFDPRAPPPPPPRDGYGGPAYSPPAAQGGQQNGRVFSTYSIYKGKAAMSLDPRPPQFVPLDSGAYKVVKEGFVLLQFAPAVATRQYDWTRKQVFSLSVWEMGSLLTLGPTDSCEFFHDPFKGRSDEGKVRKVLKVEPTPDGNSRFFNLSVQNRLLNIDENIYIPITKGEFAVIVSTFNYIIPHLMGWSTFTNSIKPEDSRAYTRPQSGPEYEWRR

SEQ ID NO: 14964 - protein, 373 aa, Methylobacillus flagellatus
MAKRDYYEVLGVNRDATDEEIKKAYRKLAMKYHPDRNPDNPKAEEHFKEAKEAYEVLSDDQKRAAYDQYGHAGVDPSAAAGAGAGGFGNFADAFGDIFGDIFGGGGGGRRSNVYRGADLRYNMEISLEEAARGTETKIRIPVMAECETCHGSGARPGTQPVTCSTCGGHGQVRMQQGFFSVQQTCPKCHGSGKMVKDPCPTCHGGGRVKQHKTLSVKIPAGVDEGDRIRLSGEGEAGVNGGPPGDLYVVVHLKKHPIFERDGANLHCEMPISFTTAALGGEIEIPTLDGHAKMKVPPETQTGAVFRLRGKGIKPLRSNEHGDLFCHVIVETPVKLTERQKELLRELEDINQQDSGKHSPREKSWMTKVKDFFQ

SEQ ID NO: 14965 - protein, 586 aa, Anoxybacillus flavithermus
MLKEAVYHRPTDQFAYAYDDKTLHIRLRTKKSDVHAVSLLHGDPYCWEDRQWQFTKTEMTKSGSDALFDYWWVAISPPYRRLRYGFELVSGNERCVYTEKGFFHEAPIDDIAYYFCFPFLNRIDVFHAPTWVKDTVWYQIFPERFANGDPSLNPKGTIPWGSADPTPTSFFGGDFAGIMERLDYLVELGINGIYFTPIFKASSNHKYDTIDYFEIDPQFGDKPTFKRLVERCHQKGIRVMLDAVFNHSGHFFAPFQDVLKHGEKSKYKDWFHIHEFPLQTEPLPNYDTFAFVPTMPKLNTENQEVKQYLLDVATYWIREFDIDGWRLDVANEVDHQFWREFRQAVKAVKQDVYILGEIWHDAMPWLRGDQFDAVMNYPFTNGVLRYFAKSEMKASEFAHSITNVLHSYPNNVNEVAFHLLGSHDTPRILTECGENKEKVKLMFTFQFSFTGTPCIYYGDEIGLTGGQDPLCRKCMVWEEEKQDLELFAHVQKLISLRRKYRSLSRGELHFLETNDETNHLVYTKTYEQETVIFLLNNSNRKLDITLPLSVKRKKLTDLWTNKQFVSEENEWTVTLAPYGFLMFLVE

SEQ ID NO: 14966 - protein, 354 aa, Oryza sativa
  misc_feature (70)..(70): Xaa can be any naturally occurring amino acid
  misc_feature (148)..(148): Xaa can be any naturally occurring amino acid
ARSAKKPSLVVRAVATPAAPVASPGAGTSKADGKKTLRQGVVVITGASSGLGLRGGEGAWRRRGSWHVVXACRDFLKAATAAKAAGMAAGSYTVMHLDLASLDSVRQFVDNFRRSGIPLDALVCNAAIYRPTARQPTFTADGYEMSVXVNHLGHFLLARLMLDDLKKSDYPSRRLIILGSITGNTNTLAGNVPPKAGLGDLRGLAGGLRGQNGSAMIDGAESFDGAKAYKDSKICNMLTMQEFHRRFHEETGITFASLYPGCIATTGLFREHIPLFRLLFPPFQRFVTKGFVSEAESGKRLAQVVGDPSLTKSGVYWSWNKDSASFENQLSQEASDPEKARKLWDLSEKLVGLV

SEQ ID NO: 14967 - protein, 313 aa, Streptococcus pyogenes
MTKIYKTITELVGQTPIIKLNRLIPNEAADVYVKLEAFNPGSSVKDRIALSMIEAAEAKGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKASPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 14968 - protein, 486 aa, Unknown
  Photobacterium sp. SKA34
MVWLKRDLRLTDHQALSVAANSAFPVLLIYIMEPMLLSDPHYSERHWRFIWQSLEDMNHQLACVNSQVFIFHGNAVECLDQLMHHCPINALFSHQEIGLGCTFERDLNIKAWCDKQQIQWHEFQQGAVIRGAKNRTNWDKQWNRVMREPVFSVNLDKVNWVSTYPEQLADMLFSPPESWREREQGMQTGGSTLALQTLDDFFSRRGKEYYRSISSPTASRTACSRLSPYLAWGNISLRQVYQQVLAHWNDKGFRRSLIALSSRLHWHCHFIQKFESEPAIEYFCMNRTYDRLLAESCSKDDLKLKAWKEGNTGIPLIDACMRCLYHTGYINFRMRSMLVSFLTHHLNIDWRDGVTHLAQLFLDFEPGIHYSQLQMQAGVTGINTIRIYNPTKQAQEHDPDGEFIHKWVPELGNIPVPLLFEPWNLTELEVVMYQLDNNSCYLYPIIDLKRSAKEARQRLWGWRGRDDVKSETNAILKRHVRIKKPS

SEQ ID NO: 14969 - protein, 490 aa, Aspergillus nidulans
MVGVGPKRPPSRKGSMSDVPQNLLEHIKHFEEIFTVDTATLKKIVDHFVNELTKGLSVEGGNIPMNVTWVLGFPDGKETGTFLALDMGGTNLRVCEITLTEEKGGFDIIQSKYRMPEELKTGEAEELWQYIVDCVEQFIQFHHENENLSKLPLGFTFSYPATQDYIDHGVLQRWTKGFDIDGVEGKDVVPPLEKVFKERGLPIKVAALINDTTGTLIASSYTDPAMKIGCIFGTGVNAAYMENAGSIPKLAHMNLPPDMPVAINCEYGAFDNEHIVLPLTKYDHIIDRDSPRPGQQAFEKMTAGLYLGEIFRLALVDILDTQPGLIFKDQDTSQLRIPYLLDSSFPAAIEEDPYENLIETAELVQNMLKIKATRSELELMRRLAELIGTRAARLSACGVAAICKKKNIESCHVGADGSVFTKYPHFKARGAQALREILDWAPSEKDKVTIHAAEDGSGVGAALIAALTLKRVKAGNTAGIRDAQAMLAMC

SEQ ID NO: 14970 - protein, 603 aa, Arabidopsis thaliana
MDTKIGAIDTCKPTTGDIGSPPSNAVATIQDSAPITTTSESTLGRHLSRRLVQAGVTDVFSVPGDFNLTLLDHLIAEPELNNIGCCNELNAGYAADGYARSRGVGACVVTFTVGGLSVLNAIAGAYSENLPVICIVGGPNSNDFGTNRILHHTIGLPDFSQELRCFQTVTCYQAVVNNLEDAHEQIDKAIATALKESKPVYISISCNLAATPHPTFARDPVPFDLTPRMSNTMGLEAAVEATLEFLNKAVKPVMVGGPKLRVAKASEAFLELADASGYPLAVMPSTKGLVPENHPHFIGTYWGAVSTPFCSEIVESADAYIFAGPIFNDYSSVGYSLLLKKEKAIIVHPDRVVVANGPTFGCVLMSDFFRELAKRVKRNETAYENYERIFVPEGKPLKCKPGEPLRVNAMFQHIQKMLSSETAVIAETGDSWFNCQKLKLPKGCGYEFQMQYGSIGWSVGATLGYAQATPEKRVLSFIGDGSFQVTAQDISTMIRNGQKAIIFLINNGGYTIEVEIHDGPYNVIKNWNYTGLVDAIHNGEGKCWTTKVRYEEELVEAIKTATTEKKDSLCFIEVIVHKDDTSKELLEWGSRVSAANGRPPNPQ

SEQ ID NO: 14971 - protein, 112 aa, Zea mays
EAQAKEAQRRIVELTADVEVGQIYDGSVLRLLDFGAIVQVLPGRDGLLHISEIANYRIANINDVLKVGQQVRVKVIEADDKGRLRLSIKAIGGIEQQQAAAEAAPQAEPQAE

SEQ ID NO: 14972 - protein, 488 aa, Neisseria meningitidis
MMKLGFKPIPLAIAAVLCALVLALPVPDGVKPQAWTLLAMFIGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 14973 - protein, 469 aa, Pseudomonas syringae
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPDIPSWVSAAAFFILINAINLTNVKVFGETEFWFAIIKVVAIIGMIALGSYMLVSGSGGPQASVSNLWEHGGFFPNGVGGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPRALAQVDRRGVPVKAIFASAAVTVVAVLLNYFVPQQALELLMSLVVATLVINWAMISYSHLKFRQHMNRTAQVPLFKALWYPYGNYVCLAFVLFILGIMLMIPGIQISVYAIPVWLAVMWVCYRAKNRRSVVMNAETGK

SEQ ID NO: 14974 - protein, 717 aa, Brassica napus
MEELDRSRAFAKDVKRIVVKVGTAVVTGKGGRLALGRLGALCEQLAELNSDGFEVILVSSGAVGLGRQRLRYRQLVNSSFADLQKPQHELDGKACAGVGQSSLMAYYETMFDQLDVTAAQLLVNDSSFRDKEFRKQLNETVKSMLDLRVIPIFNENDAISTRRAPYQDSSGIFWDNDSLAALLALELKADLLILLSDVEGLYTGPPSDPNSKLIHTFIKEKHQDEITFGDKSRLGRGGMTAKVKAAVNAAYAGIPVIITSGYAAENIDKVLRGLRVGTLFHQDARLWAPITDSTARDMAVAARESSRKLQALSSEDRKQILYSIADALEANEKTIRAENELDVATAQEAGLEESLVARLVMTPAKISSLAASVRKLADMEDPIGRVLKKTEVADGLVLEKTSSPLGVLLIVFESRPDALVQIASLAIRSGNGLLLKGGKEARRSNAILHKVITDAIPETVGGKLIGLVTSREEIPDLLKLDDVIDLVIPRGSNKLVSQIKNTTKIPVLGHADGICHVYVDKACNVDMAKRIVSDAKLDYPAACNAMETLLVHKDLEQNAVLNELIFALQSNGVTLYGGPKASKILNLPEARSFNHEYCSKACTVEVVEDVYGAVDHIHRHGSAHTDCIVTEDPEVAELFLRQVDSAAVFHNASTRFSDGFRFGLGAEVGISTGRIHARGPVGVEGLLTTRWIMRGKGQVVDGDNGITYTHQDIPIQA

SEQ ID NO: 14975 - protein, 468 aa, Desulfovibrio vulgaris
METFANGMTLDVTVDALAPGGKAVCRHEGRVIFVDRGLPGQQLHVRLTTVRKRFAEAECLAVVTHTADECDPFCPHFGDCGGCTWQNLPYPAQLAWKERFVRDSLQRIGRIEAPNVLPTLPSPLQQGFRNKMEFAFTTDDREMLHLGLRRRGGHEVVDVTSCGLQTATTCRVVTTARDIARASGLPGWDDAAHRGFWRFLVVREPARGGQCLVQCITAPHPEAEHVARAFFTALRQAVPEVTGCVHSIRSQNSQVAYGDATVFTEGEIVLTEKLGAIELDFGHDTFLQTNTRATELLYGEVERMAGLSGREHVWDLYCGVGSIALWLAEHAATICGMEATPASVEAAQRNAQAAGCTHCDFVAGDVRALLRSRSKGKAQEPIPDVVVTDPPRAGMHPDVIDALLQTAPARIVYVSCDPATMARDVGLLMQRYTLHEARPVDLFPHTPHVETVVLLSNKEVDDTISTTV

SEQ ID NO: 14976 - protein, 151 aa, Oryza sativa
MDPYAILKCRSQEQRSSIASVLWCIADEWNDLTVKIIPKECIAMCNFCYVDCGKGSNPEWNENFVFTVSDKATELLIKLLDSDTGSADDFVGEATIPLEAVYTEGSIPPTLYNVVKDEHYCGEIKVGLTFTPEDVRQRGLPEDFGGWKQSR

SEQ ID NO: 14977 - protein, 372 aa, Leptospira interrogans
MSERSYYDILGVSKSANDEEIKSAYRKLAIKYHPDKNKGNKESEEKFKEATEAYEILRDPKKRQAYDQFGKAGVSGGAGGFGQGAYTDFSDIFGDFGDIFGDFFGGGRSSGFGGGRRSGPQRGSDLRYNLEVSLEDAALGREYKIEIPRLESCVDCNGSGASKGSSPATCPDCGGSGQIRRTQGFFSVATTCPTCRGKGTIISNPCRSCGGQGLQEKRRTINIKIPPGVETGSRLKVSGEGEAGPNGGPHGDLYVVTHIKKHELFERQGNDLILVRKISLAQAILGAEIEVPTIDGKKAKMKIPEGTESGQVFRLKGHGMPYLGAYGKGDQHVIVKIEIPKKITRRQRELIEEFARESGENIPGSKGKIFTK

SEQ ID NO: 14978 - protein, 310 aa, Mycobacterium avium
MTSPAARLRRYEIGKVIALTNPASGHGAAVAAAQRAIARLHRRGVEVVEIIGDDAQDARHLVGAALDKGADAVMVTGGDGVFSNALQVLAGTDIPAGIVPAGTGNDHAREFGIPTKDPEAAADIIVDGWAETVDLGRIRADNGFDKWFGTVAATGFDSLVTDRANRMRWPHGRLRYYVAMLAELSQLRLLPFRLVLDGAREIDADITLAAFGNTRSYGGGMRICPAADHADGLLDITMVHEASRAKLVRLFPTVMKGTHVELEQVSTARAKSIHVECPGINVYADGDFACPLPAEISAVPGALRILRAGP

SEQ ID NO: 14979 - protein, 590 aa, Unknown
  Bradyrhizobium sp. BTAi1
MCGICGEVRYSSPPLLHALSRMNDAMQARGPDAAGLYVQGGVALGHRRLSILDLSAAAQQPMIDAAFGLGIVFNGCIYNFRELRTELQAKGYRFFSDGDTEVILKSYHAWGKGCVQRFKGMFAFALWERDSGRVVLARDRLGIKPLYYAEGAGFFRFASSMPALLAAGDVDTSLDPTALHHFFSFHAAVPAPRTILNGVKKLAPATLLTIDPDGTQHRERYWSFNVGEQRPTDRAMSQEEWSDALLDEMTVAVDRRRVADVPVGVLLSGGLDSSLLVALLSKLGHQDIRTFSIGFDAVDEHSGDEFRYSDIIARTFGTDHEQIRIGGDRALEALPNAIAAMSEPMVSHDSVAFYLLSSEVAKRVKVVQSGQGADEVFGGYSWYPGFLAANDAVHQYQNAYFDWQHGDLRRLLAPDLLGDDVSLELVERFFADHAGVSAVDKVLQIDTEIMMVDDPVKRVDNMTMAFGLEARVPFLDHEVVELAARMPAELKVTHGGKHILKEAARRCVPAEVIDRPKGYFPVPSLRYLRGPFLAYVRDVLSDEKARSRGLYQRDFIDHMLQNPEAEMSPKGHSRLWQAGLLEAWLQTHGL

SEQ ID NO: 14980 - protein, 1037 aa, Zea mays
  misc_feature (300)..(300): Xaa can be any naturally occurring amino acid
MPMRLLLLLLLTFLATAAAVAGAAGGAAAAGSDADALLAAKAVLSDPAGALASWTNATSTGACAWSGVTCNARAAVIGLDLSGRNLSGPVPTALSRLAHLARLDLAANALCGPIPAPLSRLQSLTHLNLSNNVLNGTFPPPLARLRALRVLDLYNNNLTGPLPLAVVGLPVLRHLHLGGNFFSGEIPPEYGRWRRLQYLAVSGNELSGRIPPELGGLTTLRELYIGYYNSYSSGLPPELGNMTDLVRLDAANCGLSGEIPPELGNLANLDTLFLQVNGLAGAIPPELGWLKSLSSLDLSXNALTGEIPASFAALRNLTLLNLFRNKLRGSIPELVGDLPSLEVLQLWENNFTGGIPRRLGRNGRLQLVDLSSNRLTGTLPPELCAGGKLETLIALGNFLFGSIPEPLGKCEALSRIRLGENYLNGSIPDGLFELPNLTQVELQDNLLSGGFPAVSGTGAPNLGAITLSNNQLTGALPASIGKFSGLQKLLLDQNAFTGAVPPVPARPPRLSKADLSGNTLDGGVPPEIGKCRLLTYLDLSRNNLSGEIPPAISGMRILNYLNLSRNHLGGEIPATIAAMRRAAAVDFSYNNLSGLVPATGQFSYFNATSFVGNPGLCGPYLGPCHSGGAGTGHDAHTYGGMSNTFKLLIVLGLLVCSIAFAAMAILKARSLKKASEARAWRLTAFQRLEFTCDDVLDSLKEENIIGKGGAGIVYKGTMPDGEHVAVKRLSSMSRGSSHDHGFSAEIQTLGRIRHRYIVRLLGFCSNNETNLLVYEFMPNGSLGELLHGKKGGHLHWDTRYKIAVEAAKGLSYLHHDCSPPILHRDVKSNNILLDSDFEAHVADFGLAKFLQDSGASQCMSAIAGSYGYIAPEYAYTLKVDEKSDVYSFGVVLLELVTGKKPVGEFGDGVDIVHWVRSTTAGASKEQVVKVMDPRLSSVPVHEVAHVFCVALLCVEEQSVQRPTMREVVQMLGELPKPAAAAAAAGQGDEVPGSGDGDECSAAPSGAPAADESVEAPHGEATKEPSSQSSPTTDLISI

SEQ ID NO: 14981 - protein, 85 aa, Cucumis sativus
IDAIEDVIYHIETYDVTTIRASTPMYLMARKIKSLGVKMVISGEGADEIFGGYLYFHKAPNKEEFHRESCRKIKALHMYDCLRAN

SEQ ID NO: 14982 - protein, 442 aa, Methanococcus maripaludis
MDVVIIGSGAGGLTTASNIKKHDKNAKVTVITSDKYIAYSPCAIPYVIGEEIADFDTIIMHTPKDYKAKGIDVIVEAEVLDVVSGENKVIYKKDGTETELKYDNLVLATGGTPFVPPIEGVTLDGVFKVRTIEDGQKITEWAKDTKNVVVAGAGAIGIEIAFGLKEIGLDVTVVEMVPQVFPRALDPDMAETVQKYLEEQGIKIILEKPVGKIIGNDKVEAVLVGEETIPAEMVIMSTGVRSNIELAKSAGCDIGRWAVLTNEKMQTSIPNIYAVGDCVEVIDAITMQNTLSPFGTTAVRQGKVAAKAIVKLEAEIKPVLNSMVSKIGKLEIGGTGMTETAAKMNGIEIVLGYSKALTRARYYPGGKPIYIKMVADKMTKKVIGCQIISEERVAERVDAMSVAISNGMTVEELANQEFCYAPPVSMVIDPIVFAAEDTLDKF

SEQ ID NO: 14983 - protein, 494 aa, Paxillus involutus
  misc_feature (141)..(141): Xaa can be any naturally occurring amino acid
KLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTXVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 14984 - protein, 524 aa, Bifidobacterium longum
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGSLAIFGVIPVAGYQHAPMFVNLIKDGVFPNGFMPVFATILTVNFAFSGTELIGVTAGETRDPQTAVPKAIHTTLWRLVLFFIGSITVMCALIPWRKAGVGESPFVLVFNGIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLAAGHSTSELKYRTPGYPYVSWAAFILCTASFVLVIFDVEQRFALVAELVFIVACYGAYFLQQWVRKRKKATEADDLDTLWVARD

SEQ ID NO: 14985 - protein, 234 aa, Glycine max
MSKSEDLKLLGGWFSPFALRVQIALNLKGLEYEVVEETLNPKSDLLLKSNPVHKKIPVFFHGDKVICESAIIVEYIDEAWTNVPSILPQNAYDRANARFWFAYIDEKWFTSLRSVLVAEDDEAKKPHFEQAEEGLERLEEVFNKYSEGKAYFGGDSIGFIDIGFGSFLSWMRVIEEMSGRKLLDEKKHPGLTQWAETFAADPAVKGILPETDKLVEFAKILQLKWTAAAAAAAK

SEQ ID NO: 14986 - protein, 563 aa, Kluyveromyces lactis
MTGSYELNHTGEVVSNRGLKDAYNEVTEMEVDPKNNEYAEEQSLNREDTFDPDSGVKRQLKDRHISLLALGGIIGPGCLIGAGNALAIGGPLALLLGFGIIGILAFIMMESIGEMITLYPSGGGFTTLTRRFHSDALSAVCGYAYAVVFFAVLANEYNTLSSIMQFWGPQVPLYGYILIFWAAFQVFQLLGVGAFGETEYWLAWFKILGLLTYYIFSIVYISGGVKNRPAFGFQYWNDPGALSNGFKGIANVFVFCSTFYSGTESVALAATESKNPRRAVPIAIRQTFWRILIVYLGISIFYGVTVPYNDENLNFATKVLKSPIAIAISRAGWPAGVHLVNAFILITCISAINGSLYIGSRTLTHLANEGLAPKLLAWTDRRGVPIPAITVFNALGLISLMNVSVTAVDAYNYIVNLSGVGVFIVWGIISLTHLRFRKAWKLQGHTRDELPYKAKLFPVFPIVSIIANIFLGLVQGWSYFKPFDAKNFVDAYILIPAGIILYLGVSYWKTKGFLTAVDLSEVNLLFGQRLPTISQDMPSSTDSTTSVVITKTPRKINWKDILT

SEQ ID NO: 14987 - protein, 494 aa, Paxillus involutus
KLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 14988 - protein, 573 aa, Haemophilus influenzae
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPEYVELRSYNPTVNGHKGQIKKALKALLVAKKPILFVGGGAITAECSEQLIQFAQRLNLPVTSSLMGLGAYPSTDKQFLGMLGMHGTLEANTAMHESDLILGIGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 14989 - protein, 494 aa, Paxillus involutus
  misc_feature (314)..(314): Xaa can be any naturally occurring amino acid
KLQQIYDAEHPRLILKELFSQDPHRFAKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGXWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 14990 - protein, 540 aa, Unknown
  Mycobacterium sp. KMS
MDTSADQLPNQVDAVVVGAGFAGLYALHKLRSQGLTVRVFEAAPDVGGTWYFNRYPGARCDVESVDYCYSFSEELQQEWNWSEKYATQGEILRYINWVADKLDLRSGITFNTKVTSAVLDEDTLRWTVTTDAGTVLSARFAIMATGPLSAALTPQFPGLDTFAGDIYHTADWPHEDVDFTGKRVAVIGTGSSGIQSIPIIAEQAAQLYVFQRTPNYSVPAGNRPLTAEDIATVKANYDERRQLSWRSGGGSPHVAHPKLTMEASLEERRAAFERRWELGGVLFSKTFRDQMIDPQANDEARKFYEEKIRAVIDDPEVADLLIPKDHPIGTKRICTDTNYFQTFNRPNVELISVRKTPIESVDPAGINTSDAHYELDVIVLATGFDAMTGALAKMDITGRDGEKLADDWRDGPRTYLGLGVDGFPNLFIVSGPGAPAVLANMVLHAEAHVNWIADCIDYLDSHGYAAIEATPQAVDDWGAELSRRADATLFTQANSWYMGANVPGKPRVFMLFIGGFGVYLDICAEVADAGYKGFELLKID

SEQ ID NO: 14991 - protein, 257 aa, Bromus tectorum
  misc_feature (186)..(186): Xaa can be any naturally occurring amino acid
CELDNIMRLTGISGIVNGMDVTEWNPAKDKFIAVNYDATTALEAKALNKEALQAEVGLPVDSKVPLVAFIGRLEEQKGPDVLIAAIPEIVQEVDVQIVLLGTGKKKFERLLKSIEEKFPGKVRAVVRFNAPLAHQMMAGADILAVTSRFEPCGLIQLQAMRYGTPCACASTGGLVDTVVEGRTGFXMGRLSVDCLVVEPADVKKVATTLKRAVKVVGTPAYQEMVKNCMIQDLSWKAPAKNWEDVLLELGVAGNEPG

SEQ ID NO: 14992 - protein, 186 aa, Zea mays
MATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKATLELTHNWGTENDPEFKGYHNGNSDPRGFGHIGVTVDDVHKACERFERLGVEFVKKPDDGKIKGIAFIKDPDGYWIEIFDQTIGTVTSSAS

SEQ ID NO: 14993 - protein, 237 aa, Cutandia memphitica
  misc_feature (3)..(3): Xaa can be any naturally occurring amino acid
  misc_feature (233)..(233): Xaa can be any naturally occurring amino acid
  misc_feature (236)..(236): Xaa can be any naturally occurring amino acid
IVXGMDVSEWDPSKDKYIAVNYDAATAVEAKALNKEALQAEVGLPVDSKVPLVAFIGRLEEQKGPDVMVAAIKELMEEGSEDVQIVLLGTGKKKFERMLKSVEEEFPDNVRAVVKFNAPLAHQIMAGADVLAVTSRFEPCGLIQLQGMRYGTPCACASTGGLVDTIVEGKTGFHMGRLSVDCDVVEPADVKKVATTLKRAIKVVGTPAYQEMVKNCMAQDLSWKGPAKNWEDXLLXL

SEQ ID NO: 14994 - protein, 221 aa, Triticum aestivum
MARRSGMLLLLAAAALLALGAGAAVPPSCERIECPAYDVVDSANGFEIRRYKDAMWVSTAPIEDISLVDATRSGFLQLFKYIQGKNAYNETIEMTAPVLTRVAPSDGPFCVSSFVVSFYVPAKNQADPPPAEGLHVQRWAGARYAAVRRFGGFVADADVGKQAALLDASLQGTRWAAAVSDGRKADPASEYTVAQYNSPFEFSGRVNEIWMLFDTMAASDM

SEQ ID NO: 14995 - protein, 180 aa, Chromobacterium violaceum
MPNIAEARGLINSSDVLFTAEQVSAAVDRMAVEITEKLGEEYPLVLSVMGGAVVFTGQLLPRLAFPLDFDYVHVSRYGDKTHGGELVWKQAPKEDVRDRVVLVLDDILDEGHTMAAIRDKVMSMGAKAFYSGVFANKLISKEKPLAADFVGLDVPDRYVFGYGMDVRGAWRNLPAIYALK

SEQ ID NO: 14996 - protein, 512 aa, Ocimum basilicum
MAALLLLLLLPLLLPAIFLLHHLYYRLRFRLPPGPRPLPIVGNLYDVKPVRFRCFADWAQSYGPIISVWFGSTLNVIVSNTELAKEVLKEKDQQLADRHRSRSAAKFSRDGQDLIWADYGPHYVKVRKVCTLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPSLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPCEFRPERFLEEDVDMKGHDFRLLPFGAGRRVCPGAQLGINLVTSMIGHLLHHFNWAPPSGVSSDELDMGENPGLVTYMRTPLEAVPTPRLPSDLYKRIAVDL

SEQ ID NO: 14997 - protein, 957 aa, Shigella flexneri
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASNVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLTRAEAAEINLRSDILNAVGITLDETTTRENVMQLFSVLLGDNHGLEIDTLDKDVAHDSRSIQPAMLRDDEILTHPVFNRYHSETEMMRYMHSLERKDLALNQAMIPLGSCTMKLNAAAEMIPITWTEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 14998 - protein, 839 aa, Vibrio parahaemolyticus
MNSPLTIPVKNALSHIVVVGNGMVGQHLVEQLVQKNAHLEHRITVIGAERFIAYDRVQLSSLFAGKSHDDLMLSNQEWYDMHGIQLVLGSQVTGIDREQKRILLDGEDVLGYDQLVLATGSYPFVPPIEGKDRDNVFVYRTLDDLSQIKKACEGARTGAVIGGGLLGLEAANALKLLGLETHVIEFAPRLMPVQLDDGAGLVLKEKIEALGLTVHTSTGTERICDGETAKHRMVFKDKDPLEVDVIVFSAGIRPQDELARLAELEVGERGGIVINNQCQTSDENIYAIGECALWEQKIFGLVAPGYTMARTTADVLTGMPSEGFKGADMSTKLKLLGVDVASIGDAQMQTEGAQEMVLQDAVAGIYKKLVVDASGTQLLGAILVGDNSDYDALLHCYLNKTVLPDHAANLLFDTGMLDGEMPDSAIICSCHNVTKGDLVAEIQAGTTNLTDLKANTKAGTGCGGCSNMVKSVLDTQLAAMGVEVNNHLCEHFELSRQEMFHICQVEQIKDFDTLIALHGKGHGCDICKPTAASVFASLWNEHIMEPQHQSLQDSNDAFMANLQKDGSYSIVPRVPGGEITPDKLIVLGEVAQQYDLYTKITGGQRVDLFGAQLEQLPEIWQTLIDAGFETGHAYGKSVRTVKSCVGSTWCRYGVDDSVGLAIELENRYKGLRAPHKLKFAVSGCTRECAEAQSKDIGVIATENGWNLYVCGNGGMRPRHADLFASDLSKSELITMIDRVLMFYVSTADRLQRTSVWMENMEGGLDYLKQVILDDSLNLCDSLDEQMARVVDTYQCEWKSTLDNPQKLQRFRPFLNSTSGSKVLPYQRVRGQRIPVKQEV

SEQ ID NO: 14999 - protein, 320 aa, Candida albicans
MVHHKVTIIGSGPAAHTAAIYLARAEIKPTLYEGMLANGIAAGGQLTTTTDIENFPGFPNGIGGSELMEKMKEQSQRFGTEIITETISKVDFSKRPFKLWTEWNEDAEPITTDAVIIATGASAKRMHLPGEDTYWQQGISACAVCDGAVPIFRNNPLAVIGGGDSACEEAIFLTKYASKVFLLVRRDVLRASTIMQKRVTNNEKIEVLWNTEALEAKGDGKLLKSLRIVNNKTKEEKDLQVNGLFYAIGHIPATKIFADQLKTDEAGYIQTTPGTASTSIEGVFAAGDVQDKIYRQAITSAGSGCMAALECEKFISEQEA

SEQ ID NO: 15000 - protein, 112 aa, Silicibacter pomeroyi
MKLIIATIKPFKLDEVREALTEAGIRGMMVTEIKGFGTQSGHTEIYRGAEYTVNFVPKIKLELVVADQIAEQIADTIARTARTGKIGDGKIFVLDVEQALRVRTGETDDDAL

SEQ ID NO: 15001 - protein, 505 aa, Triticum aestivum
  misc_feature (34)..(34): Xaa can be any naturally occurring amino acid
  misc_feature (71)..(71): Xaa can be any naturally occurring amino acid
  misc_feature (77)..(77): Xaa can be any naturally occurring amino acid
  misc_feature (153)..(153): Xaa can be any naturally occurring amino acid
MSNSAALAPSSRSRAAVFLAFSLICFSSHVLAAXGHPHYADALAKSLLFFQGQRSGRLPPDQAVKWRSNSXMSDGSXAANVDLTGGYYDGGNNVKFNFPMAFTATMLSWSIIEYGGRMDGRVHDARAAVRWATDYLLKSAKATPGKLYVGVGXCPTADHRCWERPEDMDTPRDVYAVSASAPGSDVAGETAAALAAASVVFRAADRAYSRRLLAAARDVMAFAWQHQGKYSDHVGGGVGNYYPSHSGYKDELLWGCAWLLWATKNSSYLNDLISLGANDDLDVFSWDNKLAGARVLLSRRALLDGDERLEPFTRQAEEFICHILPNSSSPSSTTAYTPGGLMHRPGNVNMQYVASASFLLTTYAKYMAASRRRAFSCQNSRPVTHRNLRALAKRQVDYVLGDNPLGMSYMVGYGARYPQRIHHRASSMPSVAAHPAHIGCQEGYRSYLNAPGPNPNVHTGAVVGGPDENDAFPDDRVDYARSEPVTYTNAPLVGCLAYFAGSYKN

SEQ ID NO: 15002 - protein, 1108 aa, Pseudomonas syringae
MAKKPGDATFIKDPLWYKDAVIYQVHVKSFFDSNNDGIGDFAGLIEKLDYIAALGVNTIWLLPFYPSPRRDDGYDISEYRDVHSDYGTMADAKRFIAQAHKRGLRVISELVINHTSDQHPWFQKARNAKPGSKARDFYVWSDTDQKYDGTRIIFLDTETSNWTWDPVAGQYFWHRFYSHQPDLNFDNPHVLDAVLEVMRFWLDLGIDGLRLDAIPYLIERDGTNNENLPETHQVLKRIRAEIDANYPDRMLLAEANQWPEDTQLYFGDSKGPDGDECHMAFHFPLMPRMYMALAQEDRFPITDILRQTPEIPENCQWAIFLRNHDELTLEMVTDRERDYLWNYYAADRRARINLGIRRRLAPLVDRDRRRVELLNSMLLSMPGTPTLYYGDEIGMGDNIYLGDRDGVRTPMQWSIDRNGGFSRADPASLVLPPIMDPMYGFQSVNVEIQERDPHSLLNWNRRMLAVRKQQKAFGRGTLKMLSPSNRRILAYTREYTAPDGHSEVVLCVANVSSAAQAAELELSAYAGTVPVEMLGGSAFPPIGQLSYLLTLPPYGFYWFLLASENQMPSWHVEPAQSMPDFPTLVLKKRLEELLEEPLRSTMENTSLAVYLPKRRWFAGKDKAIEKVSIAYAVRFGEEANPVLLSEIEVTAGGQTDRYQLPFGLLAEDDISSALPQQLALARVRRNRDVGLITDAFTLETFIRAVIQGMQSDTVIPCADGELRFEQSSQLAPLGLNAESEVRYLSAEQSNSSVVVGSSLVLKLIRKVSAGTHPELEMGAFLTRAGFKNISPLLGSLVRVGKDGQPNLLMIAQGYLSNQGDAWEWTQNNLERAVRDELAHGVSGQEQHYNALLELADFSRSLGQRLGEMHQILASPTDNADFAVEVTSSQDSKASGVSVNAQLERALQLLEQRIGELDKDDQQLVNDLLAQRKQIRQRVEGLAKRSAGGLRIRVHGDLHLGQVLVVKGDAYLIDFEGEPARALEERRAKHSPFKDVSGVLRSFDYAAAMAVRSAQSVDTSPEAAGARKRVADTYLAQARETFIEGYRSATTGIAHAWKDAKGEDAALELFTLEKAAYEVIYEAENRPAWLAVPLQGLRGLLQPSDGESI

SEQ ID NO: 15003 - protein, 250 aa, Actinobacillus pleuropneumoniae
MVPGIVCLIVLPYLLYLIYPPELKDTPKMAEMARQELQNMGKMSKAEWILALDFVLLLFLWTVGDLAFGIPATVSAFIGLVILLLSNIMNWQNIISEKSAWDTMFWFAVLVMMANALNKYGAITWISSHISQSVGGLDWPMAFGILVLVYFYTRYFFASAMAHISAMYLAFLAAAIAVGTPPMLAAIGLGYTSTLSMSLTQYAGGPGPALFGSGYNTTGQWWGVSFIISVASLVIWFTVGGAWMKLLGWW

SEQ ID NO: 15004 - protein, 301 aa, Vibrio parahaemolyticus
MEAPYQKSWFKKGQAYQSQKRSSRFSRHDQASKLNKLLEDQSVDLDANHKGFVSIVGAGPHDPDLLTVKAVKAIMSAEVLLYDRLVNKDILELASPQADWIYVGKRCGQPSIGQEEICGLMVSLAQQGKRVVRLKGGDPFVFGRGGEEALALVKHAIPYEVIPGITAAIGCSANSLIPLTHRGVARSVTFVTGQVVTGAFEAWSQLMQSGQTLVFYMGLEKSSQIQTGLISSGLRENFPVAVITHGCSPQQQVYVTQLNQLNELSITLKGVSPALIVMGEVVKLREQLIETVQSVTEYEGI

SEQ ID NO: 15005 - protein, 231 aa, Actinobacillus pleuropneumoniae
MSADQKAPPVEVKLGFNWQGLLISVVVGVGIVLIPTPEGLSERAWGMLALFVATIVAIIAKAMPMGAATLVALVISGVTELTPIKAGKDEVAMLSGFSNATIWLIGIAMFLSQAVIKTGLGKRIALYFVSRFGKRMMGVAYGIALADLVIGPGIPSASARGGGIMYPIMKSIAEAYDSKPGPTAKRAGAFLALAVSQINTIVCTMFLTAMAGNPLIAELARGQGVEISWIT

SEQ ID NO: 15006 - protein, 432 aa, Zea mays
FSSHRHRRCGGFVLRCRYVEVDEQQGVQLFYYFVRSERDPYEDPLLLWLSGGPGCSGISGLAYEIGPLKFDARGQGEFPTLLYRPETWTKVSNIIFVDSPVGTGFSYAKSEEGLETGDTKQVKQLVIFLRKWLQDHPRFVMNPLYIAGDSYSGLIIPTLALEIDRSIELGEKIFSGLKGYIAGNPLTGGQFDTDSQIPYFHAMGLVSDELYKNARENCGGKYSAPLNAVCAEAVQAINNCTRDINKQYILDPACPDDDLLSPKTVAETDGTSRLMLESADFLLDSKCAEALYILSYAWGNDDTVQESLGIRKGTIGAWKRYSHALPYNYDIQSAVDYHSRLATKGYRALIYSGDHDAVVPHVGTQAWIRYLNLTIVDDWRPWYVGDQVAGFTRSYASGLTFATVKGAGHVAPLYKTLECQKMFITWISGNPL

SEQ ID NO: 15007 - protein, 383 aa, Vibrio parahaemolyticus
MNDVIRDFFKMESAGGILLVIAAAIAMTIANSPLGETYQSLLHTYVFGMSVSHWINDGLMAVFFLLIGLEVKRELLEGALKSKETAIFPAIAAVGGMLAPALIYVAFNANDPEAISGWAIPAATDIAFALGIMALLGKRVPVSLKVFLLALAIIDDLGVVVIIALFYTGDLSSMALLVGFVMTGVLFMLNAKEVTKLTPYMIVGAILWFAVLKSGVHATLAGVVIGFAIPLKGKQGEHSPLKHMEHALHPYVAFGILPLFAFANAGISLEGVSMSGLTSMLPLGIALGLLIGKPLGIFSFSWAAVKLGVAKLPEGINFKHIFAVSVLCGIGFTMSIFISSLAFGNVSPEFDTYARLGILMGSTTAAVLGYALLHFSLPKKAQD

SEQ ID NO: 15008 - protein, 353 aa, Buchnera aphidicola
MKNKILFIDRDGTLIDEPINTFQVDSINKLVFKKYVISSLRKLVELDYKLIMITNQDGLGTESFPLQDFSTAHLFMLSVFRSEGVIFDDILICPHFLDDDCVCRKPKIKMIEPWLDKIDLKKSYVIGDRDTDMQLSNNLKIKGIKYKEDICNWLHITKYIIKHNRYAEIIRRTKETKVSIKVWLDLEETSKIDTGVKFFDHMLEQLSVHSGICMNISVQGDLDIDDHHTIEDTGIVLGEALLQALGKKNGLSRFGFYLPMDESRSNCIMDISNRPYLNFKAKFNHKMAGDLSTNMVEHFFYSLCYSMKITLHLYAEGKNDHHCIESLFKVFGRTLRQAIKIEGNMLPTSKGIL

SEQ ID NO: 15009 - protein, 73 aa, Oryza sativa
ADNIGMLMHIIENIPTCCPQVCNSSKNYAWTAVPTYPSGDIGPMLCSTAGASEGCPRHIFHTVDNDVLSLFYG

SEQ ID NO: 15010 - protein, 134 aa, Haemophilus influenzae
MNELVRGLTNLRSLRAAVRELTLEQAENALEKLQTAIEEKRANEAELIKAETERKERLAKYKELMEKEGITPEELHEIFGTKTVSIRAKRAPRPAKYAFIDENGEHKTWTGQGRTPRPIQNALNKGKSLSDFEI

SEQ ID NO: 15011 - protein, 220 aa, Guillardia theta
RGLQGTRMGLLGSLFGGSGKREYSDLKAGTWAAEAAEYAKEGQVKSVSKAGHSIATFGGGCFWGIELVYQRVPGVVATAVGYAQGELEHPSYEMVCTGATGHTEVVQLTYNPKEVSFKQLCQVLFGKINPSLKDQVGNDRGSQYRHGIYFHTPEQKAEAEEAIQEVKAKLNGAPFYTELEAAKVFYPAEEYHQQYLEKGGRFGSKQSAAKGCNDPIRCYG

SEQ ID NO: 15012 - protein, 494 aa, Paxillus involutus
KLQQIYDAEHPRLILKDLFSQDPHRFSKFSKEYVDPTDPNTTFLLDYSKNLVTQPILDTLLSLASEAELETYRDKMFAGEHINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHIAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGIWYNDFYGAQTHALLPYDQYLHKFAEYFQQGDMESNGKFVTKGGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 15013 - protein, 494 aa, Paxillus involutus
KLQQIYDAEHPRLILKDLFSQDPHRFSKFSKEYVDPTDPNTTFLLDYSKNLVTQPILDTLLSLASEAELETYRDKMFAGEHINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHIAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGIWYNDFYGAQTHALLPYDQYLHKFADYFQQGDMESNGKFVTKGGERVDYQTGPIIWGAAGTNGQHSLYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 15014 - protein, 468 aa, Buchnera aphidicola
MSRQQIGVVGMAVMGRNLALNIESKNYSVSIFNRTRSVTEEVFNQNKKKNIVPYFSIKDFIDSLLKPRCILLMVQSGKATDETIKMILPYLEKEDILIDAGNTFYKDTIRRNEKLSKYEINFIGMGVSGGELGALNGPSIMPGGQKEAYKLVLPMLEKISAKFKGEPCVSYIGPNGAGHYVKMVHNGIEYGDMQLISESYFLLKYLLNMSNEELSSTFSKWNKGELNSYLIEITKNIFIEKDEKGKYLIDRILDVAEDKGTGKWISKSALDLREPLSLITESVFARYLSSLKRQRIIASKILQGPKIKTFIKDKNSFIEEVRRALYLGKIISYAQGFSQLKRASEKYHWNLKYGEIAKIFRAGCIIRANFLQKITDEYTQNKNVVNLLLTPYFSKIANEYENSLRNIVMYAIKYGISTPTFSAAISYYDSYRALYLPANLIQAQRDYFGSHTYQRTDQTGYFHTNWSQ

SEQ ID NO: 15015 - protein, 421 aa, Haemophilus influenzae
MFTRNMTIADYDPVLWQAIQDENRRQEEHIELIASENYASPRVMEAQGSQFTNKYAEGYPGKRYYGGCEYADIVEQLAIDRAKELFGADYVNVQPHSGSQANAAVYGALINAGDTILGMDLAHGGHLTHGAKVSFSGKIYNSVLYGITADGLIDYEDVRQKALECKPKLIVAGFSAYSQVVDWAKMREIADEVGAYLFVDMAHVAGLIAAGLYPNPLPHAHVVTTTTHKTLGGPRGGLILSSCGDEEIYKKLQSSVFPANQGGPLVHIIAAKAVCFKGALEPQYKEYQANVIKNAKAMVEVFKQRGYDVVSNGTENHLFLVSFIKQGLTGKAADAALGKANITVNKNAVPNDPQKPFVTSGIRVGTPSVTRRGFNENDVRELAGWMCDVLDALGKENEEQVIAETKEKVLAICKRLPVYPK

SEQ ID NO: 15016 - protein, 631 aa, Alkalilimnicola ehrlichei
MCGITGIFDLQAQRPIDVPLLEAMNQTQYHRGPDEGGLHHEPGVGLAHRRLSIIDLSSGQQPLFNEDGSVAVTYNGEIYNFPELTRTLQSAGHTFRTHCDTEVIVHAWEEWGEACVERFRGMFAFALWDRNRETLFLARDRLGIKPLYYAALPDGHLLFASELKALMAHPDLPRQLDPCAVEEYFGFGYVPEPRSIFAGVHKLPPGHTLTVRRGQGGVPASRAYWDVPFAPLPAMGEAEAAEELVRRLREAVEIRLVAEVPLGAFLSGGVDSSAVVAMMAGLSPDPVRTCSIGFDDPRYDESEYARMVAERYRTAHRLDQVNPDDFDLLGKLGALYDEPFADSSALPTYRVCEQARRQVVVALSGDGGDENLAGYRRYRHHLGEERLRGLLPLGLRRGLFGSLARVYPKADWAPRVFRAKATFQALARDAVEGYFQGVSILRDDLRRHLFSSGFRSELQGYSAVDVLRRHAAQAPTDHPLSLVQYLDMKTYLPGDILTKVDRASMAHALEVRVPILDHKLVEWMSGLPPEMKLNGSEGKHLLKKAMEPHLPHEVLYRKKRGFAVPVAEWFRGPLRQRVRDQVLGPRIGESGLFDMDFLNRLVDEHTRGARDHSPALWSLLMFDEFLAKARP

SEQ ID NO: 15017 - protein, 444 aa, Neisseria meningitidis
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMTEAQLAALIELKEVRRERVATYAKEQGLQYFEKQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 15018 - protein, 465 aa, Xanthomonas axonopodis
MPEPSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSLAWPWCLLFCALIFGLNTVSARWFAEGEFWFSLIKVITILVFIVLGGAAVIGLLPLADGSPAPGLRHLRANGWFAHGTLPILMTMVAVNFAFSGTELIGVAAGETAQPARAIPLAIRTTLVRLVVLFVGTVLVLAALLPARRAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQWLRDGAALETLAYRAPWYPWTPILGFSLCLLACIGLAFDPQQRIALWCGIPFVALCYGAYALTQWLAARRLYA

SEQ ID NO: 15019 - protein, 484 aa, Pseudomonas fluorescens
MQTYQVLIIGSGFGGQCAAVNLLKAGIDDFRLLERRDFFGGTWCQNTYPGAAVDVPSPLYSLSFAPYRWTQMFAEQAELHRYTDHVIERFGLRDRVELEANVERVEWDDTEKRWAVHTGTKGIFYAQFLINATGPLSQPVIPHFPGQDRFQGKTFHTNNWDHSYDYHGKRVAIVGSGASAAQVIPAIAPKVAHLHVFQRTAHWVLPRADRTFGRFQRWLLGLKPAYKLLRWMIYWQFETRVIAFKYSKPAIHMVQRHALKFLKRQVTDPELRKKLTPDFTIGCKRVLVSSTYYPALTRPNVTLHSREQGIASLDETGIITTDGQHIDVDLIVWSTGYDATDGVISYPVSGKNAVQLRDVWAQYPRAYLGTSLPDFPNLFIVTGPNTGIGHTSALFIIESQMNYILDCIRTVQAKGLRSIEVRPEAERTYTQMIHREMERTVWKTGGCHSWYQSRSGHVIAMFPGFSFSYHRLTRALKPADHILS

SEQ ID NO: 15020 - protein, 509 aa, Ocimum basilicum
MAALLLLLLLLPAIFLLHHLYYRLRFRLPPGPRPLPVVGNLYDVKPVRFRCFADWAQSYGPIISVWFGSTLNVIVSNTELAKEVLKEKDQQLADRHRSRSAAKFSRDGQDLIWADYGPHYVKVRKVCMLELFSPKRLEALRPIREDEVTAMVESIYHDCTAPDNAGKSLLVKKYLGAVAFNNITRLAFGKRFVNSEGIIDKQGLEFKAIVSNGLKLGASLAMAEHIPWLRWMFPLDEDAFAKHGARRDQLTREIMEEHTRAREESGGAKQHFFDALLTLKDKYDLSEDTIIGLLWDMITAGMDTTAISVEWAMAELIKNPRVQQKAQEELDRVIGYERVMTELDFSNLPYLQCVAKEALRLHPPTPLMLPHRSNSNVKIGGYDIPKGSNVHVNVWAVARDPAVWKNPSEFRPERFLEEDVDMKGHDFRLLPFGAGRRVCPGAQLGINLVTSMIGHLLHHFNWAPPSGVSTDELDMGENPGLVTYMRTPLEAVPTPRLPSDLYKRIAVDL

SEQ ID NO: 15021 - protein, 1038 aa, Klebsiella pneumoniae
MLRYTCNALFLGSLILLSGCDNSSSSSSSGSPDNPGNPDNQDVVVRLPDVAVPGEAVMATANQAVIHLVDIAGITGTSPTDYSSKNLYLWNNETCDALSAPVADWNDVSTTPAGSDKYGPYWVIPLNKESGCINVIVRDGTNKLIDSDLRVSFGDFTDRTVSVIAGNSAIYDSRADAFAPLSAGRLPKLTGLIKRRCCGRGEDQPIVRLYYSHSSKVAADSEGKFTDRYLNWTPTTISQQVSMRFPQLSGYAAFKLPDDAKTDELLQGETVAIAAAEDGILISATQVQTAGVLDDTYAPAAEALNYGAQVSDGGVNFRLWAPTAQQVDLVLYSADKKVLASHPMTRDSTSGSWTWQGGSDLKGAFYRYALTVYHPQSRQVEQYEVTDPYSHSLSTNSEYSQVVDLNDSDLKPEGWDSLTMPHAQKTKADLAKMTIHESHIRDLSAWDQTVPAELRGKYLALTAGDSNMVQHLKKLSASGVTHVELLPVFDLATVNEFSDKVADIQQSFSHLCEVNSAVKSSEFAGYCTSGSTVEEVLNQLKQSDSQDNPQVQALNTLVAQTDSYNWGYDPFHYTVPEGSYATNPEGTTRIKEFRTMIQAIKQDLGMNVIMDVVYNHTNAAGPTDRTSVLDKIVPWYYQRLNESTGSVESATCCSDSAPEHRMFAKLIADSLAVWTTDYKIDGFRFDLMGYHPKAQILSAWDRIKALNPDIYFFGEGWDSNQSDRFEIASQINLKGTGIGTFSDRLREPCAAAARSIPAMRCVKTRGLAAARRVAKRADHPERRPGSSPGRPDSSGDGRNLADFILIDKDGAVKKGSEIDYNGAPGGYAADPTEVVNYVSKHDNQTLWDMITYKAAQQADLNTRVRMQAVSLATVMLGQGIAFDQQGSELLRSKSFTRDSYDSGDWFNRVDYAMQDNNFNVGMPRISDDGSNYDVISRVKEMVATPGEAELKQMTAFYRELTGLRKSSPLFTLGDGSAVMKRVDFRNTGPDQQAGLLIMTIDMACRQGRVSIAGLMTGGSDQRASESRTSMTSPATICS

SEQ ID NO: 15022 - protein, 1042 aa, Cryptococcus neoformans
MDYGHPEGYQPPFQPVYQFVPQGYKDSDALDDIIIDDHWIDPDIDDEDDVWSEESWIPYSSHAVPNLRDSAVSPGSQSGNQQVVIAPLTNWYPTPSDLRQHYCDLHQSECLHQQMPVETNSTERSNTTLEDDLTQGTDLKHIDWSGVGLAFTLLLIILFAIHASWSGDDEEEGENKGKDSPGSRSHSKDKNESSKKKGETKKEQKESRSDKDNEKKEAGRKNGDEKDNDKDKKKSSSRISSKNDAAEGNDDKGSLKGKGEGEKKKDGSSSKSKKPNDDKKSSEKSDKVDGVKKSDPKKDDKAEGLEKKDVKKKSSSSDDKKEDKRGNGGEKKEERNKEHENKASRGEKKEDKNSNSREKKDDKKAAGDKKEDKKATGEKKDEKKAAGASRNKDDKKSATGEKRDEKRAVGAEKKDDKKVAAADKDDKKAAGGNRKDDKEATGAEKKAAGAEKKNDKKAGDTKAERKVEKKEVEGERKKDDKKVGEKKHDEKVAEGDKKNDKSQSGRKKHDEKVGEKKHDEKVAGGDKKDDESQSGRKKPSSGDKEGGDKRRDHKKTDKKNNEKDDKKAGEKKSGSKEGDKKPGDKKGDKKAENRNEEAGKKPANEKEAVNKPGEKKEMDKNPKDNKEMDEKLAGDKKNDGKSEKKGKGSVLEERGGEGKGDKKESKKSGNDKRKHEKKYEEDKEREGTKEEGKKDKSEQKDDPKKDGKGSLTSGSSKTKNEKDDERSWFSSHILIGLLLLLPLLAMTGRSRMPIIYDPAANRPSILTGSGLGDILASPVMAASKGLKRATTSPRASSSGARWVVNEQPEPKAHIHINNVNSQGNGNPINIREPSSEPAVEITVEESSLAAEQLLNRPHSPPVLEEERIWEPINFRFTGPANPDRLWNMIFACFIVALPLIVDQVMDYPERRYSQPDYLPPASQLILLSASFLICAVIGDWHFGWSSTIAPFAEVSISGAQRGLTPLIVGVVETGESLIWSLEDVMFGDGRVLLGMGLAALGVVLFSQRQPSLDVPKTDYASSTVQAMYFLGALLIGMFVWNA

SEQ ID NO: 15023 - protein, 526 aa, Crocosphaera watsonii
MLNICFVSTEVAPYSKTGGLGDVTEGLPEELAKMGHTVCTVAPRFDQYKDAWDTGILEQVKYGKEATKVRYFHSYKKGVDRIWVDHHVYLSKTPLVNKKLYGPKAAVDYIDNSERFSMLAQAALAVPLVVPLGPDGIKGKMGENTIFVCNDWHTALLPLYLKEYYQSSGTFLKAKTVLLLHNIAFQGRFPMSKFEALNLPEKYLPDLSFNTQFAPPPLDEKTTKPITAPEPMQMLNWLKAGFLNCDQALTVSPNFAKEVTSDPAGGVELDAIAKSVGLVGITNGTKAESWNPKKDKFIPANYDAETMDSGKKLCKAALQEECGLEVDPDIPILGFIGRLENQKGPDVIMAAMPELAKLNCQVVILGTGAPKLEEKLEALENTYPFAKGVAKFDPELARLITAGADYCLMPSRFEPCGLNQLYAMMYGTIPVVAPVGGLVDTVLPQFGFLMGKIPLPDKPGVAVSEAMLEEGVEAMIVGIKKALQEYGTPKFEQMRLACMANDVSWQHPAAKYVDVFEALMSSDIEA

SEQ ID NO: 15024 - protein, 444 aa, Unknown
  Candidatus Desulfococcus oleovorans Hxd3
MNFDFTNEETLIEQLGEPRVTSPILREPNIDPEKDFTDDTARVLVNVNPDIIQARIQQGKTPLSFEMAGPRKKIFFDASKVRCALVTCGGLCPGLNDIIRAIVLELYYRYGVKSIHGIRYGLEGFIPDCGHEVVDLTPELVANILNTGGSMLGSSRGPQDISQIVDSLERMHVGILFMIGGDGTLMAATKIAEEIGRRNLKISVVGIPKTIDNDIHLISRSFGFDTAVDIATEAIKGAHNEAEGYPNGIGLIKLMGRHSGFIAATATLARQDVNFVLIPEIDFDLEGDHGLLAALEQRLKRRKHAVIVVAEGAGQKFFGDGTNATDASGNIRLNDIGLFLRERITAHFKSRGIPISLKYIDPSYMIRSLPANANDSVFCGFLGRDAVHAAMAGKTRMLVSHWNNHFVHVPMSLTVGKRKQVSPHSKLWWTVLEATGQGRFTNSG

SEQ ID NO: 15025 - protein, 464 aa, Novosphingobium aromaticivorans
MASIAPDSRTDLHTERANPHWVRLGGDHKLDHVPGEDGWPVLGTTLMQLADPLGFQRRMVETHGPVFRTRSFGRRGVNLIGADANELVLFDRDRLFSNEQGWGPVLNLLFPRGLMLMDFEAHRVDRRALSIAFKPEPMRAYCSVLNTGIAQAVQGWGGQMRFYDAIKALTLDTAASSFLGLPLGPEADRLNKAFVDMVQASGGVVRRPLPFTRMGKGVAGRRLMVEYFGRLVRERRADPGQDMFSQFALATREDGSLLPEDVVVDHMIFLMMAAHDTITSSATVLFWQLARNPDWQDRLRAEARAVTGGDGLPLAYEDLGRMELTEMAFKEALRFMPPVPNMPRRALRDFEFGGYRIPAGTPVGISPAAVHADPAHWPEPDRFDPLRFTPENVSGRHKYAWVPFGGGAHMCLGLHFAYMQVKLLVSHILTRYEVAMQPGPAPSWQAWPIPKPRDGLRVEMRRIC

SEQ ID NO: 15026 - protein, 957 aa, Kluyveromyces lactis
MTQSLPLLNGTEAYKLVTTQGLYDKTVKFYEKYLQLVHDKRVGTLTNSLITLKLVVDNSFKPLDVVNDKDWRAIVSSALVFSCTNIQHFRDLAAGETIQAYPNETNPIEIYLKDPNGYIIGITETKNAISIKPTLPKQSVEASLISSRSSRIDIASSGVSTDSSYPAIPKTAKAQKSIAVMTSGGDAPGMNANVRAIVRTAIFKGCNAFVVMEGYEGLVKGGPNYIKQVYWETVRNWSCEGGTNIGTARCKEFREREGRLLGALHLIEAGVDALIVCGGDGSLTGADLFRSEWPSLIRELLDQGRINKVQFDRYQHLNICGTVGSIDNDMSTTDATIGAYSALDRICQAIDYIEATANSHSRAFVVEVMGRNCGWLALLAGISTSADYILIPEKPASSREWQDQMCDIISKHRSRGKRTTIVIVAEGAISADLTPISSKDVHKVLVDRLGLDCRITTLGHVQRGGTAVAYDRILATLQGVEAVNAVLESTPDTPSPLIAINENKITRKPLVESVQLTKSVAEIHSKDFKKAMQLRDSEFVEHLDNFMAINSAHHIEPKLPEHTHMKIAIVNVGAPAGGMNSAVYSMATYCMSQGHKPYAIYNGWTGLTRHESVRSLNWKDLLGWQSRGGSEIGTNRHTPEEADIGLIAYYFQKYGFDGIIIVGGFEAFVSLHQLERARENYTAFRIPMVLIPATLSNNVPGTEYSLGSDTALNSLMQYCDIIKQSAASTRGRVFVVDVQGGNSGYLATHAAVAVGAQVSYVPEEGISLEQLTQDIENLTESLREAEGRGKFGQLILKSTNASKVLTPEVLAEVITQEAEGHFDAKCAIPGHVQQGGLPSPIDRTRGTRFAIRAVGFIESQHKVLAAEANLDDDDFDFDTPKIIATASVLGVKGSDIVFSSIRQLYDFETELNKRTPKTIHWQSTRPLRTICRKEKTYEIKNVSASSKFPLKWMYIIM

SEQ ID NO: 15027 - protein, 166 aa, Oryza sativa
NHRQVSNPKKSLAAAASPSPPRQALLSSSSMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 15028 - protein, 408 aa, Oryza sativa
MVYISNAQDASKLIVTAKGGGGEADDAAASSAAVVLDLWRQPAKIPAPFVWPRADVALPPSSPPTGELDVPVVDLAAALRDAAGMRRAVAQVAAACASHGFFQVSGHGVPPSLARAALDGAAGFFRLPPAAKQRARRAPGTVTGYTAAHADRFVDNLPWKETLSFGHRHANAAGNNSSTVADYFSTLGDDFKHLGEVYQEYCEAMEEVTKAIMAVLGESLGVGGGYYREFFEDSSSIMRCNYYPPCPEPERTLGTGPHCDPSALTVLLQDGDVDGLQVLVAGAWRPVRPLPGAFVVNIGDTFMALTNGRYKSCLHRAVVHREQERRSLAFFLCPREDRVVRPPAGAGAGERRLYPDFTWADFMRFTQRHYRADTRTLDAFARWLRPPACSGAAPVVGPPTTATQAATV

SEQ ID NO: 15029 - protein, 324 aa, Fusarium phaseoli
MSPPAAVSPPARSAELASAPAVKLPVGLSKNSAAATTVEEMEGKWDDFKFAPIRESQVSRAMTRRYFQDLDNYAESDIVIVGAGSCGLSTRYILGKKRPDLKIAIIEASVSPGGGAWLGGQLFSAMVMRKPADAFLREVGVPYEDEGNYVVVKHAALFTSTIMSKVLQLPNCKLFNATCVEDLITRPSKEGVRISGVVTNWTLVSMHHDDQSCMDPNTINAPLVISTTGHDAPMGAFCVKRLVSMGRIEKLGGMRGLDMNVAEDAIVKGTREIVPGLIVGGMELSEVDGANRMGPTFGAMVLSGLKAAEEALKVIDIRQKQNSF

SEQ ID NO: 15030 - protein, 932 aa, Vibrio parahaemolyticus
MRVRVLLFKNVLTALKALQPLQFGEAFFCSHGWVCKSCWSIAGGVMSQGCRKTTCPYCGVGCGVEVNSKGIVGDDNHPANAGALCVKGVALAESLNMPSRLLYPKLVTKERPQGKEIHWSQATNMIAEKIHQAKAEFGPDSVAMYVSGQLLTEDYYVANKLMKGYVGSANIDTNSRLCMSSAVAAHVRAFGEDVVPVNYDDIDNTELLIICGANTAWTHPVLFRRIQQARENNPNLKLVVIDPRETVTAQQADLHLPIKNDGDVSLFNGLLKFLIEKQGIDSQCINSYTSGFDALAKEITQQRYNVTNLATDVGVSQDKLTTFFQWFAHSPTAITLFCQGVNQAENGVDKGNAIINAHLATGKIGRVGCGPFSITGQPNAMGGREVGGLANQLAVHRGFDGESIQQVQAFWESPEIATKPGLKAVELFEAVERGEIKVLWIMATNPVVSLPDNQFVKRALERCPFVIVSDITAESDVARYADLLLPAAGWGEKQGMVTNSERRISRQRQFQNPPGEAKSDWWAVSQVGQALCTLEETKNGFDFDSEHEVFCEYAAMTGMNKKSPLKLDLSQYANLNEQEYEEWRPTQWGGERPFSDGVYSHPDGKARFVVTRESPQRLARTKGWWLNTGRQRDQWHTMTRTGHIAHLAASELEPTVYMNALSATQNRLKAGQLAKLFQPSSNTSIHAKIAIDDGLGFQELFMSMHWAGRYGGESSVNAIVNSAKDPISGQPAFKSSYVEVQDAAVKTYGMFIGTQFDSSKFLYSAFQAESNLGIWRFAHDKRPKKQSFCRTEKSRRIAIDIVQGWLAVDYDLVGDVRIIRSVLVVSSEPIQTDYTNFTGLTGKPMELSQLLTITQSQSSAKLVCSCFRVTDKQIHDAMEKQDCTSLTQLQNKLKCGTNCGSCISQIKQMVDSHQHQKGKQQASQQSLAIQIK

SEQ ID NO: 15031 - protein, 303 aa, Candida glabrata
MSINHCRFYENKYPDVDDVVMVNVQQIAEMGAYVKLLEYDNIEGMILLSELSRRRIRSIQKLIRVGKNDVAVVLRVDKEKGYIDLSKRRVSSEDIIKCEEKYQKSKTVHSILRYCAEKFQIPLEDLYKTIAWPLSRKFGHAYEAFKLSIIDETVWEGIEPPSQDILNELKTYISKRLTPQAVKIRADVEVSCFSYEGIDAIKEALKSAEDMSTEQMQIKVKLVAAPLYVLTTQALDKQIGIDLLGKAIDKINEVISKYGGVCNITMPPKAVTATEDAELQALLESKEQDNRSDSEDEDNSDYE

SEQ ID NO: 15032 - protein, 403 aa, Silicibacter pomeroyi
MSHIVVIGAGQAGASLVARLRKDGFEGEITLIGAEPVPPYQRPPLSKAYLLGEMEKERLFLRPESFYAEQNIALRLNARVSAIDPAAKTVSLGGEVIPYDQLALTTGSEPRRLPAAIGGDLAGVHVVRDLADIDAMAPSVTEGARALIVGGGYIGLEAAAVCAKRGVQVTLVEMADRILQRVAAPETSAYFRALHTGHGVDIREGVGLTRLIGAQGRVTGAVLTDGSELPVDLVVVGVGIAPATALAEAAGLVLENGIRTDAQGRTSDPSIWAAGDCASFPYKGGRIRLESVPNAIDQAETVAQNMQGAGKDYVAQPWFWSDQYDVKLQIAGLNTGYDRVVTRPGEGQTVSFWYYTGDQLVAVDAMNDPRAYMVGKRLIDSGKTADPAIVADPAADLKPLLKA

SEQ ID NO: 15033 - protein, 153 aa, Unknown
  Azoarcus sp. BH72
MHAEEAHMNPSIHLVCPHCDAVNRLPAERMAEHPACGQCHRPLFIGEPLALDGARFERHLTRNDLPVLIDFWAPWCGPCRMMAPAFAAAAAQLEPQLRLAKVNTEAEPALAQRFGIRSVPTIALFQGGREVTRQAGAMNTEQLVRWVRGQLGR

SEQ ID NO: 15034 - protein, 443 aa, Oryza sativa
MAKRSSPDPASSSPSASSSPSSPSSSSSEDSSSPMSMPCKRRARPRTDKSTGKAKRPKKESKEVVDPSSNGGGGGKRSSIYRGVTRHRWTGRFEAHLWDKNCSTSLQNKKKGRQGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQEPQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGVTEYNLFEECNMLEKDISDFLDKDISDFLDKDISISDGERISPQANNISCPQKMISVCN

SEQ ID NO: 15035 - protein, 382 aa, Mycobacterium tuberculosis
MARDYYGLLGVSKNASDADIKRAYRKLARELHPDVNPDEAAQAKFKEISVAYEVLSDPDKRRIVDLGGDPLESAAAGGNGFGGFGGLGDVFEAFFGGGFGGGAASRGPIGRVRPGSDSLLRMRLDLEECATGVTKQVTVDTAVLCDRCQGKGTNGDSVPIPCDTCGGRGEVQTVQRSLLGQMLTSRPCPTCRGVGVVIPDPCQQCMGDGRIRARREISVKIPAGVGDGMRVRLAAQGEVGPGGGPAGDLYVEVHEQAHDVFVREGDHLHCTVSVPMVDAALGVTVTVDAILDGLSEITIPPGTQPGSVITLRGRGMPHLRSNTRGDLHVHVEVVVPTRLDHQDIELLRELKGRRDREVAEVRSTHAAAGGLFSRLRETFTGR

SEQ ID NO: 15036 - protein, 170 aa, Silicibacter pomeroyi
MSLERAVLAGGCFWGMQDLIRKMPGVDRTRVGYTGGDVPNATYRNHGSHAEGIEIWFDPTRISFRQLLEFFFQIHDPTTVNRQGNDLGTSYRSAIYYVDEAQKAVALDTIADVDASGLWPGRVVTEVEPVGDFWEAEENHQDYLEKHPNGYTCHFARADWVLPKRADAAE

SEQ ID NO: 15037 - protein, 314 aa, Thermus thermophilus
MDYGMYFFEHVTPYETLVRRMERVIASGKTPFQDYFLFESKGFGKVLILDKDVQSTERDEYIYHETLVHPAMLTHPEPKRVLIVGGGEGATLREVLKHPTVEKAVMVDIDGELVEVAKRHMPEWHQGAFDDPRAVLVIDDARAYLERTEERYDVVIIDLTDPVGEDNPARLLYTVEFYRLVKAHLNPGGVMGMQTGMILLTHHRVHPVVHRTVREAFRYVRSYKNHIPGFFLNFGFLLASDAFDPAAFSEGVIEARIRERNLALRHLTAPYLEAMFVLPKDLLEALEKETMVSTDQNPFYVTPEGEARQAPYKG

SEQ ID NO: 15038 - protein, 152 aa, Oryza sativa
MAPKAEKKPAAKKPAEEEPAAEKAPAAGKKPKAEKRLPAGKGEKGGAGEGKKAGRKKGKKSVETYKIYIFKVLKQVHPDIGISSKAMSIMNSFINDIFEKLAAEAAKLARYNKKPTITSREIQTSVRLVLPGELAKHAVSEGTKAVTKFTSA

SEQ ID NO: 15039 - protein, 125 aa, Cucumis sativus
AVASVNSASPAQASMVAPFTGLKSSAGFPITRKNNVDITTLASNGGKVQCMKVWPPLGLRKFETLSYLPDMSNEQLSKECDYLLRNGWVPCVEFDIGSGFVYRENHRSPGYYDGRYWTMWKLPMF

SEQ ID NO: 15040 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFMDMLDGIFSFVLLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLFAAVTARYLAGTKAAKQWGTKLHSFCVGLEGAPDLKAAKEVAEYIGTVHHEFHYTVQDGIDAIEDVIYHIETYDVTTIRASIPMFLMSRKIKSLGVKMVISGEGSDEIFGGYLYFHKAPNKEEFHQETCRKIKALHKYDCLRANKSTFAWGLEARVPFLDKEFIRVAMNIDPECKMIKKEEGRIEKWALRRAFDDEEHPYLPKHILYRQKEQFSDGVGYGWIDGLKAHAEKHVTDRMMLNAANIFPFNTPTTKEAYHYRMIFERFFPQNSARLTVPGGPSVACSTAKAVEWDAAWSNNLDPSGRAALGVHASAYGNQVKAVEPEKIIPKMEVSPLGVAI

SEQ ID NO: 15041 - protein, 1057 aa, Pseudomonas aeruginosa
MKRMLINATQPEELRVALVDGQRLFDLDIESGAREQKKANIYKGRITRVEPSLEAAFVDFGAERHGFLPLKEISREYFKKSPEGRINIKEVLSEGQEVIVQVEKEERGNKGAALTTFISLAGRYLVLMPNNPRAGGISRRIEGEERNELREALNGLNAPADMGLIVRTAGLGRSTEELQWDLDYLLQLWSAIKEASGERGAPFLIYQESNVIIRAIRDYLRQDIGEVLIDSIDAQEEALNFIRQVMPQYASKVKLYQDSVPLFNRFQIESQIETAFQREVKLPSGGSIVIDPTEALVSIDINSARATKGGDIEETALQTNLEAAEEIARQLRLRDIGGLIVIDFIDMTPAKNQRAVEERVREALEADRARVQVGRISRFGLLEMSRQRLRPSLGETSGIVCPRCNGQGIIRDVESLSLAILRLIEEEALKDRTAEVRARVPFQVAAFLLNEKRNAITKIELRTRARIFILPDDHLETPHFEVQRLRDDSPELVAGQTSYEMATVEHEEAQPVSSTRTLVRQEAAVKTVAPQQPAPQHTEAPVEPAKPMPEPSLFQGLVKSLVGLFAGKDQPAAKPAETSKPAAERQTRQDERRNGRQQNRRRDGRDGNRRDEERKPREERAERQPREERAERPNREERSERRREERAERPAREERQPREGREERAERTPREERQPREGREGREERSERRREERAERPAREERQPREGREERAERPAREERQPREDRQARDAAALEAEALPNDESLEQDEQDDTDGERPRRRSRGQRRRSNRRERQREVSGELEGSEATDNAAAPLNTVAAAAAAGIAVASEAVEANVEQAPATTSEAASETTASDETDASTSEAVETQGADSEANTGETADIEAPVTVSVVRDEADQSTLLVAQATEEAPFASESVESREDAESAVQPATEAAEEVAAPVPVEVAAPSEPAATEEPTPAIAAVPANATGRALNDPREKRRLQREAERLAREAAAAAEAAAQAAPAVEEIPAVASEEASAQEEPAAPQAEEITQADVPSQADEAQEAVQAEPEASGEGAADTEHAKKTEESETSRPHA

SEQ ID NO: 15042 - protein, 564 aa, Unknown
  delta proteobacterium MLMS-1
MFCYQCEQTAKGEGCKTIGVCGKKPEVAALQDLLIYAIQGLSLVAVAGRKVGVNDEEVNLFTCEAVFSTLTNVDFDPERFVALIKRTVSLREALLPKVQAAGGQVDSSVAAVTFTPAADQAEMVKQGEEIDMKNSADDDADIQSLKHILLFGLKGVAAYADHAKILGQEDDQVYAFIQEGLVNLLRQDMGLQDWVGLVLKCGEINLRAMELLDAGNTGSYGHPVPTEVPLGAKAGKAILVSGHDLKDLEMLLKQTEGKGINIYTHGEMLPAHGYPELKKYPHFYGHYGTAWQNQHKEFGEFPGAILMTTNCIQKPQESYKGNIFTTGLVGWPAVAHVDDHGCPSLLDKVKSAVGLNYAGQGKDFTPVIKKAQELPGFAADNDKGKVMVGFGRNAVMGVADKVIEAVKGKDIRHFFLVAGCDGAKPGRNYYTEFVEKVPSDCVVLTLACGKFRFFDKDLGDIGGIPRLLDVGQCNDAYSAIQIAVALSQAFECGVNDLPLSLVLSWYEQKAVAILLTLLHLGIKDIRLGPSLPAFVTPNVLNVLVENFDIKPISTPDEDLKAILG

SEQ ID NO: 15043 - protein, 308 aa, Pichia pastoris
MHSHHSHSGSYVSHATDTLDEIVDKAIELHFQTYCLTEHMPRYKDEDLYPEEIEKRFTYKCLVEQFDQFYKHAKVIKETRNIDPQCDTRFLIGFETEGGLGDYQLDQCLKLRLTYPVDLIVGSIHHLDSIPIDIDRANWLKAKDATTSNGSIRDFYFLYFKTQQLMIQKLRPEVIGHFDLIRFYNEDGDQLFQWPEVVALIEENIDLINSYDGLIELNSAAIRKGWPSPYPKSDVINFIFSRGGKFCFSDDAHSVGQVGLNYMKMLEFVEQSTEIDKIWYYDLSNTDKLIQKSIPVSRLRDHVFWNSG

SEQ ID NO: 15044 - protein, 338 aa, Streptococcus pyogenes
MTKQKVAILGPGSWGTALSQVLNDNGHDVRLWGNIPDQIEEINTKHTNRHYFKDIVLDKNITATLDLGQALSDVDAVLFVVPTKVTRLVARQVAAILDHKVVVMHASKGLEPETHERLSTILEEVIPAHFRSEVVVVSGPSHAEETIVRDITLITAASKDIEAAKYVQSLFSNHYFRLYTNTDVIGVETAGALKNIIAVGAGALHGLGYGDNAKAAVITRGLAEITRLGVKLGADPLTYSGLSGVGDLIVTGTSVHSRNWRAGAALGRGEKLEDIERNMGMVIEGIATTKVAYEIAQDLGVYMPITTAIYKSIYEGADIKESILGMMSNEFRSENEWH

SEQ ID NO: 15045 - protein, 123 aa, Arabidopsis thaliana
  misc_feature (17)..(17): Xaa can be any naturally occurring amino acid
  misc_feature (22)..(22): Xaa can be any naturally occurring amino acid
  misc_feature (34)..(34): Xaa can be any naturally occurring amino acid
  misc_feature (63)..(63): Xaa can be any naturally occurring amino acid
  misc_feature (102)..(102): Xaa can be any naturally occurring amino acid
MGRRTGRGYRQIKGKPXPKSRXWRGVANSKIRIXDVGMKRKGGGEFSFWVHLVLWEKGNGLRXKQLEAGPDWLGNKVTWVKALAGKRWLSQFGGNLGVHPFXHVLRINKMLSCAGADRLQSGM

SEQ ID NO: 15046 - protein, 288 aa, Crocosphaera watsonii
MMQKFLLVSYLIEVNLLEVELFIPVILFLVMTNLTPSVYFIGAGPGDPDLLTLKAYKIISKADVILYADSLVPKQVLKDVRDNCELIATGNKTLEVIMKIMIDRVRNNQSVVRLHSGDLTLYSAINEQIARLLQENIEFQLIPGISAFQAAAAKIGTELTIPDLVQTIILTRVSGSASQVPDAEKLESLAAHQSSLCLYLAARHVRKSQEKLLQYYPANTPVAICFRIGWSDEKILIVPLEKMAEVTEEENLIRTTLYIISPALNTEQNYRSQLYHPQHNHLFRPHTP

SEQ ID NO: 15047 - protein, 501 aa, Rubrobacter xylanophilus
MLAAVAQGVVGLVPGWLATAGVELLGAADIPVLISAILVLAFLLAGLLGVLAARRPGLALLGVAALGAVALAACFAGPPAAPAATVATVAAALLLGAGLSEALLRVAGLRGAGSAPPRSPAVRSREAHSGGVVVDRGGFVLVSGAAAVAGLAAAVAGRALAGGSPRRAAPKPLRLPAEPRRAGGAPRHRTLPPPPEDASIEAPGMPPLITPAEDFYLVDTALVSPRVDAREWSLRVGGAVRNPLELSYSDLLSMPTREADITLSCVSNEVGGGLVSNGRWTGVLLSDLLREAGMDPRGISGDSAQIVGRSVDGWTAGFRTGLAFDGREALVAFGLNGSELPLKHGYPARLVVPGLYGYVSATKWLAEIELTGWDFDAYWIQRGWSKEGPVRTQSRIDTVKDGETLPAGRIPVGGVAWVPHRGISKVEVSTDGGKTWQEARLAAQLDPDSWRHYLYEWEAPPGEHTLQVRATDGEGRTQTARRAPPHPSGATGYHTVRVAVA

SEQ ID NO: 15048 - protein, 383 aa, Cenarchaeum symbiosum
MFDMRSSLILWVPASFLASMARSAGMRVLDSISAGSSNDSTMPSCDLKHASPPGQAKLGYYNSAKGAAAMESMMARLRDELRAAVRACGSKNLALSGGLDSTVIACLLGEGAEAAAVIADDFVGTDLAYHQMAAAMMGAPPRIIRATTPEILDAIEGTIRVLGSFNDIEIRNSAAMYLLIERVAGTGWTSMITGDGADELFAGYDFFGRLGPAEIEEEQQRILGVMHFDSHRIGKALGVRIESPFLAPKVAEIARSVPAEYKVREEGGRTYGKWILRKAFEDAIPRAIAWRPKAALQDGSGTAGLTGLFESVVSDGTFESKRGAIEASDGIRVRSKESLHYYEAYRRIFGKPEPPAGGRPCPYCRHPVPDGYKFCAMCGAYPA

SEQ ID NO: 15049 - protein, 447 aa, Photorhabdus luminescens
MSCLLSLSSFLGSIQRRDEYQPEYLQAVREVFTSLWPFLEQNPKYREYSLLERMVEPERVIQFRVCWVDDQGKVQVNRAWRVQFSSAIGPYKGGMRFHPSVNLSILKFLGFEQTLKNALTTLPMGGGKGGSDFDPKGKSQGEVMRFCQALMTELYRHLGPDTDVPAGDIGVGGREVAFMSGMMKKLSNNTACVFTGKGLSFGGSLIRPEATGYGLVYFVNAMLKRHGMGFEGMRVSVSGAGNVAQYTIEKCMALGAKVVTASDSGGTLVDEDGFTPEKLTHLEEIKNQRYGRVEEYARERGLTFLKGLQPWSVPVDIALPCATQNELDLDAAKVLIKNGVKAVAEGANMPATISATEAFIEAGVLFAPGKAANAGGVATSGLEMAQNAARLGWKAEKVDARLHHIMLDIHHACVEYGGEGKQINYVQGANIAGFVKVADAMLAQGIL

SEQ ID NO: 15050 - protein, 311 aa, Staphylococcus epidermidis
MSITYPGTVYLIGAGPGNPNLLTKKAERLIRSADVILFDRLVNPFILQYASSQTKVINVGKKPYCKHIQQEEINQKIVEAANQYQCVVRLKGGDPAIFGRITEEVQTLENHHIHYEIVPGVTSASAAVATMNMGLTMRSIAPSVTFSTGHFKDSVNHDTDIRNLINGGTLAIYMGVKRLGQIIKQIESYTNEDYPIAIVFNASCYNEKIVIGHLSTIEEQLVSQQLEGHPGICILGNILDDINRTLLNNNKNDKGNLYLIKGDKERAIAKAETLYDEGIQCLIDFDHSYHISQQNVYNEMIKHKSIKTIYV

SEQ ID NO: 15051 - protein, 801 aa, Staphylococcus epidermidis
MAKQKLVMIGNGMAGLRTIEEILERSQSQFDITIIGKEPYPNYNRIMLSNILQKKMTVEDTIMNPYDWYQENNIELINNDPVEKVDKENKIVTTSKGIEVEYDICIFATGSKAFVLPIPGSNLPSVIGWRTIDDTNKMIEIAQTKKRAVVIGGGLLGLECARGLLDQGMEVTVLHLADWLMEMQLDRKAGEMLKADLEKQGMKIELQANSKEIIGDKDVEAIKLADGRVIETDLVVMAVGIRPYTEVAKDSGLDVNRGIVVNDYMQTSDSHIYAVGECAEHDGKVYGLVAPLYEQGKVLADYLTGKETKGYKGSTTFTSLKVSGCDLYSAGQIVEDEDVHGVEIFNSVDNIYKKVYLSQGQVVGAVLYGDTDDGSRFYNMMKKHETLEDYTLVSLLHKGDEDAGTSIADMSDDETICGCNGVDKGTIVNAITSKGLTSVDEVTKATKAGNSCGKCKGQIGELLQYTLGDDFIAAKPTGICPCTDLTRDQIVTQIRAKNLKSSKEVRHVLDFKDKDGCPKCRPAINYYLNMVYPFEHRDEKDSRFANERYHANIQNDGTFSVIPQMRGGVTDADQLIRLGEVAKKYNVPLVKVTGSQRVGLYGLKKEELPQVWKDLGMRSASAYGKKTRSVKSCVGKEFCRFGTQYTTRLGIRLEKTFEYIDTPHKFKMGVSGCPRSCVESGVKDFGVISVENGYQIFIGGNGGTDVTVGKLLTTVETEDEVIQLCGALMQYYRETGVYAERTAPWLERMGFENVKNVLLNQEKQKELYLRIMEAKKAVENEPWETIVENKEAQKIFEVEKV

SEQ ID NO: 15052 - protein, 512 aa, Unknown
  Candidatus Desulfococcus oleovorans Hxd3
MAHSMKGKVYLVGAGPGDPALITLRGLECIRMADVVVYDYLAADQLLHHRSENAEVIYVGKKGGDHTLSQNKINDLIVEKAEQGLVVTRLKGGDPFIFGRGGEEAEILAARNIPFEIVPGVTSAIAAPAYAGIPLTHREHTTSVSFITGHEDPTKEQSTIHWQALAETGGTLVFLMGVKNLSFIVDRLMEHGRPGTTPAALVRWGTTPMQQTVTGTLDTIVDRVKAAGLQAPCIIVIGGVVNLRETIAWFEASRPLLGKTIVVTRARAQASDFIAALSRLGAACIECPTIRVAPPDDTAPLDTAIDNLAAYDWLVFTSVNGVDRFFARLFEKGGDVRRLGHLKTAVIGPATEQRLLDFGVKSDIVPESFRAESVVEAFTRQDVKGKSVLLPRAAEARPILPEELTKMGARVDEVAAYVTRQDDSAAKTLTEALESGAVDMVTFTSSSTVKNFKALLPKDKSTADRLIKNVAVASIGPITTETAKDEGFAVHVTADAYTIEGLTRAIIDYFKA

SEQ ID NO: 15053 - protein, 112 aa, Unknown
  uncultured bacterium 578
MKLVTAILRPEVLNKVREALCDVDIPGMTVTEVKGFGKQKGRTELYRGTEFTVEFVHKVKLEIAISNKNLDLLIDTISDIARSGKKGDGKIFVTEIEKVVRIRTGETDLDAL

SEQ ID NO: 15054 - protein, 146 aa, Triticum aestivum
  misc_feature (113)..(113): Xaa can be any naturally occurring amino acid
HAGVAGFASRGPPCGVGRHWVLSQRPPIWVPGDLDVGDRGRSMAVGAALYQSVVTGCSTGLSRGMGRFVFFDFQREYMAKQFPDQNGKTHLETAHEPPTELGGIVKCKETEGXPPPPLVAWGSIGHIVAYYILATTSKGDDPPLFG

SEQ ID NO: 15055 - protein, 570 aa, Nostoc punctiforme
MTNSKPRDVQVLPIATNTKAIRARSWSRLRFEIEYALERGTTSNCYLIEADKTALIDPPPESFTEIYLEALRQTLDLQSLDYIILGHFSPNRVATLKAILELAPQVTFVCSLPGANNLRAAFLEQDLKVLVMRGKETLDLGKGHVLKFLPTPSPRWPEGLCTYDRQTQILYTDKLFATHLCGDEVFDDNWEALKEDQRYYFNCLMAPQTPHVQAALEKISDLQVRMYAVGHGPLVRTSLIELTKAYGEWSRSHNDREISVALLYASAYGNTATLAQAIALGLTKGGVAVKSINCEFATPDEIRINLAQSEGFIIGSPTIGGHAPTPIHTALGIVISSGDNSKLAGVFGSYGWSGEAFDLIEGKLRDSGYRFGFDTLKVKFKPDDVTLKFCEELGTDFAQALKKAKKVRVPQQAATPVEQAVGRIVGSVCVVTAKQGEVSTAMLGAWVSQATFNPPGITVAIAKERAIESLMYPGGKFALNILPEGNHQDYMKHFRKSFAPGEDRFANFSTAVADNGCTVLTDALAYLECSVNQRLECGDHWVVYATVDEGKLLKPDAVTAINHRKTGTHY

SEQ ID NO: 15056 - protein, 572 aa, Nostoc punctiforme; identical to SEQ ID NO: 485

SEQ ID NO: 15057 - protein, 289 aa, Solanum tuberosum
MASSSSSLHFLSLTPQTLPKPTSQTTSISFFSLPPSSLNLSLSSSSTPRNFESSRFVRKVTLSDFDQIEEVEAGDDDEEEGGLSDEGASYEERNANPDLKIFVGNLPFSVDSAALAELFERAGDVEMVEVIYDKLTGRSRGFGFVTMSSKEAVEAACQQFNGYEIDGRALRVNSGPAPPKRENSFGDNSSYQGGRGGGSMDSSNRVYVGNLAWSVDQQQLETLFSEQGKVVDAKVVYDRDSGRSRGFGFVTYSSAKEVNDAIESLDGVDLGGRAIRVSPAEARPPRRQF

SEQ ID NO: 15058 - protein, 444 aa, Clostridium difficile
MRVIIIGGVAAGMSAAAKLKRIKPEYEVVVYEKTEIVSFGACGLPYFVGGFFNDADELLARTPEKLREAGIDLNIFREVVEVDSESKKIKVKNIKTDEIYEDYYDKLMIAAGARSIMPPIKNIKLKNVSTLKSLYDGEYLKKLLSNEDNKRVTIIGAGFIGLEAVEACKKLGKDVDVIQLEDRILPQVFDKEMTDVLEEEINRHNVNLHLDEMVVELCGEDKVEKVITNKGEIDTDVVIIATGVRPNTEFLSNTNIKMLKNGAIVVDEYGRTSVEDIYSAGDCATIKNIVSNENVYVPLATGANKLGRIVGENLAGREVSYQGSLSSSCIKIMDMEAASTGITEKQAKDLGINVKSKFISDYNQTHYYPGRNKIYVKLIYDADTKVILGGQVAGFKDAVQRANVLAAAIFGKMTTNQLGMLDLCYAPPFARTWDVLNVAGNVSK

SEQ ID NO: 15059 - protein, 207 aa, Methylobacillus flagellatus
MKRRPTSKAWLQEHVNDEFVKRAQRDGYRARAAYKLLEIDDKDQLIKPGMTIVDLGSAPGSWSQVAVQRLAGQGRVIALDILEMPPIPGVEFIQGDFREEEILLVLEKSLNGKPVDLVIADMAPNISGISDVDQARAAYLVELALEFSREWLKPGGNFLVKVFVGSGFDEIVMAMRDSFEKVVTRKPKASRDRSSEVYLLGLKRRNA

SEQ ID NO: 15060 - protein, 173 aa, Silicibacter pomeroyi
MVRIIFLIVLLLVGRSVQAGAVSGSFPSIDGGTLSLEEWRGQPVLVVNTASQCGFTGQYAGLQALWERYQSAGLVVLAVPSDDFNQELATAAEVKEFCALNYALTLPMTNILHVKGADAHPFYKAVKAETGFEPAWNFNKVLVAPDGSIAATFGSAVKPDSARMQREIEALLN

SEQ ID NO: 15061 - protein, 118 aa, Nicotiana tabacum
AVTIRPRVEVQGGDMRTFFTLVITDPDVPGPSDPYLREHVHWIVTDIPGTTDATFGKELVSYEIPRPNIGIHRFVFVLFKQKCRQSVSPPTSRDHFNTRNFANVNDLGPPVAAVFFNA

SEQ ID NO: 15062 - protein, 376 aa, Unknown
  Synechococcus sp. WH 7805
MADYYELLGVSRDADADTLKRAYRRLARQYHPDINKEPGAEDRFKEIGRAYEVLSDPQTRGRYDQFGEAGLGGAAGMPDMGDMGGFADLFETFFSGFGGAAGGGRQQRRRGPQQGDDLRYDLTIDFEQAVFGQEREIRVPHLETCTTCGGSGAKSGSGPTTCSTCGGVGQVRRATRTPFGSFTQVAECPTCNGSGQVIADPCNACGGQGVVQVRKKLRINIPAGVDTGTRLRVAGEGNAGLRGGPSGDLYVFLTVKNHPTLRRDGLTVLSEVKVSYLQAILGDTIEVETVDGPTSLEIPAGTQPNAVITLENKGIPKLGNPVARGNQRVAVTVKLPTRLNNEERGLLEELAGHHSARGEQHHHHKSGLFARLFGQR

SEQ ID NO: 15063 - protein, 420 aa, Streptococcus mutans
MIFDKDNYEEYDREVWEAIHAEEKRQQNNIELIASENVVSKAVMKAQGSILTNKYAEGYPGRRYYGGTDYVDVVESLAIERAKKLFGAKYANVQPHSGSQANAAAYMALIKPGDTVMGLDLAAGGHLTHGSPVSFSGQTYNFIAYNVDPETEVLNYEQILKQAEEVQPKLIVAGASAYSHIIDFKKFRDIADQVGAKLMVDMAHIAGLVAAGLHPNPLPYAHITTTTTHKTLRGPRGGLVLTNDEDLAKKINSAIFPGLQGGPLEHIVAAKAITFKENLDPAFKVYAQKIIENCQAMVEVFNAHEKFRVVSGASENHLFLVDVTQVVENGKVAQNILDDVHITLNKNSIPFEKLSPFKTSGIRIGTAAVTARGFGPEECRKVAELIVKTLENTENEAVLEEVRQEVKLLTDAFPLYENLV

SEQ ID NO: 15064 - protein, 557 aa, Kluyveromyces lactis
MASKNTYSDFKLATELPAWNQLQSLYEQKGKKLNVKDEFAKDNSRYEKFAKTFVNYDGSKILFDFSKNLVDDEILKSLIQLAKEAKVTSLRDAMFNGEPINFTEGRAVYHVALRNRSLKPMYVDGTNVTPEVDAVLQHMKEFTEEVRSGAWKGYTGKSITDVVNIGIGGSDLGPVMVTEALKHYATNLKVHFVSNIDGTHIAETLKDLDHETTLFLIASKTFTTAETITNATQLELKNWFLSKNGGDQSHISKHFAALSTNATEVEKFGIDTKNMFGFENWVGGRYSVWSAIGLSVALYIGFDNFEAFLKGAEAVDKHFVETPLEDNIPLLGGLLSVWYNNFFDAQTHLVAPFDQYLHRFPAYLQQLSMESNGKSVTRGNVFANYSTGSILFGEPATNAQHSFFQLIHQGTKLIPSDFILAAQSHNPIENNLHQKMLASNFFAQAEALMVGKDEEQVKSEGATGGLVPHKVFSGNRPTTSILAQKITPATLGALIAYYEHVTFTEGRIWNINSFDQWGVELGKVLAKVIGSELATDNKISSHDSSTNGLINQFKEWI

SEQ ID NO: 15065 - protein, 305 aa, Streptococcus pyogenes
MYDTLIIGSGPAGMTAALYAARSNLSVAIIEQGAPGGQMNNTFDIENYPGYDHISGPELAMKMYEPLEKFNVENIYGIVQKIENFGDYKCVLTEDASYEAKTVIIATGAKYRVLGVPGEEYYTSRGVSYCAVCDGAFFRDQDLLVVGGGDSAVEEAIYLTQFAKKVTVVHRRDQLRAQKILQDRAFANDKVDFIWDSVVKEIQGNDIKVSNVLIENVKTGQVTDHAFGGVFIYVGMNPVTGMVKDLEITDSEGWIITDDHMRTSIPGIFAIGDVRQKDLRQITTAVGDGAIAGQGVYHYLESFPS

SEQ ID NO: 15066 - protein, 601 aa, Pisum sativum
MATFTASPSNTWINTKSSSRTNSSSILLNKKRSTSKNTISCSLQTTLPFPKKYQPQSTNTTTTTLIPTRETKPNLPSNTKPLHKQEQKWNLLQQAAATTLDFVETTLIKQESKHPLPKTSDPRVQIAGNFAPVPEHPVTQNLPITGKLPKGIDGVYLRNGANPLHEPVAGHHFFDGDGMVHAVKFTNGSVSYSCRFTETHRLAQEKALGRPVFPKAIGELHGHSGIARLMLYYARSLCGLVDGTHGMGVANAGLVYFNNRLLAMSEDDIPYHVRVTPNGDLTTVCRYDFNDQLKSTMIAHPKVDPVDKNLYALSYDVVQKPYLKYFRFDSNGVKSPDVEIPLAEPTMMHDFAITENFVVVPDQQVVFKLGEMIRGGSPVVYDKEKVSRFGVLSKNAENASEMKWIDAPECFCFHLWNAWEEPENDEVVVIGSCMTPADSIFNECDESLKSVLSEIRLNLKTGKSTRRAIIQESEHMNLEAGMVNKNKLGRKTQFAYLALAEPWPKVSGFAKVDLFSGEVKKYLYGENRFGGEPLFLPNEDSENEDDGYILTFVHDEKEWKSEIQIVNAVNLKLEACIPLPSRVPYGFHGTFIHSKELEKQE

SEQ ID NO: 15067 - protein, 302 aa, Oryza sativa
MSLGFCGGGAAGAPAAGGAVAGGGGPGGGPPATSVHELLECPVCTNSMFPPIHQCQNGHTLCSTCKARVHNRCPTCRQELGDIRCLALEKVAESLELPCKYCSLGCPEIFPYYSKIKHEAQCSFRPYNCPYAGSECAVAGDIPFLVAHLRDDHKVDMHSGCTFNHRYVKSNPREVENATWMLTVFHCFGQYFCLHFEAFQLGMAPVYMAFLRFMGDENEARNYTYSLEVGGNGRKMVWEGTPRSIRDSHRKVRDSHDGLIIQRNMALFFSGGDRKELKLRVTGRIWKEQTNPDGACIPNLCS

SEQ ID NO: 15068 - protein, 436 aa, Unknown
  Synechococcus sp. WH 5701
MSGVLETLAFFRDPDFARSRFERYGDVYETTLLGQRTVFIRGGQAVGDLFAQGDAVQGWWPDSVRKLLGPLSLANRNGVDHKARRRVVGQLFTTVALKRYSPAIVALVNELSHDLLGCAAPVALVPRLRRFAFSVIASTVLGLDPVDRDALFVDFETWCQGLFSLPFALPGSPYARARQARGRLLLRLGSVLNKAQAAVAAGKPLAAGGLDLLAGGLDEAGLPLADDDVAEQLLLLLFAGYETTASSLSCLLQTLLQHPAELAWLQQELGALSWPPPQGEATTAYDAIRAPRLDAVVKEVMRLTPPVGGFFRRTLEPIALAGVLVPADRVVQVSIAASHRHGREDEDLEVFRPQRHLAGDSTATLLPYGGGERVCLGKSLAELEIRLLTVGMLKQLMLVLKPDQDLTLRVIPSPSPTDGLLVRPLPRATGLHSPVR

SEQ ID NO: 15069 - protein, 64 aa, Protea revoluta
MPGQWEYQVGPSVGIEAGDHIWCSRYLLERITEQAGVVLTLDPKPIEGDWNGAGCHTNYSTKSM

SEQ ID NO: 15070 - protein, 605 aa, Triticum aestivum
MDTHIGSVDGPSPAAVNGAVGCPASAPGCPIMSSHPVVSPGEASLGRHLARRLVQVGVSDVFAVPGDFNLTLLDHLVDEPGLRLVGCCNELNAGYAADGYARARGVGACAVTFTVGGLSVLNAIAGAYSENLPVICIAGGPNSNDYGTNRILHHTIGIPDFSQELRCFQTVTCHQAVVTNLDDAHEQIDTAIATALRESKPVYLSISCNLPGLPHPTFTRDPVPFFLAPRMSNKMGLEAAVEATVEFLNKAVKPVLVAGPKLRVAKAGKAFVDLVDASGYAYAIMPSAKGFVPETHPHFLGTYWGAVSTAFCAEIVESADAYLFAGPIFNDYSSVGYSFLLKKDKAIIVQPERVIVGNGPAFGCVMMKEYLSALAKRVQKNTTAYENYKRIFVPEGHPLKGEANEPLRVNVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYTIEVEIHDGPYNVIKNWNYTALVEAIHNGEGKCWTAKVKCEEELTAAIEMALGEKEDSLCFIEVIAHKDDTSKELLEWGSRVSAANSRPPNPQ

SEQ ID NO: 15071 - protein, 455 aa, Schizosaccharomyces pombe
MEANFQQAVKKLVNDFEYPTESLREAVKEFDELRQKGLQKNGEVLAMAPAFISTLPTGAETGDFLALDFGGTNLRVCWIQLLGDGKYEMKHSKSVLPRECVRNESVKPIIDFMSDHVELFIKEHFPSKFGCPEEEYLPMGFTFSYPANQVSITESYLLRWTKGLNIPEAINKDFAQFLTEGFKARNLPIRIEAVINDTVGTLVTRAYTSKESDTFMGIIFGTGTNGAYVEQMNQIPKLAGKCTGDHMLINMEWGATDFSCLHSTRYDLLLDHDTPNAGRQIFEKRVGGMYLGELFRRALFHLIKVYNFNEGIFPPSITDAWSLETSVLSRMMVERSAENVRNVLSTFKFRFRSDEEALYLWDAAHAIGRRAARMSAVPIASLYLSTGRAGKKSDVGVDGSLVEHYPHFVDMLREALRELIGDNEKLISIGIAKDGSGIGAALCALQAVKEKKGLA

SEQ ID NO: 15072 - protein, 423 aa, Unknown
  Mesorhizobium sp. ZJ15B7
WGFDGSSTMQAEGRSSDCVLKPVALYPDPARTNGILVMCEVMMPDGVTPHESNSRATILDDEDAWFGFEQEYFFYKDGRPLGFPESGYPAPQGPYYTGVGYKNVGDVARKIVEEHLDQCLAAGINHEGINAEVAKGQWEFQIFGKGSKKAADQIWMARYLLLRLTETYGIDIEFHCKPLGDTDWNGSGMHCNFSTKFMREVGGKAYFEALMAQFDKNLMDHIAVYGPDNDKRLTGKHETAPWNKFSYGVADRGASIRVPHSFVKNDYKGYLEDGRPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 15073 - protein, 319 aa, Vibrio parahaemolyticus
MSDVKHCKLLILGSGPAGYTAAVYAARANLNPVLVTGMQQGGQLTTTTEVENWPGDAEGLTGPALMERMKEHAERFETEIVFDHINEVELSQRPFRLKGDSGEYTCDALIISTGASAKYLGLESEETFKGRGVSACATCDGFFYRNQKVAVVGGGNTAVEEALYLSNIASEVHLIHRRDSFRAEKILINRLMDKVENGNIILHTDRTLDEVLGDDMGVTGVRIKDVNTGTTEDLEVMGAFIAIGHQPNTQIFEGQLEMKDGYIVVKSGLEGNATQTSIEGVFAAGDVMDHNYRQAITSAGTGCMAALDAERFLDALSDK

SEQ ID NO: 15074 - protein, 423 aa, Unknown
  Mesorhizobium sp. HN8A1
WGFDGSSTMQAEGRSSDCVLKPVALYPDPARTNGILVMCEVMMPDGVTPHESNSRATILDDEDAWFGFEQEYFFYKDGRPLGFPESGYPAPQGPYYTGVGYKNVGDVARKIVEEHLDQCLAAGINHEGINAEVAKGQWEFQIFGKGSKKAADQIWMARYLLLRLTETYGIDIEFHCKPLGDTDWNGSGMHCNFSTKFMREVGGKAYFEALMAQFDKNLMDHIAVYGPDNDKRLTGKHETAPWNKFSYGVADRGASIRVPHSFVKNDYKGYLEDRRPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 15075 - protein, 291 aa, Saccharomyces cerevisiae
LVHVASVEKGRSYEDFQKVYNAIALKLREDDEYDNYIGYGPVLVALAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 15076 - protein, 173 aa, Methanococcus maripaludis
MALRPARCYRTIERRSYTRKEYVRAVPQPKVVHYVMGNPSAEFPVQVQLVSKSDILIRHNALESSRIAGNKYILSECGRTGYLFNIRVYPHEILRENKMAAGAGADRISDGMRLSFGKAVGTAAKVKKGQEIITIGVNPEKFYAAKEALRRCSMKLPTACKIVVTKGKELIKD

SEQ ID NO: 15077 - protein, 567 aa, Ehrlichia ruminantium
MFMENLQTSLESENYLQNIKKIKSNKFISHTLETEGYDNNNEDTEFQHALKEFMDSSVKEGQIIEGTIICIDKGYVTIDSGLKSESIISLKEFELGDDYQNIGVGSKVKLYLEKMEGRNGSVVLSREKAIRSELWQKLEEAAENKEDVEGVIFSSIKCGYTVDIKGVVAFLPASHVALRQVKDITPLLGKKQKFRILKMDKKQGNIVVSRKAILEESLADAKSLYLSQLNEGDIIEGKVKSITKYGVFIEIHESPSVGVVDGLLHITDISWSRVNHPSAVFSCGQTVRTKIIKIDRENKKISLGVKQLEESPWSNIEKKYPVDSVHKGIVTSIEEYGIFVELEVGIEGLVHVSEVSWTKSSLPINQLFMRGEEIQVKVLSIDTAKSRMSLSMKRCQDNPWEAFTLKYPLGSIVLTKVKNITNLGIFVSFQDETLNSGIEGLIRITELSWSLPPEAAVKKYSIGDSIEAKILMINTNKSKIDLGIKQLEYDPFLDLLKRTNLGDKIPVTVTKVVEDTGILVDVFNGSNSFNLLIEQEYLPDNKKFFPGDKLEAEVLLIETYNMILSLK

SEQ ID NO: 15078 - protein, 294 aa, Oryza sativa
MAAATSTAAYWLAEHPAIVSFRWSPTGLWFSTWAFLLGFLASYVALCLALDAILAALLRRRRPLPLGPLPAAHALLMAAVSAAIFAGTLLSALAEIRDTRWSWRGRSRTTPFRWLLCFPPGTRSSGRVFFWSYAYYLSRYLHAARGLFAVLQRRRGAAARVFAHAASVAMAFLWLEFSQSFQVLAILASTLAHAVAFGFRFWVGAGLPAARGAPVALACQCALLGCNLLCHVGVVWMHFGGVAGGGCSGIGAWVFNTLLNAALLWVFLHCYGKRGVCDDDGGATAASARHDKDL

SEQ ID NO: 15079 - protein, 372 aa, Streptococcus pneumoniae
MNNTEFYDRLGVSKNASADEIKKAYRKLSKKYHPDINKEPGAEDKYKEVQEAYETLSDDQKRAAYDQYGAAGANGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGDLKVNPKKKGFFDHIKDAFDGE

SEQ ID NO: 15080 - protein, 277 aa, Arabidopsis thaliana
MTREFELENNYQLCDEIGRGRFGTITRCFSPATKEFYACKTIDKRVLIDALDRECIETEPRIMAMLPPHPNIIRIFDLYETEDSLAIVMELVDPPMTIYDRLISAGGRLSESESASYAKQILSALAHCHRCDVVHRDVKPDNVLVDLVSGGVKLCDFGSAVWLGGETAEGVVGTPYYVAPEVVMGRKYDEKVDIWSAGVVIYTMLAGEPPFNGETAEDIFESILRGNLRFPPKKFGSVSSEAKDLLRKMICRDVSRRFSAEDALRKSSFFSRFFFFF

SEQ ID NO: 15081 - protein, 438 aa, Methanococcus maripaludis
MNGELSFKYDNVMEENLGNLGISNGKLESFNNESSKIIEILKEKELNGEFGFLDVLNDNLDKYYELNEYSKNFENILIIGIGGSNLGLRAAETGILGSFTSRYEIPRIYYMDNSDPEKTHDILSNIDLEKTLVFVISKSGNTVETLANFFIVRNLMKKKNIDLEKHVVSITSGGELEKITKKENYIHFEVPENVGGRFSVLSSVGIAPLSCTSVDIKKLIDGAKSIEKSCKCEDIFKNPALMNAVIHKLMYNRGKTVSVMMPYIERLRSFGMWYGQLWAESLGKNGFGQTPVIAVGATSQHSQLQLYMDGPNDKIATFLKVNKYRNDLKIEYEYDHHLSGHNLSEVITSELVGTENSMKHNNIPNVKITLSKLNEITMGKLFLMYEMQTAISGELYGINAFDQPAVEYGKKIAHECLTGSKVDSENKYINGKYIITSK

SEQ ID NO: 15082 - protein, 125 aa, Glycine max
MIAFLKARRGFVRVAMVKGKPLVPVFCFGQSNVYKWWKPGGKLVLNFARAVKFSPVYFWGIFGSPIPFKHPMHVVVGRPIELEKTPEPTPEEVAKIHSQFVEALQDLFERHKARAGYPNLELRIV

SEQ ID NO: 15083 - protein, 127 aa, Oryza sativa
MGRRPARCYRYCKNKPFPKSRFNRGVPDPKIRIFDLGRKRASVDEFPFCCHLVSNEYEQLSSEALEAARICANKYVTKTSGKDSFHMRVRVHPYHVIRINKMLSCAGADRLQTGMRGAWGKPYGTVA

SEQ ID NO: 15084 - protein, 462 aa, Unknown
  Frankia sp. CcI3
MTDMQAFDHVIDLVGNTPLVRITPTIETTPTPVLAKLEYLNPGGSVKDRVALTMVSAAEEAGLLPPGGTIIEPTSGNTGVGLALVAARRGYRCVFTMPDKISEEKRAVLRAYGAEVVICPTAVAPDDPRSYYSVARRLVRETPGGWSPDQYSNPNNPAAHYATTGPEIWQATNGRVTHFVAGIGTGGTISGVGRYLKEASGGTVQIVGADPEGSVYSGGSGRPYLVEGVGEDIWPTTYDKTVVDRVEAVSDRDSFLMTRELARKCGLLVGGSGGLAVVVALRVARELGPDDAVVVLLPDSGRGYLSKIFNDEWMYEYGFLEPPSNEPTVSDVLRNKAEQTSGPPDLVHVHPAETVGAAISYLREYNVSQMPVVRHEPPLRAAEVAGSVIERHLLAAVFADRSAIDAPVADHLSPSLPMVGTGEPLARIVAVLGDEPAVLVHDEGNPVGILTRADLLSFLAVR

SEQ ID NO: 15085 - protein, 646 aa, Triticum aestivum
  misc_feature (640)..(640): Xaa can be any naturally occurring amino acid
MLSLRSDARHLAAPVVRGGDDVWLGVSGGAGPAPEGPAPAAAFLLPPVSLDARAKQLVGVNEEDHLALAHQSYKSGKYSQALEHGNAVYEKNPRRTDNLLLLGAIYFQLRDYDLCIAKNEEALAIDPQFAECYGNMANAWKEKGDIDLAIRFYLTAIQLRPNFCDAWSNLASAYTRKGRLNEAAQCCKQALLLNPRLVDAHSNLGNLMKAPGLVQEAYACYLEAIRIDPHFAIAWSNLAGLFMEVGDLNKAMQYYKEAVKLKPSFADAHLNQGNVYKAMGMLQEAVACYQRALQARPDYAMAYGNLATIYYEQRQLDMAIHCYNQAILCDSRFVEAYNNMGNALKDAGRVEEAINCFQSCLVLQANHPQALTNLGNIYMEWNMISTAASFYKAAIAVTSGLSSPLNNLAVIYKQQGSYADAIACYTEVLRIDPTAADALVNRGNTFKEFGRVAEAIQDYIQAVTIRPNMAEAHANLASAYKDSGHQEAAIASYKQALCLRPDFPEVTCNLLHTLQSVCDWENRDTMFREVEEIIRRQIKMSLLPSVQPFHAIAYPIDPLLALEISRKYAVQCSLIASRFGLPPFVHPPPLPVKAEGKHGRLRVGYVSSDLGNHPLSHLKGSVLGMHDRDNVEVFCYALSXQNDGTE

SEQ ID NO: 15086 - protein, 522 aa, Aspergillus oryzae
MDNSETVPSNADQAKNAHNVNNRRESFSSQNSQTAKEFIESQMQLEADAREILPYSFDSCTKALGPLRQTLYACLTCNPPPKTADEPHAAAGVCYSCSIACHGEHTLVELFNKRNFVCDCGTTRVPSSAPCTLRNDPKTGTKGVHSEEPHPENKYNQNFQNKFCGCSEDYNAEEEKGTMFQCLGLGTAESGGCGEDWWHPECLIGLPRDWYKDFKKEAGGNGQIEDDEETPLPPGFPGEDDFETFLCYKCVDSNPWLKRYAGTVGFLPPVYKEGGLPKTTKTAPETTATDVKEEEPTNPKKRKMEDEEEGEPTAKRIKEDSENTPSDSKPEPNSAPKEEPTQPPPLKNKHDSLTDPVPSGAFSLFLKEDFRDHFCRCRDCYPNLAPHIQLREEEETYEPPLSEDGEANGGGSTGTGSLLDRGEAALSNIDRVRAIEGAMVYNHLRDKVKEFLKPFAETGKAVGAEDIKSYFEKLRGDEQHIRDAAGQASALSGKDDSNDNEGGGGRREQNGTCKRHFLGNDR

SEQ ID NO: 15087 - protein, 143 aa, Dehalococcoides ethenogenes
MEEPKITLGLIAHNNCKKDMVHLIQAYAHLMKGHHLIATKSTGELIRKHTGLPVILKESGPDGGELQLGGFVASGIIKAVIFLRDPLKRKSHEPDVTALMRVCDAHNIPLATNRATAACVLHTVLFHPDKLEDMPPKESDDDP

SEQ ID NO: 15088 - protein, 416 aa, Streptococcus pyogenes
MTDMRRLGQRAKQASLLIAPLSTQIKNRFLSTLAKALVDDTQTLLAANQKDLANAKEHGISDIMMDRLRLTSERIKAIAQGVQQVADLADPIGQVIKGYTNLDGLKILQKRVPLGVIAMIFESRPNVSVDAFSLAFKTNNAIILRGGKDALHSNKALVKLIRQSLEKSGITPDAVQLVEDPSHAVAEELMQATDYVDVLIPRGGAKLIQTVKEKAKVPVIETGVGNVHIYVDAQADLDMATNIVINAKTKRPSVCNAAEGLVIHEAVAARFIPMLEKAINQVQPVEWRADDKALPLFEQAVPAKAEDFETEFLDYIMSVKVVSSLEEAISWINQHTSHHSEAIITRDIKAAETFQDLVDAAAVYVNASTRFTDGFVFGLGAEIGISTQKMHARGPMGLEALTSTKFYINGDGHIRE

SEQ ID NO: 15089 - protein, 625 aa, Glycine max
  misc_feature (450)..(450): Xaa can be any naturally occurring amino acid
IRLEEFMLKKKTWDLGREVDHIMRQKEAAMHVRMLTQEIRKSLDRHTILYTTLVELSKTLGLQNCAVWMPNVDKTEMNLTHELNGRNFNLTIRITDPDVVRIKGSDGVNILSSDSALAVGSRGVSGEAGPVAAIRMPMLRVCNFKGGTPELRQACYAILVLILPSGDNQEPRSWSNQELEIIKVVADQVAVALSHAAILEESQLMREKLEEQNRALQQAKRNALMASQARNAFQKVMSDGMRRPMHSILGLLSMIQDDKLKSEQKLIVDAMLRTSNVLSNLINDAMDNSTKDEGRFPLEIRSFGLHSMLKEAACLSKCMCVYKGFGFMVEVEKCLPDNVMGDERRVFQVILHMVGNLLEHNHGGGILVYRVFAETGSQGRSDKGWTTWRPSSSSGDVNIRFEIGINSSDSEVGSSISSGFGGRKYSSDRVGGRLSFSICKRVVQLMQGNXIWLVPCNHGFPQSMTLLLRFQLRPSISIAISDPGEGSERTDSNSMLRNLQVLLVENDDVNRAVTQRLLQKLGCVVTPVASGFECLTVIGPAGCSIQVILLDLHMPDLDGFEVATRIRKFRSGNQPMIVALTASAEEDLWERCMQVGINGVIRKPVLLHGIASELRRILMQGNNVL

SEQ ID NO: 15090 - protein, 163 aa, Brassica napus
  misc_feature (119)..(119): Xaa can be any naturally occurring amino acid
MVRKQFQQAKTGVEALKAMDANKYLKKVGLGRDDMFFWKQVGKALLCTYTIFGMAWLYNETSPLGWWTLKPRPKEERELAHLYERREFPYPGDTEAMEDFVAKGGMIGTAIGPKGVVGXSKAKGDNYQKEMEKKKFDKEAQKLWLRMRNEVMTELQEKGYDLE

SEQ ID NO: 15091 - protein, 273 aa, Streptococcus pyogenes
MMKRQFEDVTRIVIKIGTSSLVLPTGKINLEKIDQLAFVISSLMNKGKEVILVSSGAMGFGLDILKMEKRPTNLAKQQAVSSVGQVAMMSLYSQIFAHYQTNVSQILLTRDVVVFPESLANVTNAFESLISLGIVPIVNENDAVSVDEMDHATKFGDNDRLSAVVAGITKADLLIMLSDIDGLFDKNPTIYEDAQLRSHVAVVTQEIIASAGGAGSKFGTGGMLSKIQSAQMVFENKGQMVLMNGANPRDILRVLEGQPLGTWFKQIEEVTHD

SEQ ID NO: 15092 - protein, 449 aa, Burkholderia xenovorans
MTVETTSIDTLVVGAGQAGVAMSEHLSRLGVPHLVLERARIAERWRTGRWDSLVANGPAWHDRFPNLEFADVDPDAFAPKEQVADYFVAYAKKFDAPIRTGVEVKNVVRNAGRQGFTIETSEGTIEARRVVVATGPFQRPVIPPIAPQDSSLTQIHSADYRNPGQLPEGGVLVVGGGSSGVQIADELQRAGRRVYLSVGAHDRPPRAYRGRDFCWWLGVLGEWDAEVMKPGREHVTIAVSGARGGHTVDFRRLANQGITLVGLTKSFDNGVATFETDLAENIARGDENYLSLLDAADAYAARNGLDLPEEPEARVIPADPECVTHPLHDLDLAKAGVTSIVWATGYALDFSWLNVDAFDEKGKPKHQRGVAKEPGIYFLGLPWLSRRGSAFIWGVWHDAKHIADHIVTQRKYLAYYDDSQRHAQGGSEQSTGNTSADSRVHKVSELGVN

SEQ ID NO: 15093 - protein, 429 aa, Leuconostoc lactis
MAHALKRILYATWYPDILVNYTHSVNCRRTLDVMSETNNEFLAALESAADQIKVGDVVTGELLAIDNDNQAVVGLSTGEEGVVPAREYSDDRNINLADELKIGDTIEAVVISNVTSDKEGVAYLLSKKRLDARKAWENLSFAEGDTVDAKVINAVRGGLIVDVNGVRGFVPASMVAERFVSDLNQFKNKDIKAQVIEIDPANARLILSRKAVAAQELAAQLAEVFSKLSVGEVVEGTVARLTDFGAFVDLGGVDGLVHVSEISHDRVKNPADVLTKGDKVDVKILALDTEKGRISLSIKATQRGPWDEAADQIAAGSVLEGTVKRVKDFGAFVEILPGIEGLVHVSQISNKRIENPSEVLKSGDKVQVKVLDIKPAEERISLSMKALEEKPEREDRRGNDGSASRADIAAYKQQDDSAATLGDIFGDKL

SEQ ID NO: 15094 - protein, 574 aa, Aspergillus nidulans
MASIYIDEDAGRDDQTANGSESAPYKTLLHAFLQHDPSEGTQYLTRKSLTEPTGEGADPESKLEWKPATKSAIKKATNLLEQRKKKAAKEQQLAIREKEEAEKRRLVLEEAKKVVIKEDTSLPKPVRIRLDVTDPAIVKLGSPESDTPGTRVRVLGRVHRLRSQKDMIFLTLSDGYGYLQCVLTGDLVKTYDAMTLTLETSIALHGEMRAVPPKQHAPNNRELHVDFYTIIGRAAGDKEAITTRVAHDSDPQTLYNNRHLVLRGETASSVMKVRAATLKAFRQTFDELRMTEVTPPAMVQTQVEGGSTLFKFDYYGEDAYLTQSSQLYLETCIPSLGDVFCVCPSFRAEKSLTRRHLSEYTHIESELDFIEFTDLLDHLEAVICRVLEIVLADPVAKPIIAQLNPGFQMPSRPFLRMKYSDAIEWLREHEIPNEEGKPHEFGDDIAEAAERKMTDIINRPIFLTHFPAEIKAFYMKKDPEDRRVTESVDVLMPGVGEIVGGSMRMDDWDELMAAYKHEGMDPSPYYWYTDQRKYGTSPHGGYGLGLERFLAWLCARYTVRDCSLYPRFTGRCTP

SEQ ID NO: 15095 - protein, 522 aa, Triticum aestivum
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGQSDPSFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 15096 - protein, 1148 aa, Candida glabrata
MATTPSAVAAAAAAATTGNASANATTTTTTTANATNEQQLDPLTQSTAETWLSIASLAETLGDADRAAMAYDATLQHNASSTKGLTSLAHLYRSRDMFQKAAELYECALQVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILAQPPTPLQEWDIWFQLGSVLESMGEWQGAREAYEHVLLQNDHHAKVFQQLGCLYGMNNVQFYDPQKALSYLLKSLEVDPSDATTWYHLGRVHMIRSDYTAAYDAFQQAVNRDSRNPIFWCSIGVLYYQISQYRDALDAYTRAIRLNPYISEVWYDLGTLYETCNNQLSDALDAYKQAARLDPENIHIRKRLETLTAQLENPQEAAALQQQQQQQQLSTPSNGNVILSNNSQQQEFNQGSVQMMINNNANASPPVMLQPTLQVTDQVNPLNVRPAYPADQQPQQPQQLYSGAPLQQPPQTQQPPHTETQPLQQPVAPPSLPPTQIPNTLPQQPLPSQQQANLLPKANPMDISNANNQIPPRNPDIPSAEQAEPAYTAGAHQQSVGAAQPEAPESVGAAPKPDILNQPEAPKTEDNQLPQANIPEIKPMEVQNPTTQETETHQLPRIQPNAAPQTLPENGSINALVNAAVSSAPAPTNKNEREPDANEVEPAQKRQKLDDSPEAPQATESAPESVPESAPESAPESNIEPTNQEKEDLAKETTPTENTESAKSVKQEQQTQQEVSEPPVENGQEETTTSLPVPATEETNHNNETVGTAEDLKDEAMHDATQDGEKHQAVEESVTTDLPSTEQEKHLDEPAQKSEVEENTRAETAGYEEPSDLPDAQKSSETTGTTETAEAEHTEVTNVPSEVETSETAKPAETTADQLTGEINQEKQIEQPSEASESVPEEKTEVEQPKPAEEDSKGNDTPQEEVSISNTETTMADESSTQPVKDSTETNQNDPADNMTEESHGQDSTIDEADKGSIEENKDTPNEDFQKLQEGTSTDEKINNDEEMKEENDEPKITTTNENTEQNDSVNGEVQTNGTTEVEEAADETVIKPTAEALEKLEEEAKLREEEEKERLNNENNEDNKTEVTKDAVVREVEEDENYDD

SEQ ID NO: 15097 - protein, 333 aa, Unknown
  Candidatus Protochlamydia amoebophila UWE25
MKKIGYLGLGAWGYCLASLLASKGHKVVCWTTKPELAKHLTDTREHPLLAGHLSKGEMTFTTDMSEALKDVDMIVESVTSAGLRSVFEQVRSLGLPNCPIVITSKGIEQDTGMILPEVVIEVLGEEFRSLIGFLSGPSFAQEVIRELPTSVVGTGYTVEVIQEICETFMTPTFRVYPNTDILGVAFGGALKNIIGIACGISDGLALGCSSKAALMTRGLHEIRKLSVACGCKAETLNGLAGMGDLCVTCSSPISRNFRFGTLLAQGLSTEQARNRIGMVVEGAYTCVSALQLSKQHKIIMPISEAVYNIIQGTIKPIEAVSALMKRTIKEEHL

SEQ ID NO: 15098 - protein, 617 aa, Oryza sativa
  misc_feature (541)..(541): Xaa can be any naturally occurring amino acid
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIDHPSFLEKVWGKTGEKIYGPDTGVDYKDNQMRFSLLCQAALEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTARMSDKFQAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVXPSDVKKVAATLKRAIKVVGTPAYEEMVRNCMNQDLSWKGPAKNWENVLLGLGVAGSAPGIEGDEIAPLAKENVAAP

SEQ ID NO: 15099 - protein, 336 aa, Atropa belladonna
MEVNHNNGSTTKIILKNGSICNGDVNGNSHTHKKIENKLVECTNSIKPGWFSEFSALWPGEAFSLKIEKLLFQGKSDYQDVMLFESATYGKVLTLDGAIQHTENGGFPYTEMIVHLPLGSIPSPKKVLIIGGGIGFTLFEVSRYPTIDTIDIVEIDDVVVDVSRKYFPYLAAGFDDPRVTLIIGDGAAFVKAAQPGYYDAIIVDSSDPIGPAKDLFERPFFEAVAKALRPGGVVCTQAESIWLHMHLIKQIIANCRQVFKGSVNYAWTTVPTYPTGVIGYMLCSTEGPEVNFKNPVNSIDKDTSHVKSKGPLKFYNSDIHKAAFILPSFARDLVEF

SEQ ID NO: 15100 - protein, 159 aa, Listeria monocytogenes
MNVHDFSEKAMNGKEIALSDYKGKVLLIVNTASKCGLTPQLEGLEAMYKKLGGANFEILGFPCNQFLRQDPGSDEEILEFCQMNYGVTFQMFSKIKVKGKDASPLYKYLTEQTGGKKVEWNFAKFLIDENGEVVERFPSKMKPADFEDKVEALVAKVNN

SEQ ID NO: 15101 - protein, 456 aa, Vibrio parahaemolyticus
MTALAVTLKNWFFTRNSMILNANILLFIILFNTLPFEPQVVTGISILVFVAILWLTEAIHVSITALLIPMLAVFLGVFNTQAALNNFSNSIIFLFLGGFALAAALHKQKLDQALADKVLLIARGRMSVAVFMLFGVSAGLSMWISNTATAAMMLPLVLGVMTKLDAKKNHNTFLFVLLGIAYSASIGGIATLVGSPPNAIAAAEVGLNFTEWMKLGLPISLILMPIAILVLYTMTKPDLSHKFELDHKPVEWTNGKMVTLAIFLLTVTLWIFSKPINTMLGGFAKFDTLVAIGAILLLGASRAVEWKDIEKTTDWGVLILFGGGICLSNVLKATGTSVFLAHSLTGFLEQAGVLLTILSVVAFVVFLTEFASNTASAALLVPVFATIAEALGLSPVILSALIAVAASCAFMLPVATPPNAIVFGTGHIKQKEMMRIGFVLNIACIGALTLFAWLFW

SEQ ID NO: 15102 - protein, 251 aa, Haemophilus influenzae
MEAQPQQKENIMAQVSMRDMINAGVHFGHQTRYWNPQMKPFIFGARNGVHIINLEKTLPLFNEALAELTRIASNNGKVLFVGTKRAASEAVQAAALDCQQYYVNHRWLGGMLTNWKTVRQSIKRLKDLETQSQDGTFDKLTKKEALMRSREMEKLELSLGGIKDMGGLPDALFVIGADHEHIAVKEANNLGIPVFAIVDTNSTPAGVDFVIPGNDDATRAIQLYVSAAAAAVKEGRGNEAQVAEELAADAE

SEQ ID NO: 15103 - protein, 293 aa, Candida glabrata
MSEITHPTIVDGWFREISDTMWPGQAMTLKVEKVLHHEKSKYQDVLIFKSTNYGNVLVLDNVIQATERDEFSYQEMITHLAMNSHPNPKKVLVIGGGDGGVLREVVKHECVEEAWLCDIDEAVIRLSKEYLPDMAGVYSHPKVKTHIGDGFQFLRDYQNTFDVIITDSSDPEGPAETLFQQSYFELLRSALTDKGVITTQAESMWLHLPIIKDLKKACSQVFPVAEYAYTTIPTYPSGTIGFMVCSKDASANVKKPLREMTEEQEKKLLRYYNKRIHESSFVLPTWVAKELEL

SEQ ID NO: 15104 - protein, 307 aa, Triticum aestivum
  misc_feature (244)..(244): Xaa can be any naturally occurring amino acid
  misc_feature (258)..(258): Xaa can be any naturally occurring amino acid
MDPCPFVRVLVGNLALRMPVAPPAAGAGAGVHPSTSPCYIKIRLGKMACQTAAAPLVLSDAAAEQPPSGALAAAFHLSKADLEWFARKPSLFSPSRGAATLKVSVYAGRKGTTCGVSSGRLLGKATISLDLKGAEAKPAVLHSGWMSVGRRGVGGKGGGPAAADLSLTVRAEPDPRFVFESDGEPECTPQVMQVRGSMKQPMFTCQFGCRTNSDLRRSVAQTEPEAAGEERLGWSVTVHDLSGXPVALVCMDDTFVAXPEDDRVSRSTRGRCSAPTRGHRRVTEGRIIVMARGDWSLRQVTDKVRAG

SEQ ID NO: 15105 - protein, 423 aa, Unknown
  Mesorhizobium sp. HN14A16
WGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLMQRLTEKYGIDIEYHCKPLGDTDWNGSGMHANFSTAYMREVGGKAYFEALMAAFDKNLMDHIAVYGPDNDKRLTGKHETAPWNRFSYGIADRGASIRVPHSFVKNDYKGYLEDRRPLGANEQVVEIETVPTGSLGLDIALGVGGLPRGRIIEIYGPESSGKTTLALHTVAEAQKKGGICAFVDAEHALDPVYARKLGVDLENLLISQPDTGEQALEICDTLVRSGAIDVLVVDSVAALTPRAEIEGEMGDSLPGLQARLMSQA

SEQ ID NO: 15106 - protein, 580 aa, Oryza sativa
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYRGFYSDEVVPLDPAAVEHWHKAGGAALGTSRGGFDLARIVDAIERHGFNQVYAVGGDGTMRGAARIQREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWSFVVYLGGHSHGRGGAALASSQERAKNSHHEFLGSFLGSKEKARDAIFYSYTKYINGFAATLEEEEAMEISKHPSVISVFPNRGHRLHTTRSWEFLGMEKDGRIRANSIWAKARFGEGVIIGNLDTGNLTSA

SEQ ID NO: 15107 - protein, 424 aa, Desulfotalea psychrophila
MQNALGHLSIGEGHGALPPATTFVLTGGNLSMKVKNNIHWVGKIDWELRKFHGDEYSTHKGSSYNPYLIKEEKVVLIDTVWGPFAQEFVENLRREIDLDQIDYIVACHAENDHSGALPELMRHIPDVPIYCSKNCAKFLKGLYHQDWNFQVVKSGDRLSLGSKELVFIEAPMLHWPDTMFVYLTGDAVLFSNDGFGQHYASAHMFNDLVDQADLFQECLKYYANILTPFSPMVTRKIKEILDMNLPLEMICTSHGIIWRDNPSQIVEKYLQWADNYQENQISILYDTMWESTRVMAEQIAAGIREVDEEVTVKLYNLAKSDKNDVITEIFRSKAILMGSPTLNNGILVSVAGLLEEIKGLKFKGKKAGAFGSYGWSGEAVKNISQRLTDSGFELVDEGLRLTWSPDEEGKKTCREYGKSFVQSL

SEQ ID NO: 15108 - protein, 417 aa, Xanthomonas campestris
MFSRDVRLETYDPELAKAIAAEAGRQEDHVELIASENYCSPLVMEAQGSQLTNKYAEGYPGKRYYGGCEFVDIAEQLAIDRIKQVFGADYANVQPHSGSQANQAVYLALLQPGDTILGMSLAHGGHLTHGAKVNVSGKLFYAVQYGVNEQGLIDYDEVQRLATEHKPKMVVAGFSAYSQKIDWARFRAIADSVGAYLFVDMAHIAGLVAAGVYPSPMEHAHVVTSTTHKTLRGPRGGIIVAKGASEELQKKLQSIVFPGIQGGPLMHVIAAKAVAFKEALEPAFKTYQQQVVKNAQAMANTLIARGYKIVSGGTENHLMLVDMIGRDVSGKDAEAALGKAHITVNKNSVPNDPRSPFVTSGLRLGTPAITTRGYQEQDSIDLANWIADVLDAPTDEAVLAKVRDAVTAQCKRYPVYG

SEQ ID NO: 15109 - protein, 417 aa, Xanthomonas axonopodis
MFSRDVRLETYDPELAKAIAAEAGRQEDHVELIASENYCSPLVMEAQGSQLTNKYAEGYPGKRYYGGCEFVDIAEQLAIERIKQVFGADYANVQPHSGSQANQAVYLALLQPGDTILGMSLAHGGHLTHGAKVNVSGKLFNAVQYGVNEQGLIDYDEVQRLATEHKPKMVVAGFSAYSQKIDWARFRAIADSVGAYLFVDMAHIAGLVAAGVYPSPMEHAHVVTSTTHKTLRGPRGGIIVAKGASEELQKKLQSIVFPGIQGGPLMHVIAAKAVAFKEALEPAFKTYQQQVVKNAQAMANTLIARGYKIVSGGTENHLMLVDMIGRDVSGKDAEAALGKAHITVNKNSVPNDPRSPFVTSGLRLGTPAITTRGYQEQDSIDLANWIADVLDAPTDEAVLAKVRDAVTAQCKRYPVYG

SEQ ID NO: 15110 - protein, 324 aa, Pseudomonas fluorescens
MSRIFADNAHSIGNTPLVQINRIAPRGVTILAKIEGRNPGYSVKCRIGANMIWDAESSGKLKPGMTIVEPTSGNTGIGLAFVAAARGYKLLLTMPASMSIERRKVLKALGAELVLTEPAKGMKGAIEKANEIVASDAGKYFMPAQFDNPANPAIHEKTTGPEIWNDTDGAIDVLVAGVGTGGTITGVSRYIKNTAGKPILSVAVEPVSSPVITQALAGQEIKPSPHKIQGIGAGFVPKNLDLSMVDRVELVTDDESKAMALRLMQEEGILCGISCGAAMSVAVRLAETPEMQGKTIVVVLPDSGERYLSSMLFSDLFTDQENQQ

SEQ ID NO: 15111 - protein, 469 aa, Pseudomonas aeruginosa
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIVGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVLFILGIMLMIPGINISVYAIPFWLLLMWLCYRVKLSLAERRGLGQQA

SEQ ID NO: 15112 - protein, 2493 aa, Ustilago maydis
MLFTMQFTTRSTVASPEQQHQHQQRSISYSDIELGLERISSRDSNGSSNFTHRAYPPPLSQQYDDTSTNSFHSSQPDITASSSTLSSRLVSANYSRPRFEHAHTQPPTPDQDRSSSGSGSGSGSRSYFPANSHSDSLPGPSTHSISPSFDEDELRQIMSHIPANQATSSSDGDVGKAVQSANHQDISPFLFQSENAAPFSSSHSNRTSVNPSAASTASPSTSAATRTRPRGGTNASQYNTLDTSFGSIDRPGLSSSRSQYSLRPQTPPSASTSTSTLNGSKDTHASAVKKTRNPFGFLKKKSSAHSNASSNHPTRHDIGSVSSLSSRYGPNAAANVNPMRPPAWLDNHCTLANSNSPSSASLRSHYHQPPASSNPPPWQNPLVSRADSTPSAMSLEDEVEAEHHLKKDPRKRIKGVRHHLAKTTKPGEDADSARDPAFAAQSQSIEQEVELSLDMNFDQLDDFVDTNAARQRLQGSITESASPSEHRSPNGSEAGVYRSPSPSQTPIAERQTSVTSTVESPSHASEASLAPSGSLRTPSRTTASTSTSSASTVLSDRLPSQVNMLPRNSVPRLSLAEMQNYQSLRKLSNNLIDMSQTQNPSAMGASYRRGSIAAAQAPVDAPQLGVAPRTDSELSDRKDSVVSTHSMRSNHSGISPKTSYANLPSVIQERQKPATALPSAANWTSSITRDKTANGHADHAYQFPPATEYQSNLLLSVRKSSASSGQEPSSSWMAPDSWAVQPDKMRDYLRDDNVGEEEDDDDDQHQARAALATDGKRRGSSSGISSTHASSMFRTSSTDPFKKTASLAGSRRGTDDSVDPLTALPPLPGSKSVDEAAANKVDVLQQTNNLAQSALVQQQSQSQNHHQPSPNVRPTSRGGAGAHMFASAGASAAAAAAGKLGLHRPSKHRMNARPNTAGSVGATRPSTTTLGSTLSAEDDTSINGSIRRDGHPLKRSATANTNNATGTLPRNHFIRVYKTDGTFATLSCSLVSTANEVQTILARKSLTTESAAYRLFVRDKGSERPLGISDKPSQLQRRRLIQAGYTENDGLEDMGRDDLSYLLRFVFRPDSVPTFDSESIGHSEHTFQHLDLHSRNLEMVPIFLYKHADWIVSLDLSGNPMSDLPLDFVQLCSSLRTLRLSNLALKRIPQSVRHSETLTHLDVSNNRIVELAHVSLDLIPELMSLKVQNNRLFDLPSYFSSISTLRNLNISNNRFEEFPKVICDVPSLVDLDVSFNSITELPAEIANLINLERFILAGNELEKLPDSMSELVSLRTIDLRRNKVQDVSSLLGLPRLQNIQAESNNIKSFEATLGPQLTQVELGRNPLSKVRIAALTTCDLTSLDLSSTNMTRLEEGLFPQLPALVKLTLDGNQLVVLPDTLGDLKRLEMLSCSNNLLATLPESIGDLKALKELLVHNNNLKTLPQTLWLCESLAHINLSSNLLESFPAVPDIRTDASVGDAAAAAGTSAVIAARKGSTSSSLTHRSNTGGANGNINLSTPSEVFVAPLSLSLQKLRLGDNRLGDDVFSVLSELTSLEVLNLSFNEIFEIPDFSLQTLTKLRELYISGNQLSTIPSDDLVVLQELRILHLNCNKLTTLPTELGKLKKLANLDVGNNVLKYNIANWHYDWNWNMNPELRYLNLSGNTRLEIKTKLSDMGFTRKSNISDFSRLTSLRMLGLMDVTMPLHSNATPDESDNRRVRTSLSQVNGMAYGIADALGKHDNLSVIDLVIPTFRKDEGECIFGLFDGRGHGAHVGSRIAHHLAEWSGHRLSWEFQKHQNEMTAEPVSVPDALRRAFLRLQKDYADALINDGSRKLSEAHAEAAADVTRSSAPAIAAASNKHDWRAGASAILAYVVDHTLYIANAGDALAVMSRNGGTAHLISNKHEPFDRAEIERIRSAEGWVSLRGYVNDMLDVSRSFGYFHLFPIVNAAPAVTTVQLTDSDEFVIIANRTLWQYVSYQTAVDIARTQRNDPMIAAQKLRDFAISYGAEESIMVMVISVGDLFYRSDQRNGGGLNFASYKNSDAIQKAGRRFREELPGDRTLARLDREVAPPIGQVALVFTDIKNSTSLWETNNGMQTAMRLHNYLLRRQLRTIGGYEVKTEGDAFMVSFPSVSAALLWCFTVQQQLLQEDWPREILDSEDGKEVYDQSGELIHRGLSVRMGIHWGRPVCEADPITRRMDYFGPMVNRAARISGAADGGQILASKDVIKELQGLLGTFDESSTAGGAGGEGENLEKTEEELDEDAFRLLNPNVSRDVVLLRRMGFGLSQLGERRLKGLETPEMLWLVYPKQLAGRLEQAKTDDAPDAPTAQVYEPTVQLLDIEDVKQVGMLCLRLEYLSNSTVCPGIFAAKDEADRSQPSTPLDDNGRNPIDGHGTAVPLLSHQARRKGVEAMLTMHPELLIYSIRDDATDEELAGILDQLTTRIQNAVSSLMLNMLRDKTANGTKELGVDPGVLELLMGLLSQPPPRASTSALSLPSPRTSPRNRLLELVP

SEQ ID NO: 15113 - protein, 674 aa, Methanococcus maripaludis
  misc_feature (132)..(132): Xaa can be any naturally occurring amino acid
MELDFIHTICPYCGTGCGVDLVVKDGTLVGTNPFKRHPVNEGKTCIKGSYCHEFVHRDDRLKTPLIRKNGELVEASWDEALELISGKLQNYSPEEVGFFSSARCTNEDNYVFQKFARTVIKTNNVDHCARLXHSATVVGLGQAFGSGAMTNSISDIEDADCIFIIGSNTFEQHPLIARRVVRAKEKGTKIIVIDPRYTPTAKQADLYLQLLPGTNIAVLNAIMHVLVKENLVDEEFIKNRTKGYEELKTTLETYTPEYASKLSGVAPELIVEAAKMYGSANAASILYCMGITQFTTGVNNVKSCCNLAMITGNIGKPGTGVNPLRGQNNVQGACDMGALPNVFPGYQAVPANHEKYAEAWNTCVDPNVGLSIPDMLAKAGEQVKCIYVMGENPMVSDPDIHHVEHALKSLDLLIVQDIFLTETAQVADVVLPGASWAEKDGTFSNTERRIQKINKAVDSPGEAIADWKIVKMLAEKMGQGELFNFNTAEEVFQEIAKVTPQYAGVTYERLGVDGLHWPCKTCEDPGTPILHCEKCLTPDGLGNIFAIDYADPDEMADSEYPMTLTTGRIIFHYHTGTMTRRSKHMADEINEGFVEIHPEDAEKMGIKNKQKVKVSTRRGEVVVNAKITPNIKQGVVFMPFHFAETAANILTNPAQDPNCKIPEYKVCAAKVEKI

SEQ ID NO: 15114 - protein, 425 aa, Flavobacteria bacterium
MSYNDKEIFDLIQEEQSRQKTGLELIASENYVSDDVLAAAGSILTNKYAEGYPGKRYYGGCEVVDEIETIAIERAKELFNAEYVNVQPHSGSQANTAVFHACLKPGDKILGFDLSHGGHLTHGSPVNFSGKLYKTSFYGVEKETGLLNYEKIQSIAEQEKPKLIIAGASAYSREIDYKKFRDIANSVNAILLADIAHPAGLIAKGILQDAVQFSHICTSTTHKTLRGPRGGIIIMGKDFENPFGQKLKNGNLKKMSSLLNSGVFPGNQGGPLEHIIAAKAVAFKEALSENFLHYMVQVKKNAKAMASEFIKRDYHIISGGTDNHMMLIDLRNKNITGKQAEEALGKSHITVNKNMVPFDDQSPFITSGIRIGTAAITTRGLVESDMAEIVKLIDMVISNPEDDETLNNCKDFVNNFITDYPLFKN

SEQ ID NO: 15115 - protein, 321 aa, Crocosphaera watsonii
MVENRQSTVVITGASSGVGLYAAKALADRGWYVVMACRNQPKAHQAAQSLGIALDAYTVMHIDLGNLDSVRQFAQDFRATGKTLDALVCNAAIYMPLLKEPLRSPEGYELSMTTNHLGHFLLCNLMLEDLSHSSAPEKRMVILGTVTHNPDELGGKIPPRPDLGNLEGFADGFKEPISMVDGKNFEPVKAYKDSKVCNVLTMRELDRRYHESTGIVFTSLYPGCVADTPLFRNHYPLFQKIFPWFQKNVTGGYVSQELAGERVADVVTKPEYGESGSYWSWGNRQKKDRQAAFVQNVSPQAQDEAKAEKMWNLSEKLVGLA

SEQ ID NO: 15116 - protein, 265 aa, Xanthomonas axonopodis
MPQVTMRQMLEAGVHFGHQTRYWNPKMAPYIFGARGKIHIINLEKTVPLFNDAMNFLSSVAQKRGTVLFLGTKRSARESIKEEAERCNMPFMTQRWLGGTLTNFRTVKQSVARLKELEAAETDGTFDKLVKHEVLGLRREREKLDASLGGIKEMNRLPDAIFVIDIGHEDIAIKEAKKLGIPVIAVVDTNYDPALVDYAIPGNDDAIRAVQLYARAAADAVLEGKAAAPNSASVREEEFSADAADEGKGRRAPAKKGDKKADAAE

SEQ ID NO: 15117 - protein, 502 aa, Taxus wallichiana
MDALYKSTVAKFNEVTQLDCSTESFSIALSSIAGILLLLLLFRSKRHSSLKLPPGKLGIPFIGESFIFLRALRSNSLEQFFDERVKKFGLVFKTSLIGHPTVVLCGPAGNRLILSNEEKLVQMSWPAQFMKLMGENSVATRRGEDHIVMRSALAGFFGPGALQSYIGKMNTEIQNHINEKWKGKDEVNVLPLVRELVFNISAILFFNIYDKQEQDRLHKLLETILVGSFALPIDLPGFGFHRALQGRATLNKIMLSLIKKRKEDLQSGSATATQDLLSVLLTFRDDKGTPLTNDEILDNFSSLLHASYDTTTSPMALIFKLLSSNPECYQKVVQEQLEILSNKEEGEEITWKDLKAMKYTWQVAQETLRMFPPVFGTFRKAITDIQYDGYTIPKGWKLLWTTYSTHPKDLYFSEPEKFMPSRFDQEGKHVAPYTFLPFGGGQRSCVGWEFSKMEILLFVHHFVKTFSSYTPVDPDEKISGDPLPPLPSKGFSIKLFPETIVN

SEQ ID NO: 15118 - protein, 104 aa, Unknown
  Cyanothece sp. ATCC 51142
MKTFKQKNKETGKKEEIAEIDVTLEVPEDVYIFDAAEEEGLDLPSSCRSGACSSCVGRIVEGEVDQEDQSFLDDEQVEKGWVLLCVAYPRSNCTIKTHQEAYLA

SEQ ID NO: 15119 - protein, 212 aa, Oryza sativa
MDPSGPGPSSAAAGGAPAVAAAPQPPAQLSRYESQKRRDWNTFLQYLRNHRPPLTLARCSGAHVIEFLRYLDQFGKTKVHASGCAFYGQPSPPGPCPCPLRQAWGSLDALIGRLRAAYEESGGTPESNPFAARAVRIYLREVRDSQAKARGIPYEKKKRKRSQAAQPAGVEPSGSSSAAAAAAGGGDAGSGGGAAATTTAQPGGSGTAPSAS

SEQ ID NO: 15120 - protein, 291 aa, Treponema pallidum
MLANLQHLSDIQYRVTQQSATETPFKNEFWNSYQPGFYLDVVSGELLFLSEDKFDSGCGWPSFSAPAYARAVIEKEDRTHNMLRTEVRSRNANSHLGHVFKDGPPERGGLRYCINSAALRFVAREEGTALFAAGCFWSTEAYFRRVKGVLRVRVGYTGGTTKSPTYRNVCTGTTGHAEAVEILFDPQVISYEDLLKHFFRMHDPTSLNKQGGDVGTQYRSAIFYLSGTQKQQAETLMGRYAGAGKFTRPLVTTLEEARDFYPAEEYHQDYLTKNPGGYCHVSLHLASEPLE

SEQ ID NO: 15121 - protein, 1101 aa, Cryptococcus neoformans
MPESRMVHPHSHHLHSAHHHSSHPHSYQHPPPPNYSSSHPSYPHHHHTPRHVSNGHSSQVPLSGPPPPQMPIAGPPADPVGPPAIATSNAGSTRSRSVPPMSSEARAAKEKMDNILAQLAAANENTWMLIGAVAEGMNDQDRALSAFENALRHNPSSVLGLNAVASIARGRDDFDKAIEYFQRILNANPENGEVWGSMGHCLLMKDDLPKAYTSYQQALYHLANPKEPKLWYGIGILYDRYGSFEHAEEAFSSVLKVDPNFEKANEIYFRLGIIYKHQRKYKSSLDCFRYILNNPPRPLTSWDIWFQLGHVYEQDRDFEAARDAYMRVLSHQPDHAKVLQQLGWLYHQPGAHFADQEKAVSYLTKSLETDPSDAQSWYLLGRAYMAAQRYNKAYEAYQQAVYRDGRNPTFWCSIGVLYYQIAQYRDALDAYSRAIRLNPYISEVWYNLGSLYESCNNQMADAMDAYSRALELDPNNTVIKQRMALLQNPNGGPLPPVPPPIDVHPSQYTATPTAQPPAGSPNASPSHQLPSDAHAGGRDLPPPPPGGDIARGHSPGPFRNGAAPPPLNHVDEPRGPVPGMTQLARMETEPRSAEIRDERYNGRYDPADIRRHNGSPLSPRASRRESQAFPSQPSYFPSNGAHARDREREEWDRSRGGSRAPQGHSPRLGDRTPGADPRVPQEYRDYPGYYDPRTAYPAPLGGPPTPSAMPGRFDPRREAEEFRRREEDREVNGAKLASSARQENRMPSPAPSIASSKNGRKRGEGTRKAKDKEEKALNKKEGGRKGKAAGLKAGEEITGQSPRGNVKSPSVSVHNTPQLNTARPIPPSAPAPVPLMSRTVDEDYDEGAADALMVLAGDRSTTTLPLPVRHITPTPSGPMSPPPPAPNTGPATGAKRPGPEANSPEQANKRVKAEKSQSPVDSASGSASSRVPKRMVIEVLNTPSIASPLPRTSSAVNEEKQSRASQERREERREGTISGTEIDERTAQTSTPLPPPAPLSPANRLAPSSSAHTPQSPPRQASSPPPEAEKEASRPPTPPLPDEPPSPAAPAAAVRVESSRDSDPRTPPLPPSQTFETSSMKTPTSAGDRGDVDMADAGTER

SEQ ID NO: 15122 - protein, 321 aa, Brassica napus
MGGDIPPPVDQLAAVSLTSDEASSSTVQKARFSDRVRIQSILGRPDGGAGLAGQKVRISGWVKTGREQGKGAFAFLEVNDGSCPANLQVMVDASVSDLSKLIATGTCVTVDGCLKLPPEGKGTKQKIELSVVEVVDVGTVDPGTYPIPKTKLTLERLREFLHLRARTNSISAIARIRHALAIATHTFFDEEGFLYVQTPIITTSDCEGAGEMFQVTTLISTTEKLERELIENPPPTEADVEAARVVVKERGEAVAELKAAKASKEAILASVAELNDAKANLAATEARSRLKPGVPKVDGKIDYSQDFFGRQAFLTVSGQLQ

SEQ ID NO: 15123 - protein, 568 aa, Vibrio angustum
MKEITVVQYLINALKAINIHHVFGVPGDFAFPINDAICEDDNIEWIGSSNELNASYAADGYARIHGVAALSTTYGPGELSALCGVAGAYSAHLPVIFITGMPSEKVMASHALIHHTLGDGQFGTFAKMADNVVEASTILTVDNAENEINRVIQLALSAKRPVYIALPEDVALSILPAPQEFNFTFEPQTGSDDVIQLAELIAYKINNATQPLIMIGEHLRVCHAQKQALRLLEKANLPFSTMFADKALLDETHPNFIGLCDGKVINKHINDYVESSDFILNLGALFTDFNTGAFTIQWPEDIVNIYQDKININKRQHPPVNFCRLLETLTPLIHPRTNTYNCYMGYSHLEPAANTENNHNDLITAHSLYPRLETFFKEDDQVIAETGTISMGLGLARLPKGARFENQTLWGSIGWATPAAFGAAIANPSCRTVLLTGEGSHQLTVQELGQFHRFGLKPIVIVLNNNGYLIERILCKDPMINYNDLCQWNYSQLPQAFGAKDWLSMKVTTNAELDHALELASTATTGVYIEVVTAMMETAALAANLASQLNPQRGLQVHVPPVQEKEFA

SEQ ID NO: 15124 - protein, 681 aa, Oryza sativa
MSASPSSMKRRRRRRGGGADGGVVQAGPARGGQPALAAAARAAGEVGAGVRVGAGGGRAVLPGAGVPVVAQPEPQAPGRLAPAARRQQARHPPLRRRRRRAHRARPQHRRHASLLQPPLRPAVAGEGPPGEGAADGRGHRRAVVQRRPAVRAMGGGRRRRLPVHHVRAVLGQVPVHARPGGALLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRDSRATGWLHDRIRVVVSSFFVKVLQLPWRWGMKYFWDTLLDGDLESDRLGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTWERRRRGARLVASGSVRPLRSLRCR

SEQ ID NO: 15125 - protein, 649 aa, Nostoc punctiforme
MCGITGFWDISKQFSGEHLDETIQKMSKTLLHRGPDDGGIWTDVEVGVALGHRRLSIVDLSPLGHQPMMSANGRYMVVFNGEIYNFLELRRELTQLGHNFRGHSDTEIMLAGFSEWGLDKAIRRFNGMFAFALWDRQKRILHLGRDRLGEKPLYYGWQGSTFLFTSELKALKAHPNFRAEINRDALTQFFRYSYLPAPYSIYQGIYKLPPGTLLSWNGIDAHPDPVTYWSAREVTELGIAEPFMGSESEAVIQLEALLREAVGLRMVADVPLGAFISGGIDSSTIVALMQAQSSQPVKTFTIGFNEEAYNEAKHAKAVAKHLGTDHTELYVNPKEALEVIPKLPFLYDEPFSDVSQIPTFLVSQLAKQQVTVSLSGDGGDELFAGYNRYLFGRKIWQAIGWIPTTVRKNSARALTSVSPQNWNRGFANVNALLPSRIKQPEFGNKLHTFSEIMALPNPTAIYTKLVSHWEDPKALVIDGLEPPTILSNSQNWPHLLDFTQCMMYFDTVTYLPDDILVKVDRASMGVSLEGRIPFLDHRLVEFAWRLPLSMKIRNGQGKWLLRQVLYKYVPPTLVERPKVGFGVPINSWLRGPLRDWAEELLNENRLKNEGFFNPKPIREKWEEHLSGAASWEYRLWDVLMFQAWLEANH

SEQ ID NO: 15126 - protein, 149 aa, Zea mays
MAPKAEKKPAAKKPAEEEPAAEKAPAGKKPKAEKRLPAGKSAGKEGGEKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 15127 - protein, 109 aa, Unknown
  Candidatus Desulfococcus oleovorans Hxd3
MGDKVLSISDGSFEAEVIQAEMPVFVDFWAPWCGPCKAIGPLVEELAAAYEGKIKFAKCNVDDNPSTPTKFGIQAIPTLIIFKGGEVVERITGMVPKAKLEAALNKALE

SEQ ID NO: 15128 - protein, 309 aa, Unknown
  Candidatus Desulfococcus oleovorans Hxd3
MSETNYDLVIIGGGPAGLTAGIYAARARLNAVVVEKMAAGGQVLTSDWIENYPGFPEGISGADLMMRMSDQASRLGVALEYEEITAVDLSDPVKILSLGDKTITCKAVIIASGASPSRLNVPGEERFIGRGISFCATCDAPFFRDKVVAAVGGGDTAVQESLFLTKFAKKVYLIHRRDALRATKILQERAFENKKIEFVWDSVVTEIGGGLTNVEKVTVKNVKTEETRDLAVDGCFMWVGIHPNADFLAGAVDTDKGGFILTDQAMATSVPGVFAAGDVRATPLRQIATSVGDAAIALHSAEAYIESME

SEQ ID NO: 15129 - protein, 301 aa, Solanum tuberosum
MVSNYISATVSSILLFLLCSSSLFGASMAALVQEQPLVLKYHNGALLKGTVTVNLIWYGKFTPIQRSIIVDFLQSLNSPKAPNPSAASWWKTTEKYKTGASTVTLGKQILDENCSLGKSLKNSHIVYLASKGGYMGRSVNLVLTAKDVFVEGFCSRCGSHGSTRGKVRFTYAWVGNSETQCAGQCAWPFHQPIYGPQTPPLLAPNGDVGVDGMIINVATVLAGTVTNPFNNGYFQGPATAPLEAVSACTGMFGSGSYPGYPGQTLVDKSTGASYNAHGVNGRRFLLPAMWDPTKSACSALV

SEQ ID NO: 15130 - protein, 340 aa, Atropa belladonna
MAFRNGSTTTTITTINHPNDASTIPKNGTNITTTLLKNGSTNEFGCIKPGWFSEFSQLWPGEAFSLKIEKLLFQGKSDYQDVMLFESATYGKVLTLDGAIQHTENGGFPYTEMIVHLPLGSIPSPKKVLIIGGGIGFTLFEVFRYPTIENIDIVEIDNVVVDVSRKFFPYLAAGFDDPRVTLVLGDGAAFVKAAQAGYYDAIIVDSSDPIGPAKDLFERPFFEAVAKALRPGGVVCTQAESIWLHMHIIKQIIDNCRQVFKGSVNYAWTTVPTYPTGVIGYMLCSTKGPQVDFRNPVNPIDKKTSHIKSKGPLKFYNSDIHKAAFILPSFARNLMESELD

SEQ ID NO: 15131 - protein, 338 aa, Hyoscyamus niger
MEVISNHNNGSTTKIILKNGSICNGNVNGNSHSNEKTENKLVECTNSIKPGWFSEFSALWPGEAFSLKIEKLLFQGKSDYQDVMLFESATYGKVLTLDGAIQHTENGGFPYTEMIVHLPLGSIPSPKKVLIIGGGIGFTLFEVSRYSTIEKIDIVEIDDVVIDVSRKYFPYLAAGFDDPRVTLIVGDGAAFVKAAQPGYYDAIIVDSSDPIGPAKDLFERPFFEAVTKALRPGGVVCTQAESIWLHMHLIKQIIANCRQVFKGSVNYAWTTVPTYPTGVIGYMLCSTEGPEVNFKNPVNSIDKDTTHVKSKGPLKFYNSDIHKAAFILPSFARDLVEF

SEQ ID NO: 15132 - protein, 160 aa, Bacillus cereus
MTVYDFSAKTITGEEKSLKDYEGKVLLIVNVASKCGFTPQYKGLQEVYDKYKGQGLEILGFPCNQFGGQEPGTEADITSFCELNYGVNFPMFAKIDVKGDKAHPLYTYMTEQAPGLLGMKAVKWNFTKFLIGKDGKVVGRFAPQTKPVDLEVEIEKVLGE

SEQ ID NO: 15133 - protein, 391 aa, Arabidopsis thaliana
MVLSVKQTLSPKIGLFRRNPSSSLGRSPVSLSFPSTELPKRTVLAVSKPLHLSSSLRAKSPVVRCEAYEADRSEPHPIGDDAAAAETKSEAAKKLKIGIYFATWWALNVVFNIYNKKVLNAYPYPWLTSTLSLAAGSLMMLISWAVGIVETPKTDFDFWKTLFPVAVAHTIGHVAATVSMSKVAVSFTHIIKSGEPAFSVLVSRFILGETFPTSVYLSLIPIIGGCALSALTELNFNMIGFMGAMISNLAFVFRNIFSKKGMKGKSVSGMNYYACLSMLSLLILTPFAIAVEGPQMWVDGWQTALATVGPQFVWWVVAQSVFYHLYNQVSYMSLDQISPLTFSVGNTMKRISVIVSSIIIFRTPVQPVNALGAAIAILGTFLYSQVNITLP

SEQ ID NO: 15134 - protein, 299 aa, Schizosaccharomyces pombe
SKLDSYTHLSFYEKRELFRKKLREIEGPEVTLVNEVDDEPCPSLDFQFISQYRLTQGVIPPDPNFQSGCNCSSLGGCDLNNPSRCECLDDLDEPTHFAYDAQGRVRADTGAVIYECNSFCSCSMECPNRVVQRGRTLPLEIFKTKEKGWGVRSLRFAPAGTFITCYLGEVITSAEAAKRDKNYDDDGITYLFDLDMFDDASEYTVDAQNYGDVSRFFNHSCSPNIAIYSAVRNHGFRTIYDLAFFAIKDIQPLEELTFDYAGAKDFSPVQSQKSQQNRISKLRRQCKCGSANCRGWLFG

SEQ ID NO: 15135 - protein, 280 aa, Streptomyces avermitilis
MSRVIRAAVFQTAWTGDKESMIQVHEQAVRDAAAQGAQVLCFQELFYGPYFCQVQDKAFYEYAEQIPHGPIVKRFQALARELGIVLVLPMYEEEQPGVLYNTAAVIDADGSYLGKYRKTHIPQVEGFWEKFYFRPGNSGWPVFDTAVGRIGVYICYDRHFPEGWRALGLAGAEIVFNPSATSRGLSGYLWQLEQPAAAVANEYFVGAINRVGVEELGDNDFYGTSYFVDPEAQFVGEVASDKETELVVRDLDLAKLREVRDRWQFYRDRAPGAYGPLTAP

SEQ ID NO: 15136 - protein, 280 aa, Streptomyces avermitilis
MAHVVRAALVQATWTGDTESMIAKHVEHAREAARQGAKVIGFQEVFNAPYFCQVQEPEHYRWAEPVPDGPTVVRMQELARETGMVIVVPVFEVEQSGFYFNTAAVIDADGTYLGKYRKHHIPQVKGFWEKYYFKPGNMGWPVFDTAVGKVGVYICYDRHFPEGWRQLGLNGAQLVYNPSATSRGLSAYLWQLEQPAAAVANEYFIAAINRVGQEEYGDNDFYGTSYFVDPRGQFVGEVASDKSEELVVRDLDFDVIDEVRQQWAFYRDRRPDAYEGLVRP

SEQ ID NO: 15137 - protein, 180 aa, Sulfolobus islandicus
PKSVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 15138 - protein, 365 aa, Mesembryanthemum crystallinum
MAAAVTAAVSFPSTKSTPLSTRTSSVITHEKINFNKVPLYYRNVSVGGKVGTIRAVASDVEAPVAKVEKHSKKMEEGVIVNKYKPKNPYTGRCLLNTKITGDDAPGETWHMVFSHEGEIPYREGQSVGVIPEGIDKNGKPHKLRLYSIASRPLGDFGDSKTVSLCVKRLIYTNDNGEIVKGVCSNFLCDLKPGSEVVLTGPVGKEMLMPKDPNATIIMLATGTGIAPFRSFLWKMFFEKHDDYKFNGLAWLFLGVPTSSSLLYKEEFEKMKEKAPENFRLDFAVSREQTNEKGEKMYIQTRMAQYDRELWELLKKDNTYVYMCGLKGMEKGIDDIMVSLAAEDGIDWFDYKKQLKKAEQWNVEVY

SEQ ID NO: 15139 - protein, 381 aa, Zea mays
MATAAAASRVAVSAPVFGSDGGARSSGIKGNNNVSFGSKSWVGGTLAWESSCSVRPRRASKVLCMSVQQASRSKVSVAPLHLESAKEPPLNTYKPKEPFTATIVSVESLVGPKAPGETCHIVIDHGGNVPYWEGQSYGVIPPGENPKKPGAPQNVRLYSIASTRYGDNFDGRTGSLCVRRAVYYDPETGKEDPSKNGVCSNFLCNSKPGDKIQLTGPSGKIMLLPEEDPNATHIMIATGTGVAPFRGYLRRMFMEDVPNYRFGGLAWLFLGVANSDSLLYDEEFTSYLKQYPDNFRYDKALSREQKNRSGGKMYVQDKIEEYSDEIFKLLDGGAHIYFCGLKGMMPGIQDTLKKVAERRGESWDQKLAQLKKNKQWHVEVY

SEQ ID NO: 15140 - protein, 180 aa, Sulfolobus islandicus
PKGVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 15141 - protein, 363 aa, Vicia faba
MAAAVTAAVSLPYSNSTSLPIRTSIVAPERLVFKKVSLNSVSISGRVGTIRAQITTEAEAPVTKVVKHSKKQDEGIVVNKFKPKEPYVGRCLLNTKITGDDAPGETWHMVFTTEGEVPYREGQSIGIVPDGIDKNGKPHKLRLYSIASSAIGDFGDSKTVSLCVKRLVYTNDAGEVVKGVCSNFLCDLKPGSEVKITGPVGKEMLMPKDPNATVIMLGTGTGIAPFRSFLWKMFFEKHEDYKFNGLAWLFLGVPTSSSLLYKEEFEKMKEKAPENFRLDFAVSREQVNDKGEKMYIQTRMAQYAEELWELLKKDNTFVYMCGLKGMEKGIDDIMVSIRPKDGIDWIEYKRTLKKAEQWNVEVY

SEQ ID NO: 15142 - protein, 257 aa, Oceanicola granulosus
MTVHFIGAGPGDPELLTLKAARLIEACPVCLYAGSLVPAAVVARAPAGARVLDTAPMTLDETHAEIRAAHARGEDVARVHSGDPSLYGAVAEQVRRLRADGIPYQIVPGVPAYAAAAAALGQELTVPEIAQSIVLTRMSMKSTSMPPGETLETFARSGATLAIHLGIRALREIERQLVPHYGEDCPVAVVYRASWPDQQVIRGTLADIRERVRAAKITRTALIFVGPALAESHAFPDSALYDAARPHLLRPRARERG

SEQ ID NO: 15143 - protein, 363 aa, Arabidopsis thaliana
MDNFLPFPSSNANSVQELSMDPNNNRSHFTTVPTYDHHQAQPHHFLPPFSYPVEQMAAVMNPQPVYLSECYPQIPVTQTGSEFGSLVGNPCLWQERGGFLDPRMTKMARINRKNAMMRSRNNSSPNSSPSELVDSKRQLMMLNLKNNVQISDKKDSYQQSTFDNKKLRVLCEKELKNSDVGSLGRIVLPKRDAEANLPKLSDKEGIVVQMRDVFSMQSWSFKYKFWSNNKSRMYVLENTGEFVKQNGAEIGDFLTIYEDESKNLYFAMNGNSGKQNEGRENESRERNHYEEAMLDYIPRDEEEASIAMLIGNLNDHYPIPNDLMDLTTDLQHHQATSSSMPPEDHAYVGSSDDQVSFNDFEWW

SEQ ID NO: 15144 - protein, 520 aa, Chlamydomonas reinhardtii
MQRTVQGISQLARALSSAHAVAGQRCFAAQPALSNEEEYSRFSQDASRAHVTWPKVLNAGLAEVDPDLFDIIEKEKNRQFKGLELIPSENFVSASVMEAVGSVMTNKYSEGYPGARYYGGNEFIDQAERLCQERALKAFHLDPAQWGVNVQSLSGSPSNFQVYTALLQPHDRIMALDLPHGGHLSHGYQTDTKKISATSIYFEQMPYRLNEETGLIDYDMLEKTAVLFRPKLIVAGASAYTRHYDYARMRAIADKVGAWLLADMAHISGLVAADLVPSPFGFADVVTTTTHKSLRGPRGAMIFYRKGVRRTDAKTGKPINYDIEDKINFAVFPGLQGGPHNHTIAGLACALKQAATPEFKSYQQQVLSNSQALAGALAKRGFKLVSGGTDNHIVLVDLRPKGVDGSRVERVLELAHIAANKNTVPGDVSALVPGGLRMGSPALTSRGFVEKDFEQVAEFVDRAVNIAVDLKKKYPKLKEFREAMAKESTPDINALKKDVETFAMRFPTIGFDKAAMRYKN

SEQ ID NO: 15145 - protein, 185 aa, Glycine max
MAAEPKESPSNNPGLHTTPDEATKGYIMQQTMFRIKDPKVSLDFYSRVLGMSLLKRLDFPEMKFSLYFMGYENTAEAPSNPIDKVVWTFSQKATIELTHNWGTESDPEFKGYHNGNSEPRGFGHIGVTVDDTYKACERFQNLGVEFVKKPEDGKMKGIAFIKDPDGYWIEIFDRKTIGNVTQTAA

SEQ ID NO: 15146 - protein, 293 aa, Bifidobacterium longum
  misc_feature (234)..(250): Xaa can be any naturally occurring amino acid
MAQITMSDMLKAGLHFGHQTRRWNPKMKQFILTQRNGIHIINLFKSLDMIDKAYDFIKTTVAHNGTVLFVGTKKQAQEAIANQATRVNMPYVSERWLGGMLTNFQTVSKRVNRLKELEEMDFTDVHGSGLTKKELLLLEREKDKLNKQLGGIRNMNRTPSAMFVVDITKEALAVEEAHKLGIPVVAIVDTNADPDTVEYPIPANDDAIRGIELLTSLMADAVAEGLLERSGANXXXXXXXXXXXXXXXXXEKELLTTRLLPRLPLKPPLRLPPRAKPPRPPRPSDALRWEVPE

SEQ ID NO: 15147 - protein, 564 aa, Xanthomonas axonopodis
MCSIFGIFGLQPGDDLQALRRQALECSQRQRHRGPDWSGVYVDTGAILVHERLAIVDPAGGSQPLLSEDGQLALAVNGEIYNHRELKAELLQPYAFQTGSDCEVINALYREDTPASYLNRLNGIFAFALWDKTEGRVIIARDPIGVVPLYWGHDREGRLRVASELKSLVDDCADAAQFPPGHWYDSATGALNRYYERAWRQYGAVEGVQVQLQELREAFERAVHRQLMTDVPYGVLLSGGLDSSLVAAVAARYARHRIEENDITEAWWPRLHSFAIGLKGSPDLAAAEVAAAALGTVHHGFEYTFDEGLDALPDVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDARFKMIDKTSSGATRMEKGVLREAFAGYLPESILWRQKEQFSDGVGYGWIDGLKAHAQSQVSDRELAAADRRYPVNPPQTKEAYFYRSLFEQFFPGQAAAETVPGGKSIACSSPTAIAWDASFAAMADPSGRAIAGVHAQALAS

SEQ ID NO: 15148 - protein, 603 aa, Hordeum vulgare
MAALATSQLATSGTVLGVTDRFRRPGFQGLRPRNPADAALGMRTIGASAAPKQSRKAHRGSRRCLSVVVRATGSGMNLVFVGAEMAPWSKTGGLGDVLGGLPPAMAANGHRVMVVSPRYDQYKDAWDTSVISEIKVADEYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEAKALNKEALQAEVGLPVDRKVPLVAFIGRLEEQKGPDVMIAAIPEILKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVGTPAYQEMVKNCMIQDLSWKGPAKNWEDVLLELGVEGSEPGIVGEEIAPLAMENVAAP

SEQ ID NO: 15149 - protein, 134 aa, Proteus mirabilis
MSESLKILNNIRTLRAQARETSLETLEEMLEKLEVVVNERREEEQAMQAEIEERQQKLQKYRELLIADGIDPTDLLEAAGASKTGRAKRAARPAKYSYVDDNGETKTWTGQGRTPAVIKRAIEEEGKSLEDFLI

SEQ ID NO: 15150 - protein, 440 aa, Flavobacteria bacterium
MSKKVNIFWFRRDMRLDDNVGFLEALKSDYPVLPIFIFDKEILDHLPEDDARVTFIYEELQRMRNNLQENHDSSLATFYGKPLNIWQEIIDNYEVNAVFTNRDYEPYAQERDLKLTSFFNEQNVAFHTFKDQVIYEKDDIVKDDGDPYVVYTPYKNKWLENFRKDYGKADNLTIHYTNDYLDNCIKNSRLPNLNLSDIGFKKSSIEIPEYNITPTLIEDYEKTRNYPAMENGTSRLGVYLRFGVVSIRKMMKKADLANEKTFMSELIWREFFMTILYHFPHTVDNAFRSKYDRIEWRNNESEFEKWKNGQTGYAIVDAGMRELNTTGYMHNRVRMLVASFLCKHLLIDWRWGERYFAEKLLDFDLSANVGNWQWAAGSGVDAAPYFRIFNPITQKDKFDKNYKYIKQWVPEFETDDYVEKMVDHKEARERCLKTYKEAVS

SEQ ID NO: 15151 - protein, 418 aa, Unknown
  Azoarcus sp. EbN1
MNKANLLYAQSGGVTAVINATAASVIEAARARADAVGRVLAARHGILGALDEDLIDTAPLSVVDLRRLAGTPGGAFGSCRFDLDPPEANRDQYDRLFAVLAAHDIGYFLYNGGNGSMDTVAKVSRAAAERGYPLVCVGVPKTVDNDLEGTDCSPGFGSAAKYAATSMLEAGLDLAAMTSRVGRAFVLEVMGRNAGWLAAATALAARNDDEPPHVILMPEVPFDEEAFLAVVRSTVSRLGYCAVTVSEGIRRADGSLLMEQDEDAKGHVQLGGAGQCIARLIHSRLGYKHHWAIPDYLQRAAGHLVSATDHAQARAVGQAAVEYALAGRDGVMAAIRRLADAPYRWDVAPVAVAAIANLERQVPRAFIRPDGLHVTDAARTYLRPLIEGEMPACFAGGLPDYPRFPLPGVPRKLAPYRP

SEQ ID NO: 15152 - protein, 489 aa, Shigella flexneri
MGSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 15153 - protein, 128 aa, Erwinia pyrifoliae
  misc_feature (76)..(76): Xaa can be any naturally occurring amino acid
MSETLKVLNNIRTLRAQAREVSLSELEEMLEKLEAVVNERRDAEAAIASEIKEKEEKLAKYRQMLLEDGIDLSELXSAENTSGKPRAKRAPRPAKYEYTDENGEQKSWTGQGRTPAVIKQALDAGKKL

SEQ ID NO: 15154 - protein, 485 aa, Cleome spinosa
MAVAPTRIGLAGLAVMGQNLALNIAEKGFPISVYNRTTSKVDETVERAKREGNLPVYGFHDPESFVNSIQKPRVIIMLVKAGAPVDQTIKTLSAYMEEGDCIIDGGNEWYENTERREKAVTEQGLLYLGMGVSGGEEGARNGPSLMPGGSYEAYKYIEDILLKVAAQVPDSGPCVTYIGKGGSGNFVKMVHNGIEYGDMQLIAEAYDVLKSVGKLSNDELHTVFSEWNKGELLSFLIEITADIFKIKDDKGDGYLVDKVLDKTGMKGTGKWTVQQAAELSVPAPTIESSLDARFLSGLKEERVQAAKVFKEGGFGDILTDQAVDKKQLIDDVRRALYASKICSYAQGMNLIRAKSLEKGWGLKLGELARIWKGGCIIRAIFLDRIKQAYDRNPELPNLLVDPEFAKEIIERQSAWRRVVSLAINSGISTPGMSASLAYFDSYRRERLPANLVQAQRDYFGAHTYERVDMDGAFHTEWFKIAKSMI

SEQ ID NO: 15155 - protein, 257 aa, Brassica napus
MLSIVASPPVISAVSLSKPLQSLAKAALSLSKRAKPTSPFPKTARSISVYKSPMNNLFTRLGFGSRPQPDPAASSAIAQGPDDDVPSPGQQFAQFGAGCFWGAELAYQRVPGVTKTEVGYSHGFVDNPTYEDVCSETTGHNEIVRVQYDPKEVSFESLLDVFWKRHDPTTLNRQGNDVGTRYRSGIYFYTDEQEKLAREAMEKQQKILNRKIVTEILPATKFYRAENYHQQYLAKGGRMGLSQSAEKGCNDPIRCYG

SEQ ID NO: 15156 - protein, 417 aa, Haemophilus influenzae
MLEQMGKQAKDAAFILAQLTTAEKNCALSIIAEQLQQQAPLILAENAKDIELAKQNGLSDALIDRLLLTQERLQSIANDVRHVISLADPVGKIIDGGTLDSGLKIERVRTPLGVIGTIYEARPNVTIDVASLCLKTGNAVILRGGKETQFSNKILIEVVQNALEQAGLPKFAVQAITDPNRELVMQLLKLDRYVDMIIPRGGSGLHELCKQHSTIPVIVGGVGVCHTFVEKSADQNKAIFVIDNAKTQRPSTCNTLETLLVQHSIAEEFLPKLVSHLATKNVKYHAKSTALNILKQAGANVCEVTEKELRKEWGSLDLNVVVVEDIHAAIEHIRQYGTQHSESILTSSQNLARQFINQVDAAAVYVNASTRFTDGGQFGLGAEVAVSTQKLHARGPMGLEALTSYKWVCEGEYTVRK

SEQ ID NO: 15157 - protein, 577 aa, Aspergillus oryzae
MEGETLPLAQYLFKRLRQLGVDSIFGVPGDYNLTLLDHIVPSGLKWVGNCNELNAGYAADGYSRIKEIGAVVTTFGVGELSAINAIAGAYAERAPVVHIVGTPMRASQESRALIHHTFNDGDYQRFDAIQEHVTVAQVSLNDHRTAPSEIDRILLQCLLHSRPVRIAIPVDMVPVLVPVAGLSSKIQIPPAVRQPQVEEAALSAVLKRIYSSKKPMILVDGETRSFGMHGRVNHLVRTISWPTFTSGFGKGLVDETLPNVYGVCTLAYKAFVDSCDLVLVFGPHFSNTNSYNYLLKPADEKSVLLSPNSIQVNKDVFRDLPVGYFIEQLTQQLDISKIPTHKHDLVHPSLRTLPEVSPTDLVTQTGGFWKRFSPFLRTGDIILGETGTPGYGVNDFILPPQTRLFKPATWLSIGYMLPAALGASHAQRDLVISNKYHSVSNPRTILFIGDGSFQMTVQELGTIIHQKLNVIIFLINNDGYTIERCIHGRSQAYNDIAPWRYLKAAEFFGADQEGEYKALTWEVRTWADLDRVLNDSQLANGKGLRMVEVFMERLDAPDVLMGLLNNQVLRENAQSRL

SEQ ID NO: 15158 - protein, 327 aa, Fusobacterium nucleatum
MEIEKMEKKLAILTSGGDAPGMNAAIRATAKIAESYGFEVYGIRRGYLGMLNDEIFPITGRFVSGIIDKGGTVLLTARCEEFKQARFREIAANNLKKKGIEYLVVIGGDGSYRGANLLYKEHGIKVVGIPGTIDNDICGTDFTLGFDTCLNTILDAMSKIRDTATSHERTILIQVMGRRAGDLALHACIAGGGDGIMIPEMDNPIEMLALQLKERRKNGKLHDIVLVAEGVGNVFEIEEKLRGHINSEIRSVVLGHIQRGGTPSGRDRVLASRMAAKAVEVLSKGEAGVMVGIEKNEMVTHTLEKACSVEKRKSIEKDYELALLLSK

SEQ ID NO: 15159 - protein, 473 aa, Trichodesmium erythraeum
MGQQKFGVIGLAVMGENLALNVERNGFPISVYNRSDDKTKKFMAERAQGKNVHAAYSLEDFVQSLERPRRILVMVKAGNPVDKVVEQLKPLLDKGDMIIDGGNSLYEDTERRTKDLESTGLGFMGMGVSGGEEGALWGPSLMPGGTEASYKELEAILTKIAAQVDDGPCVDYVGPGGAGHYVKMVHNGIEYGDMQLIAEAYDLLKNAVGVSNEQLHEIFAEWNKTPELESFLIEITADIFTKKDTETSNHLVDMIVDSAGQKGTGRWTVINALELGVAVPTITAAVNARIMSGIKEERVGAAKELTGPSGQYEGDKQAMINKVRDALYCSKICSYAQGMALLAQASRQFDYKLNLGECARIWKGGCIIRAGFLNKIKKAFDENPALPNLLLAPEFKQTILDRQNAWREVVALAGKLGLPVPAFSASLDYFDSYRRVTLPQNLTQAQRDYFGAHTYERIDKSRGQFFHTEWPTK

SEQ ID NO: 15160 - protein, 333 aa, Burkholderia xenovorans
MPATSTKHAKVLILGSGPAGYTAAVYAARANLAPVLVTGLAQGGQLMTTTDVENWPADANGVQGPELMARFLEHAERFNTEIIFDHIHTAKLDEKPIRLIGDSGEYTCDSLIIATGASAQYLGLPSEEAFMGKGVSACATCDGFFYKQQHVAVIGGGNTAVEEALYLAGIAKKVTVIHRRDKFRAEPILIDRLLAKEKEGIVEIKWNHTLDEVTGDQSGVTGLRIKHTQTGETTDLALQGLFVAIGHKPNTDIFAGQLEMKNGYIITKGGLNGFATATSVPGVFAAGDVQDHVYRQAITSAGTGCMAALDAQRYLETIDEMAGEHAMSQEAGR

SEQ ID NO: 15161 - protein, 597 aa, Staphylococcus xylosus
MLYPVVNEFRSIIDLNGIWRFKLEGNEDQIDVSQPLNTEQVMAVPGSFNDQGVTANIRNHVGNVWYERTFTIPNVLNNERIVLRFGSATHKATVYIDGNEVTSNQGGFLPFEVTLEKAYTVGTHRLTVCVNNILDETTLPVGDYSETTDAEGNVIKKNLPNFDFFNYAGLHRPVKIYTTPKTHIQDIEIVPELQGDDAFVNYKVSTNHSRGAVKVQLVDEDKQVIAESTGVEGTIKVQNPHLWQPLKAYLYHLEVSLIEDEEIIDTYAERFGIRSVKVDKGKFLINGEPFYFKGFGKHEDSYYHGRGLDEVVNVLDFNLMKWIGANSFRTSHYPYSEEMMRLADEQGIVVIDETTAVGVHLNFNAILTGEKERNTFKEIGTKAAHEAVIKGLIERDKNHACVVMWSIANEPASDEQGAKAYFEPLVNLARTCDPQQRPVTIVTILTSQPDTCQVQDLVDVLCLNRYYGWYTQTADLKAAKLALAEELDGWSIKQPDKPIMFTEYGADTVAGMHALNDELFTEEYQIRYYEANHEVMDKYPQFIGEQVWNFADFETSSGIIRVQGNKKGIFTRERRPKAVAHYFKERWSNIPNFGYKI

SEQ ID NO: 15162 - protein, 306 aa, Triticum aestivum
  misc_feature (163)..(163): Xaa can be any naturally occurring amino acid
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADSNIQKESTLHLVLRLRGGMQIFVKTLTGXKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 15163 - protein, 449 aa, Haemophilus somnus
MSAIVSLEDFLAKVEQRDGHQPEFLQAVREVFTSIWPFLEKNPKYRSEALLERLVEPERAFQFRVAWTDDKGQVQVNRAFRVQFNSAIGPFKGGMRFHPSVNLSILKFLGFEQIFKNALTTLPMGGGKGGSDFDPKGKSDAEVMRFCQALMSELYRHVGADTDVPAGDIGVGGREVGYLAGYMKKLSNQAACVFTGRGLSFGGSLIRPEATGYGLVYFAQAMLAEKGQSFAGKTVVVSGSGNVAQYAIEKALQLGAKVVTCSDSSGYVYDPEGFTQEKLTALLDIKNVKRGRVKDYAEQFGLQYVEGARPWGVKADIALPCATQNELELSDAQQLIANGVQLVAEGANMPTTIEATDAFLEAGVLFGPGKAANAGGVATSGLEMAQSSQRLYWTAEEVDEKLHRIMLDIHANCKKYGTVEGQKNINYVVGANVAGFVKVADAMLAQGVY

SEQ ID NO: 15164 - protein, 327 aa, Wolbachia endosymbiont
MAISILGAGAWGTAIAISLGSKKDVILWTRNETTFESINGKRESDKLPGCRISDNVSVKLAIEDTINASVTILAVPTQSLRKVCQQLHNCNLKKDVAIILACKGIEKSTLKLPSEIVNEILPNNPIAIFSGPSFAVEVARKLPYSMVLACQNNTLGSKLVSELQQENVKLEFSNDIIGVQICAALKNVFAIACGIVLGSKLGFNAHAALITKSMSEIKALYSAKIGDGSVDINTLLGPACLGDLIMTCTSLNSRNLSFGFKIGNSDNGFNVQQILSEGKSVIEGFSTAESIFNLAGKLKIKMPICEAVYRLLYESASIEDTISVLIS

SEQ ID NO: 15165 - protein, 596 aa, Haemophilus somnus
MLYPTLTKTRSLYDLSGLWQFKLGEHNPEKDLSPEEVMVVPTSFNDVVVDKDKRNYIGDFWYERWVDIPKLAENDELVLRFGSVTHNAKIYVNGRELASHKGGFTPFEVIIPEELYQENQIKISVCANNILDYTTLPVGNYIEETQEDGSIKKVVKENFDFFNYAGIHRPVKLMVRPKIHISDVTIVSELSDDLKTAKLSIAVETSKAVDTIQVTILDEDRQVVAQSSNGHITLEQVRLWEVLDAYLYTAHIELLVDGKVVDTYDEPFGVRSVHVADGQFFVNQKPVYFKGFGKHEDTFINGRGLNEAANLMDMNLLKEIGANSFRTSHYPYSEEMMRLADRMGVLVIDEIPAVGLFQNFTASLDLNPKDNGTWSAMKTREAHEQAIQELVKRDKNHPSVVMWVVANEPASHEAGAHDYFKPLVALYKELDPQKRPVTLVNILLATPERDEVMDLVDVISLNRYYAWYVDHGDLAKGEAGLRQELLKWQSKFPDKPILMTEYGADTLPGLHSMWDIPYTEEFQCDFYAMSHSVFDSIPNLVGEQVWNFADFETNLMIYRIQGNHKGLFSRNRQPKQVVKEFKKRWTAIPNYNYKKK

SEQ ID NO: 15166 - protein, 416 aa, Neisseria meningitidis
MFSKSVTLAQYDPDLAAAIAQEDQRQQDHVELIASENYVSCAVMDAQGSQLTNKYAEGYPGKRYYGGCEYVDIVEQLAIDRVKELFGAAYANVQPHSGSQANQAVYASVLKPGDTILGMSLAHGGHLTHGASVNISGKLYNAVTYGLDENEVLDYAEVERLALEHKPKMIVAGASAYALQIDWAKFREIADKVGAYLFVDMAHYAGLVAGGEYPNPVPFCDFVTTTTHKTLRGPRGGVILCRDNTHEKALNSSIFPSLQGGPLMHVIAAKAVAFKEALQPEFKQYAKQVKINAAAMAEELVKRGLRIVSGRTESHVFLVDLQPMKITGKAAEAALGKAHITVNKNAIPNDPEKPFVTSGIRIGSAAMTTRGFNEADARVLANLVADVLSNPEDEANLAKVRKQVTALCNKYPVYGA

SEQ ID NO: 15167 - protein, 180 aa, Sulfolobus islandicus
PKSVVINPYFEWEDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 15168 - protein, 130 aa, Burkholderia thailandensis
MSTPRIALIAHDAKKDEIVALAGAYRAALAQCRLVATGTTGGRIAQAHGLDVERKLSGPLGGDLQIGAELADGRVDIVIFLRDPMTAQPHDPDITALVRACDVHDVPVATNVATARVLLDDLARRLPVKA

SEQ ID NO: 15169 - protein, 430 aa, Bordetella parapertussis
MNDLLPAAAAPAGARALPLRHADPEIWRAVDAERQRQMHSIELIASENFVSQAVLDAQGSVMTNKYAEGYPGRRYYGGCRHVDVAERAAIERARRLFGCEYANVQPHSGSQANQAVYLALLAPGDRILGLDLKAGGHLTHGARVNLSGKWFEALSYGVDPVSHRIDMDEVERTARRERPRLIIAGGSAYARVPDFARFRAIADATGALFVADMAHYAGLVAGGAFPSPVPFAHVTTTTTHKTLRGPRGGMILTDDADIARRIDAAVFPGLQGGPLMHVIAAKAVALGEALQPGFRAYARAVIDNARALCARLAEGGLSIVSGGTDCHLGVVDLRPWGLAGNAAERALEEAGITVNKNAVPGDAASPAVTSGIRVGSAACTSRGMGPAEFRQIGDLVLAVLGGLRDGGQAGGRDAVPARAAELSRRFPLPY

SEQ ID NO: 15170 - protein, 180 aa, Sulfolobus islandicus
PKSVVINPYFEWDDEDFIKRNKVPLKDTVIYEVHVKGFTKLRLDLPENIRGSYEGLTSEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 15171 - protein, 181 aa, Brassica napus
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 15172 - protein, 377 aa, Buchnera aphidicola
MAKKDYYQILGIPKSAEEREIKKAYKKLAMKYHPDRNQGDKTAEGKFKEIKEAYEILINEEKRSAYDQYGHAAFENGQSNSTYSTFTNSADFSDIFGDVFGDIFGGNRTQRAKKGADLCYNMEITLEEAVKGIKKEIQIPTLQKCKTCYGSGTRTGTKPRSCSTCHGKGQIHIRKGFFTVQQSCPTCHGKGTIITDPCNLCHGQGRVETYKILSVKIPPGLDTNDRIRLNNEGEAGANGAQSGDLYVQITVKKHPIFEREGNNLYCEVPINFTMAALGGEIEVPTLDGRVKLKIPYETQSGKLFRIRGRGVKSVQNRNQGDLLCRVVVETPVNLNEQQKNLLHELGNSFHGFRGEKNSPRSKRFFDGVKRFFDDLTR

SEQ ID NO: 15173 - protein, 180 aa, Sulfolobus islandicus
PKSVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQQDNKRYYLDF

SEQ ID NO: 15174 - protein, 587 aa, Unknown
  Candidatus Protochlamydia amoebophila UWE25
MFKHPQHTWNESNIVDDVQFQETDAELFKNLLTQKEALPADENSLMSPGSILKGRIVEITKDHVVVDVGLKSEGLVPIEEFSDPSQVYLDAEVEVLLDQAEDDNGQIVLSREKAERLRQWEYILEHCEEGSIVKGRVIRKVKGGLMVDIGMEAFLPGSQIDNKRIKNLDDYLGKTYEFKILKINIERKNVVVSRRELLEAERISKKAEVLEHIQPSDIREGVVKNITDFGVFLDLDGIDGLLHITDMTWKRIKHPSEMVQLGQKLEVMILSVDKDKGRVALGLKQKGPNPWDQIEQKYPPGTRVHGKIVNLLPYGAFIEIEPGIEGLIHVSEMSWVKNITDPSEVVKKGDDVEAIVLSVQKEEGKISLGIKQTEHNPWDDVEKKYPVSNIVKAEIRTLTNYGAFVELEPGVEGLIHISDLSWIKKVSHPSEVLRKGDVVDAIILSVDKESKKITLGVKQLSTNPWESIEKTMPVGSLVKGKVTKITAFGAFVELDSGIEGLIHVTELSDQAFGKVEDVVAKGDEVTAKVIKLDPEHKKIALSIKEYLIDQNQYNRDDIVVTPAKRKKKDEQKNNEDDESGSEQESEK

SEQ ID NO: 15175 - protein, 281 aa, Vigna radiata
GSSTDQAPGDDSEVILYPQAIFKDPFRRGNNILVICDVYTPAGEPLQTNKRYDAAKIFSHPDVVAEVPWYGIEQEYTLLQKDVNWPLGWPLGGFPGPRDPYYCSAGADRSFGRDISDAHYKACLFAGINISGINGEVMPGQWEFQVGPAVGISAGDELWVARYILERITEIAGVVLSFDPKPIKGDWNGAGAHTNYSTKTMRNDGGYEVIKSAIEKLGKRHKEHIAAYGEGNERRLTGRHETADINTFLWGVANRGASIRVGRDTEKAGKGYFEDRRPASN

SEQ ID NO: 15176 - protein, 395 aa, Arabidopsis thaliana
FFFSSSIFSLSHSRSPSLSSSRFSSLSAAMSPALEKSRQGNGGCNDDSKSKVTVVGSGNWGSVAAKLIASNALKLPSFHDEVRMWVFEEVLPNGEKLNDVINKTNENVKYLPGIKLGRNVVADPDLENAVKDANMLVFVTPHQFMDGICKKLDGKITGDVEAISLVKGMEVKKEGPCMISSLISKQLGINCCVLMGANIANEIAVEKFSEATVGYRGSREIADTWVQLFSTPYFMVTPVHDVEGVELCGTLKNVVAIAAGFVDGLEMGNNTKAAIMRIGLREMKALSKLLFPSVKDSTFFESCGVADVITTCLGGRNRRVAEAFAKSRGKRSFDELEAEMLQGQKLQGVSTAREVYEVLKHCGWLEMFPLFSTVHQICTGRLQPEAIVQYRENKL

SEQ ID NO: 15177 - protein, 519 aa, Perilla frutescens
MVEPPKSRVESLLQAAVQTAQWTYSLFWQLCPQKGTLVWSDGYYNGAIKTRKTVQPTEDVAEELTLQRSQQLRELYESLSAGETNHQPRRPSASLSPEDLTESEWFYLMCVSFSFPPGVGLPGKAYADRQHIWLTRANEADSKLFSRTILAKTVLCIPLLDGVVELGTTEKIEEDIGVIERVKSLFSESPLIRAPKSSEHSTSNPPNPSASRFYSRAEEEEEEEEEEEEDELTRPLNSAVQPLMQLDMYMSAQDIRVGSPDNDSSNNLDSDLRLQPTHSAAEEDSQYYSQTVSNILENQTSNRWSKYSAFCKWARRSSSSCHRHNLLLDGASQWVLKYVLLTVPLLHTRATPTPQLDDLINGNHVMAERRRREKLNQRFIVLRSMVPFITKMDKASILADTIDYLKQLKKRIQELESKIGDMKKREIRMSDADASVEVSIIESDALVEIECSQKPGLLSDFIQALRGLGIQITTVQSSINTTHATLTAHFRAKVKENVNGRKPSIMEVKRTIEQIIQRC

SEQ ID NO: 15178 - protein, 566 aa, Kluyveromyces lactis
MRYLVFLLVLFLGVNCEGDSVLFSSATDVFERPKPLKVTTALATKNSNKSRPLQVSMSSTIRNVPLATQGKDSSVFKSFNEWNKEKLRQNKLAQQERPKRSLFHNNNNGDVIRDELEMDFEIFNDDEPEGKIYKDKFNYASVDCAATIIKTNSEAQGAVSILFENKDKSLLNPCSVPNKFFVVELCEDILIESIVMANFEFFSSTFKNVRFSVAERFPVPKNGWKVLGEFEAENIRNTQQFTITNPMIWARYLRVEVLSHYGEEFYCPITLIRAHGIAMIDEFKMEVQNAGEKLEEVVSIEQKLAEEKEKCMIPSSFLTNNMSINFDLDINHQCLASLKHMNFDEFFTGYKDNENITQAKDSSSFIPINTEESIFKNIMKRLSGLETNGTMSILYIEEQSKLLSKSFDKLEDSYSQQFEALVKAFNETMTSNLENLNQFALQLRESSIKIIEEQRLATDKFISTTTNKVEELENAYQHQARVMYLILFGLISSIIYISLTRESYFEEEMVDDGWYTDNSSLQKLKNNIKRSVSETKGHPYTEAAHYSPISSDSEFEDEDSIVIPAK

SEQ ID NO: 15179 - protein, 587 aa, Oryza sativa
MESNGGGGGSPKEAAVVVPSSGDATLGGHLARRLVQVGVSDVFAVPGDFNLTLLDHLIAEPGLRVVGCCNELNAGYAADGYARARGVGACAVTFTVGGLSVLNAIGGAYSENLPLICIVGGPNSNDYGTNRILHHTIGLPDFSQELRCFQPLTCYQAVVNNLDDAHDQIDRAISTAIRESKPVYISVSCNLPAVPHPTFSRDPVPYFLSPRLSNQASLHAALDATLAFLDKAVKPVLVAGPKLRVAKAGGAFVDLADASGHAVAAMPSAKGLVPETLPRFIGTYWGAVSTAFCAEIVESADAYLFAGPIFNDYSSVGYSCLLKKEKAVVVQPDRVTVGNGPAFGCVMMRDFLSELAKRVRKNTTAFDNYKRIFVPEGQLPECEAGEALRVNVLFKHIQRMIGGTEIGAVMAETGDSWFNCQKLRLPEGCGYEFQMQYGSIGWSVGALLGYAQAVQKRVVACIGDGSFQVTAQDVSTMLRCGQRSIIFLINNGGYTIEVEIHDGPYNVIKNWDYVGLVNAIHNGEGRCWATRVRCEEELEAAIATATGDKADSLCFIEVVAHKDDTSKELLEWGSRVSAANSRPPNPQ

SEQ ID NO: 15180 - protein, 281 aa, Vigna radiata
GSSTGQAPGEDSEVIIYPQAIFKDPFRRGNNILVICDAYTPAGEPIPTNKRHNAAKIFSHPDVVAEVPWYGIEQEYTLLQKDVNWPLGWPVGGFPGPQGPYYCGAGADKAFGRDIVDAHYKACLYAGINISGINGEVMPGQWEFQVGPAVGISAGDELWVARYILERITEIAGVVLSFDPKPIKGDWNGAGAHTNYSTKTMRNDGGYEVIKSAIEKLGKRHKEHIAAYGEGNERRLTGRHETADINTFLWGVANRGASIRVGRDTEKAGKGYFEDRRPASN

SEQ ID NO: 15181 - protein, 369 aa, Debaryomyces hansenii
MTSTPFNIEKPFRVAIIGSGNWGTAVAKIVSENTAEKPEVFEKQVNMWVFEEEVDGQKLTEIINTKHENVKYLPEVKLPENLVANPDVVDTVKDADLLIFNIPHQFLPRVCKQLVGHVKPSARAISCLKGLEVGPEGCKLLSQSINDTLGVHCGVLSGANIANEVARERWSETTIAYNIPEDFRGKGRDIDEYVLKQLFHRTYFHVRVINDIIGASFAGALKNVVACAVGFVIGAGWGDNAKAAIMRIGIREIIHFASYYQKFGVKGPAPESTTFTEESAGVADLITTCSGGRNVKVARYMIENNVDAWEAEKIVLKGQSSQGILTAKEVHELLTNYNLSNEFPLFEATYRIIYENADVNEFPVILERD

SEQ ID NO: 15182 - protein, 162 aa, Mycobacterium avium
MTVKNIPLTTLDGRPTTLAELSDGATLVVNVASKCGLTPQYTALEKLAEDYAARGLTVVGVPCNQFMGQEPGTPEEIREFCSTNYGVTFPLLAKTDVNGDDRHPLYAELTKAADADGHAGDIQWNFEKFLISPDGEVVRRFRPRTEPDAPEVISAIEAVLPR

SEQ ID NO: 15183 - protein, 543 aa, Unknown
  Acinetobacter sp. NCIMB9871
MSQKMDFDAIVIGGGFGGLYAVKKLRDELELKVQAFDKATDVAGTWYWNRYPGALTDTETHLYCYSWDKELLQSLEIKKKYVQGPDVRKYLQQVAEKHDLKKSYQFNTAVQSAHYNEADALWEVTTEYGDKYTARFLITALGLLSAPNLPNIKGINQFKGELHHTSRWPDDVSFEGKRVGVIGTGSTGVQVITAVAPLAKHLTVFQRSAQYSVPIGNDPLSEEDVKKIKDNYDKIWDGVWNSALAFGLNESTVPAMSVSAEERKAVFEKAWQTGGGFRFMFETFGDIATNMEANIEAQNFIKGKIAEIVKDPAIAQKLMPQDLYAKRPLCDSGYYNTFNRDNVRLEDVKANPIVEITENGVKLENGDFVELDMLICATGFDAVDGNYVRMDIQGKNGLAMKDYWKEGPSSYMGVTVNNYPNMFMVLGPNGPFTNLPPSIESQVEWISDTIQYTVENNVESIEATKEAEEQWTQTCANIAEMTLFPKAQSWIFGANIPGKKNTVYFYLGGLKEYRSALANCKNHAYEGFDIQLQRSDIKQPANA

SEQ ID NO: 15184 - protein, 407 aa, Unknown
  Terrabacter sp. YK3
MTAPHHVIVGGSAAGVAAALAMRRNGFEGRITLVEAASEEPYERPPLSKSFTDLDAPRRILPPSTYVEEDIDLLLGMPVAALDVDRKVVRLPDGEGLGADAVLVATGVNARRLGVPGEYLEHVLVLRGLADARALAARLDVGGPWVIVGGGFIGLEAAAVARGRGIDVTVVEAMPVPLAGVLGPALAAHVQRMHEREGVRILGGRTVTEFVGEREVEKVVLDDGSVLDAATVLVGCGVEPNDELARDAGVYCNGGIVADRHGRTSVPWIWAAGDVATFVSPFTGRRQRIEHWDVANRLGTVTGANMVGVPAVNTDAPYFWSDQYGHRLQMYGRHQPGDQFVVRPGVTTAQFVAFWVRDGRVTAAAAIDSPKELRATKPLIEGRVPVMASDLIDPAVSLRALGRVAHP

SEQ ID NO: 15185 - protein, 381 aa, Haemophilus influenzae
MAKKDYYEVLGLQKGASEDDIKRAYKRLASKHHPDKNQGSKEAEEKFKEINEAYEVLGDDQKRAAYDQYGHAAFEQGGGTGGFGGGFGGADFGDMFGDIFGDIFGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRSCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 15186 - protein, 614 aa, Oceanobacillus iheyensis
MCGITGFVNWGKTADEQRSVLGKMTDTLSLRGPDDTQLWTKGHTGFGHKRLSVVDLEGGKQPMSKTVNGITYTVCYNGELYNTEDLRKELLKRGYTFSTTSDTEVLLTSYIEWKEACVDHFNGIFAFGIWDEEKEQLFMSRDRLGVKPLFYAEKAKGFIFGSELKAILAHPDISTKVDRTGLSEIFGLGPSRTPGHGLFKDIDELRAAHSLTFSKHGLKVWRYWNMVSNHHTDSEEETAEKVRELFVDAVQRQLVADVPVSTLLSGGLDSSAITAIAANYYKEKGYGPLTTFSIDYQGNEQHFQKSKFQPSSDRAWIEKMVEGFSTDHHDEIIAGQELAILLKEAVEVRDQPGQADIDSSLLWFCREIKQHTTVALSGECADEIFGGYPWFHDPAAAGNNFPWIRSLDSRIDLLHGDWKKKLDLESYVQEQYQSTIAETPRLDGEDKIDAKRRELFYLNMQWFMSQLLDRKDRMSMGASLEVRVPFADHRLVEYVWNIPWDIKMVNGHEKGILRKAMEGILPNEVLYRKKSPYPRTFQPEYTEQVSQWMNRILVDPNARLFEFMKKEKVEAIVKSKGKEFKDPWYGQLMRGPQLIAHLCQIDHWLRQYDVEVVD

SEQ ID NO: 15187 - protein, 249 aa, Flavobacteria bacterium
MHTINQRIMKNLLLLLLAMLSIQATAQIELTDENAHEKLLINNDKLIIVDFYATWCGPCKRMDPIIERLAEKYGDRISIYKIDVDKNEVDDALSVTSIPTYYFIKNQTTLEYMEGAMSEEDFEDLIIEHGGFSSNSSSAGNSEGTEDEFSQDNIDAIWYDSDALNSKAWHAYLEHSEIDVLLKSIKMVKRSIELDANYNNTDTYAALLYKTGRYDEAWKQAKAAILLAKVEDVSYSSTQELLLKIVDKM

SEQ ID NO: 15188 - protein, 549 aa, Chromobacterium violaceum
MSKDMKRAVVYQIYPKSFSSHRNQATGDLLGVVDRLDYLAWLGVDYLWLTPFYRSPQRDNGYDVSDYYSIDPAYGEMEDFELLLAEAKRRGIGVMLDIVVNHTSTEHAWFQEARKGRDNPYRDFYIWRDAPNNWQSKFGGSAWEWDEASGQYYLHLFDKTQADLNWENPAVRAEVYKMMRFWRDKGVAGFRLDVINLISKDPAFSEDDSDGRHFYTDGPRVHQHLQEMHREVFDGHDLLTVGEMSSTSLEHCIAYSRPDRRELSMTFNFHHLKVDYPDGEKWRPGAVDFIALKRILSDWQTGMHAGGGWNALFWCNHDQPRALSRFGDDGRWRTESAKMLATALHGLQGTPYIYQGEEIAMANPGFADIGQLRDVESLNAYRQLLAEGFTAADAMAVIRQRSRDNARTPMQWDDGPNAGFSAAEPWIGVAADAGSVNVATAIGDPNSTAHHYRRLIQLRKQYRVFADGDYRCLTPDHPSLWIYTRRCADEMLLAISHFGADDSHYALPAGAMPEGWTMELLLSNYPPQPPGRLRPWHSLLYRATPPAAT

SEQ ID NO: 15189 - protein, 152 aa, Haemophilus influenzae
MQTTTRTLTQHKRIALVAHDSCKKNLLNWTQKHKEALKPHILYATGTTGHILERETGLSIQSLLSGPMGGDQQLGGLIAEKKIDMMIFFWDPMNAAPHDPDVKALMRIATVWNIPVAINQSSADFLLTSVLFEQDVEIDVPDYEGYLKERLA

SEQ ID NO: 15190 - protein, 357 aa, Ginkgo biloba
MAPVQSVSAAPVPKFLPTENEAKVLQSIFVRDEDERPKVAYNEFSKEIPIISLAGMEGEERGRVREEVRAACEEWGIFQVLHHGVPSDLVHRMSQLSRSFFALPSHEKLKFDMTGGKRGGFVVSSHLQGESVLDWREIFTYFSYPLRSRDYSRWPQNPDGWREVVEEYSQELMKLACKLLEIISESLGLEPQAVTKACLDMDQKVVINFYPKCPQPDMTLGLKRHTDPGTITLLLQDQVGGLQATKDGLNWITVEPVEGAFVVNLGDHMHYLSNGKYKNADHQAVVNADTSRLSIATFQNPAQEAIVYPLEGVVKAEDKCVMEEPITFAQMYSHKMNRDLELARQKKLAKLQQDESK

SEQ ID NO: 15191 - protein, 291 aa, Brassica napus
MAEHLASIFGTEKDRVNCPFYFKIGACRHGDRCSRLHNRPTISPTLLLSNMYQRPDMITPGVDPQGQPLDPSKIQAHFEDFYEDIFEELDKFGEMESLNVCDNLADHMIGNVYVLFKEEDQAAAALKALQGRFYSGRPIIADFSPVTDFREATCRQYEEDNCNRGGYCNFMHVKQISRELRRKLFGRYRRSYRRGSRSRSRSRSVSPRRKRERGERGGDVRERGDVRERDRHGNGKRSSDRSERHDRDGGGGGRRRHGSPRRSRSPVVVREGSEERRARIEQWNKERDEGV

SEQ ID NO: 15192 - protein, 363 aa, Cleome spinosa
MALPVSAIGFEGYEKRLEISFFEPSLFLDPQGKGLRALAKSQLDEILQPAECTIVSSLSNDQVDSYVLSESSLFVYPYKVIIKTCGTTKLLLSIPPLLKLAGELSLAVKSVRYTRGSFICPGGQPFPHRSFSEEVSVLDGHFAKLGLSSSAYVMGNADESKKWHVYSASANDVSRSAGGYKNVYTLEMCMTGLDRKKASVFFKTESGSTTSMTEGSGIRKILPNSAICDFEFEPCGYSMNSVEGDAVSTIHVTPEDGFSYASFESVGYDLNAAELKGMVRRVLECFEPKQFSVAIHADMAEGVHGKAIDMDDYVCVERTMEKLGEERGAVVYQGFERVAAACGSPRSILKCGWSSEDEKDEGI

SEQ ID NO: 15193 - protein, 171 aa, Triticum aestivum
  misc_feature (119)..(119): Xaa can be any naturally occurring amino acid
NKFVQKSRLVPVRNSRDIVDPRVRWSVGALLGYAQGASDKRVIACIGDGSFQVTAQDVSTMLRCEQNSIIFLINNGGYTIEVEIHDGPYNVIKNWNYTALVEAIHNGEGKCWTAKVKCXEELTAAIETALGEKKDSLCFIEVIAHKDDTSKELLEWGSRVSAANSRAPNPQ

SEQ ID NO: 15194 - protein, 375 aa, Unknown
  Cyanothece sp. ATCC 51142
MNHSQTIVIKIGTSSLAQPETGKLALSTIAALVETLTELRQLGYDVVLVSSGAVGVGCSRLKLTERPKKIATKQAIAAVGQGRLIRVYDDLFTALNQPIAQILLTRRELMERSCYVNAKNTFDALFELGVIPIVNENDTVAIEELKFGDNDTLSALVASLINANWLFILTDVDRLYSADPRTFPDAKPIKVVNSLQLDQLQVKAGNKGSQWGTGGMSTKLTAARLATSVGVTTVITHGKKPENLLKIINGEDIGTKFEAQLKNDNARKRWIAYGLLPRGKLYLDKGAVKAISQKGKSLLAAGILKVEGSFDSADAVQLCDETGQEIARGIVNYNQEEINKIKGNHSNQIPELLGYDGGGTIVHRDNLVINGTFKN

SEQ ID NO: 15195 - protein, 520 aa, Cryptococcus neoformans
MFYAMRTLASLAILPLVLSLQLPHFPTPQDTLELAESFIRSGHAHAGDHAAEVEMVHANDMRLSTIGDEHVILTHKKYPNHKVRIKSTTGWCDPDVKSYSGFLDVGYGKNLFFYFFESRSKPSEDPIVMWINGGPGCSSSLGMLMELGPCSVKDDPKGVNDTARNPYAWNEKANVFFLDEPIGVGFSHADNGQTVSTTEEAAIDVQAFISIFFETFKEFEGRAFHMAGESYGGRYLPVFASAVVDGNKQLIKDGKTPINLNSVMIGNGVTDYFTTTESYFPFQCTVHGDLTEPVQSIGACVAMAEAVPKCHKLAKKGCLETHDYTTCSMAINYCEEVLGETFLSAGVNPYDVTMPCTVEELADSLCYPVTKKIGTYLDLPDVRHTLGVEKLRSNWSSCDGPVFTRFTQSLDNTGKTWLYVAGLLERGVRVLNYVGMLDFICNHVANELWMERLEWSGKEGYNAAQFSDWVVDGHRAGEFKTYGNLTMLKIRGAGHMVPYDKPKEALSMVTSWLDAAALDQ

SEQ ID NO: 15196 - protein, 204 aa, Brassica napus
MKKLKLMDHSSCRRRYHDPPSQATARTLNNNNNNPKKKRVVKEDLDDDKIVSKHPTYRGVRMRQWGKWVSEIREPKKKSRIWLGTFSTAEMAARAHDVAALAIKGGSAHLNFPELVYQLPRPASADPKDIQAAAAAAAAAVAVDMEVETSTSSPVSSEPSSPATTTLADDAFSDLPDLLLDVNHNIDGFWDSFPYEEPFFSGTY

SEQ ID NO: 15197 - protein, 224 aa, Brassica napus
MTTNEDGSIGTSLHGVTAREQVFSLSVEDGLSSQAIRSDDPTAKFAIPVDSEHRAKVFKPLSFAKPHMRAFHLGWISFFTCFISTFAAAPLVPVIRDNLDLTKTDIGNAGVASVSGAIFSRLAMGAVCDLLGARYGTAFSLMLSAPAVFSMSFVADAGSYLAVRFMIGFCLATCVSCQYWTSVMFTGKIIGLVNGCAGGWGDMGGGVTQLLMPMVFHVIKLTGA

SEQ ID NO: 15198 - protein, 365 aa, Pimpinella anisum
MAPSTLTALAQEKTLNSKFVRDEDERPKIAYNQFSDEIPVISLAGIDDDKRSQICRKIVEACEGWGIFQVVDHGIDTDLISEMTRLAREFFALPAEEKLRFDMTGGKKGGFIVSSHLQGEAVQDWREIVTYFSYPVPARDYSRWPDKPEGWRSVTEVYSDKLMGLACKLLEVLSEAMGLEKEALTKACVDMDQKVIVNYYPKCPQPDLTLGLKRHTDPGTITLLLQDQVGGLQATRDGGKTWITVQPVEGAFVVNLGDHGHYLSNGRFKNADHQAVVNSNSSRMSIATFQNPAPNATVYPLTIREGEKAVMEEPITFAEMYKRKMSKDIEMAKLKKLAKEKVLQEQEAEKAKLQMTPKSADEIFA

SEQ ID NO: 15199 - protein, 375 aa, Nostoc punctiforme
MARDYYEILGVSRDTDKEELKQAYRRLARKYHPDVNKEPGAEDRFKEINRAYEVLSEPETRARYDRFGPEGVSGAGAGFQDVGDMGGFADIFESIFSGFAGGMGSPTQQRRRSGPARGDDLRLDLKLDFREAVFGGEKEIRISHLENCEVCSGSGAKPGTRPRTCSTCSGSGQVRRVTRTPFGSFTQVSTCPTCNGTGMVIEDKCDACDGKGANQVTKKLKITIPAGVDNGTRLRISSEGDAGQRGGPSGDLYVYLFVNEDEEFQRDGINILSEIKISYLQAILGCRLEVDTVDGPVELIIPAGTQPNTVMKLENRGVPRLGNPVSRGDHMLNVLIDIPNKVTPEERELLEKLAKIKGDRTGKGGLEGFLGNLFK

SEQ ID NO: 15200 - protein, 138 aa, Oryza sativa
MSMPEAGRSERDGREQDDDYEQQQARVLMALMQGFCAARYRKADNIPCPIVQGLYLGSVGAAMNKDALKSLNITHILIVARSLNPAFAAEFNYKKIEVLDSPDIDLAKHFDECFSFIDESISSGGNVLVHCFAGRSRR

SEQ ID NO: 15201 - protein, 604 aa, Cucumis sativus
MEIESLRVSVDEKVLKDEEKNEKEEMKMKMKMKRKLGGVKTMPFILGNEVCDRFASSGFHSNIITYLTQDLNMPLVPASNILTNFAATSSFTSLIGALIADSFAGRFWTITIASIIYELGMVTITISAILPSLHPPPCPTQINCTQASGTQLMILYLALLLTSLGAGGIRPCVVAFAADQFDMTKVGIAGRTWNFFNWYYFCMGMATLTALTVVVYIQDNVGWGWGFGLPTIAMALSVVAFVVGSPLYNKLKPSGSPLVRLAQVVVAAFKNRKAVLPDDSKLLYRNHELDAAIAIQGRLVHTDQFKWLDKAAVITSPDSTANPPNLWRLATVHRVEELKSIIRMLPIWAAGILLVTASSHQHSFTIQQARTMNRHLTPTFQIPPATLSIFGILSMLTGLVLYDRLLVPFAKKLTHNPSGITCLQRMGVGFAINILATLVSSIVEIKRKKVAANHGLLDNPTATIPFSVFWLVPQFWLHGIAEVFMSVGHLEFMYDQSPESLRSTATALYWLAISVGNYIGTLMVYLVHKYTGEEHNWLPDRNLNRGRLEYYYWLVSGIQVMNLVYYVICAWFYTYKPLEEEKINIENKDGDQEWERCEDTIKIA

SEQ ID NO: 15202 - protein, 256 aa, Cytophaga hutchinsonii
MHEPRVTLVGAGPGDPELITLKGMRALSSADVVLYDALIHKEILSFAPITAIQVFVGKKKGVCQFPQDEINALLVEYALKHGHVVRLKGGDPFIFGRGHEELLYVESFNIPTEVIPGISSSIAVPELQRIPLTRRGVNDSFWVLTGTTRDHQLSADIQIAAKSNATVVVLMGMTKLADIIQLFIAEGKSKLPVAIIHNGTMPDETYVLGTVETIVDIVARSGISSPAVIVIGEVVRLHPEYVLDEVQKIVGPEKES

SEQ ID NO: 15203 - protein, 472 aa, Unknown
  Candidatus Protochlamydia amoebophila UWE25
MIVFAFNKSYATVHFLTELYPMGEKMNTLTMLRQRSSQVVETSDSQSVDMRQVASLILSGGEGTRLHPLTLARCKPAINFGGKYRLIDVPISNSLHAGCKKVFLLTQFLSSSLHQHVFQTYMQGPGAGSIEILTAEQKPSKKNWFQGTADAVRQNIDYLLESPFEYFLILSGDQLYNIDFQEMVHFAKKNDSDVVVATIPVNTQDAKRMGILKVDEQNSITSFYEKPQDNDLLQQLRSPSNILEKAGVAPTGERVYLGSMGIYLFKRKALVELLSEDIREDFGKHLIPTKVASGKISAYLYTGYWEDIGTIETFYQANLALTETNPVFNFHNEARPIYTYRYDLPPAKFTTCQIQKSILCEGSIIEADEITHSLLGPRTVIGSGAIIRDSYLMGNDYYVSPVNDHCKLPSEPQIGENCIIKKAIIDKNVRIGKGVQLINKQQLTRYESELVFIRDGIIVVPRGSVLPDGFIL

SEQ ID NO: 15204 - protein, 440 aa, Pyrococcus horikoshii
MKIVVIGSGTAGSNFALFMRKLDRKAEIIVIGKEPTMQYSPCALPHVISGTIEKPEDVIVFPNEFYEKQRIKMMLGVEAKKIDRERKVIITDKGEVPYDKLVLATGSRAFIPPIKGVENEGVFTLKSLDDVRRIKEYISKRKPKKVVVIGAGLIGLEGAEAFAKIGMDVLVVELLEHLLPTMLDKDMAKIVQEEMEKHGVKFKFGVGVSEIIGNPVKEVKIGEESVEADLVLVATGVRANVDLAKDAGLEVSRGIVVNEYLQTSDPDIYAIGDCAEVFDAVTGKRTLSQLGTSAVRMAKVAAENIAGKKVKFRPVFNTAITELFDLEIGTFGITEERAKKEGIEVVIGKFKGSTKPEYYPGGKPITVKLIFRKEDKRLIGAQIVGGERVWGRIMTLSALAQKGATVEDVAYLETSYAPPISPTIDPITVAAEMAMRKFKS

SEQ ID NO: 15205 - protein, 260 aa, Oryza sativa
MVLGVVLPADKHEKVMTKAVTINSGLVTIGQGKDSDRTEFYGYIKEMFKLGFEVLHIYISTCSKLERYSFCYHLEEADLHQCHQILTCTINGSSLVMIWCCHLANNSANCYFLYFTIVQHLKKFYFHFQDYVDLIIWKVSHSSEQNLAFFAVYNMETTDIVSLYQNSSEELYSLFEYFYDHFHTNPQNSSHGNFISSHSNNVHALDQLRTIKNKASSSSQQFVKKMMASLPYTCQSQSPSPYFDLSLFRYDKLISAIDRH

SEQ ID NO: 15206 - protein, 221 aa, Candida glabrata
MARRPARCYRYQKNKPYPKSRYNRAVPDSKIRIYDLGKKKATVDEFPLCVHLVSNELEQLSSEALEAARICANKYMTKISGRDSFHLRVRVHPFHVLRINKMLSCAGADRLQQGMRGAWGKPHGLAARVDIGQIIFSVRTKDNNKDVVVEGLRRARYKFPGQQKIIMSKKWGFTNLDRAEYVKRRDAGEVKDDGAFVKFLSKKGSLEENFREFPDYFTAQA

SEQ ID NO: 15207 - protein, 180 aa, Sulfolobus islandicus
PKSVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPENKRYYLDF

SEQ ID NO: 15208 - protein, 486 aa, Streptomyces avermitilis
MSEQSLKGEAQGAIRTGTQPSRHVDAGDAGYAKSLKSRHVNMIAIGGAIGTGLFLGAGGRLADAGPSLFVAYAVCGIFAFLVVRALGELVLYRPSSGAFVSYAREFLGEKGAYTAGWMYFLNWATTGIADITAVAVYTHYWGMFSDIPQWVIALIALAVVLTVNLISVRMFGELEFWFAIIKVSALVVFMLIGIFLLVTQHPVDGHHPGPSLITDHGGIFPHGLLPMLLIIQGVVFAYASVELVGVAAGETENPEKIMPKAINSIMWRVGLFYVGSVVLLSMLLPWNKYTAGQSPFVTVLSNIGVPAAGGVMNLVVLTAAMSSLNSGLYSTGRILRSMAMSGSAPKFTGVMSRSQVPYGGILLTSGICILGVGLNFVVPADAFEIVLNFAAIGILATWGMIMLCHLMFWRKTRTGELSRPSYRLPGSPWTEIVTIGFLVSVLVLMYADGGAGRTTVLCLPLIAAALVAGWYGVRGRVARKASGADA

SEQ ID NO: 15209 - protein, 557 aa, Coccidioides immitis
MRQGASWMGTPSIKGRTESQRMALLTFSLVGLQFTWGIEMTYCTPYLLQLGLTKSRTSLVWIAGPLSGLIMQPLVGVIADRSTSKWGRRRPFMIGGSLVVALCLFVLGWTTEIVSIFISDTQLRKSVTIMVAVLSIYATDFAINVVQACCRSLIVDTLPIPQQQLGSAWASRMTAVGSLIGYAIGSVDMLSRFGTTLGNTQFKQMTVIAALSLITAVSVTSYAVKERVLLSVRRYAGRNSGLGLVCTPQKTLRETLANAFLVPKSAVEQSKDTLGEVGRLGSLSLVIFSMITLVSSVVLPFGVLSPENKRGRFTPRPPRGVVRLLKKIAFVRPDLQTAWMMSHIIFAATMIFAPLAKSVRFATFLVAICGIPWAVTSWAPFAFMGVEINRLALSSTSRNSTVTMITSAGASNRHSAYLPLETTDGNNSDLEFDNASVLRLNHRHDGDSDFESDVEDDESASTGELAGIYLGVLNVYTTLPQFVGTFISWIVFSILEPNRSSTQSEPELKAKETTNSKEDQWMNLNAEGPNGIAMCLFIGAICAMVATEATRRLKHVR

SEQ ID NO: 15210 - protein, 1226 aa, Kineococcus radiotolerans
MGGVQLLPRLRVHPGQRVRVLRGLHPGQLRERLAAGELRPALLQLGHHHGALRGAGAAPGVDGRLRGGPVQLQVQPRPARALHSREPAAAAGPADPALPPLQGDRGPVLVQLLGDPARQLLGVDHRQHGLPDRVLRLRAQQLHEDAALRALRSGPGRRPERLQAVLEDHPAAVPARPGRSRGARDHLDLQRVLLGHGPAAVGGQVPHHQLAEQPQGSVLHRLQPAVGRFGPRGPAGARRVLRAAEAVRLRSDAGSHQGMNHWFEDFTPGRGALPARAWVRSDAPALSLNGGWRFRYAERADAPADLADPALDDGGWGEITVPGHWQLQGWGVPAYTNIVYPFPVEPPFVPDENPTGDHRRAFALPAGFGAEGARAVLRFEGVDSAFTAWVDGTEVGRSVGSRLPVEFDVTAALDPARDEHLLAVRVHQWSAASYLEDQDMWWLSGIFRDVTLLARPADAVEDVFVHAGYDHRTGGGTLRVDTPGPARLRVPELGVDAATNEDVPLPAVEPWSAEVPRLYDAEVSTAGERVRLRIGFRTVAVVDGVFTVNGAPVKLRGVNRHEVSADRGRAVTEAEMLADVLLMKRHNVNAVRTSHYPPHPRFLELCDEHGLWVVDECDLETHGFWLLDWRNNPSDDPRWREAYLDRIRRTVERDKNHPSVVLWSLGNESGTGQNLAAMSAWVADRDPSRLVHYEHDWAVPYADVYSRMYATHAEVAAIATRTEEALPDAAADARRRAMPFVQCEYAHAMGNGPGGLAEYQDLFESSDRCMGGFVWEWIDHGLRQRGPDGRERFAYGGDFREPLHDGAFVADGLVFPDRTPSPGLLDYAAVITQVRLRPEETPAGGRLRLTNHHDVVDLDHVRLRWSVEDDGLEVAAGELATPELAPRASTLLELPEEVPALPAATAERWFTVTAVLARATSWADAGHVLGRGQVQLADAPAPARSPGRGPARRGPDLLVGPAVLDARTGALHRLGAFPARSLELALWRAPTDNDRGEHGEPLEPAWRALGLHRLRHRTGSVEVSGSDVVVAGRSAPAGTDTGFATTWRWSAVGDGAVRLEVDVLPQAPGGLSVPLPRVGLRLELPRALRTLTWFGRGPGEAYPDTGAATWTSRFSRSVEDLQTPYVRPQENGQRADVRWAELTADDGSGLRLEADPAIGVTVRPWSTEALDASTHTSALRDEGRVWLHLDAAQQGIGTASCGPGALPAYRLQAQPVRFAVTFAALA

SEQ ID NO: 15211 - protein, 589 aa, Zea mays
MSRKRREGGGGGRGAGPVDHHGGGKGSEAGAAATDAVSMDGGLREVSVPVVFSVWCLLFLLRSQFLHSQADDDPSSEFYEEHGMRDSYCKVRPLEAYVLPYHNDSCQSSYSHSQPPQEAPSSSALASPQYNATTGGNASSPEAAFVGLDEFRSRMMQGKAENDTGPPTDGGVAHRLEPNGAEYNYAAAAKGAKVLAHNKEAKGAANILGGDKDKYLRNPCSAADKFVVVELSEETLVDTVALANLEHYSSNFREFEVYGSTSYPTEAWELLGRFTAENAKHAQRFVLPEPRWTRYLRLRLVSHYGSGFYCILSYLEVYGVDAVERMLQDFIAGAGAGAGAEADASRDRAPIDFANRDADCNDTTAQQDGNGGAGRNDSTAGDGKSNSSRSGDAKLPPQVAALASPTGRIHSDGVLKILMQKMRSLELSLSTLEEYTRELNQRYGAKLPDLQNGLSQTAVALEKMKADVHDLVDGKDSVAKDLDDLKAWKSTVSGKLDDLIKENQEMRWSVEEMRGVQETLQNKELAVLSISLFFACLALFKLACDRVFCLFAGKGREEPDAEEHTRSSRAWMLVLASSSFTTLIVLLYN

SEQ ID NO: 15212 - protein, 420 aa, Neisseria meningitidis
MSNTQKQLALAKAAKKSVNTADTEEKNRALLAMADSLEAATADILAANRQDLEAAAGNIPESMTDRLLLDGKRICAMADGIRAVAALPNPVGEILETSTLPNGLEIVKKRVAMGVIGIIYESRPNVTSDAAALALKSGSAVVLRSGKDAFQSARAIVAALKTGLAQTRIDPDALQLIEDTGRESSYEMMRAKDYLDLLIPRGGAGLIRAVVENAVVPVIETGTGIVHIYIDKDADWDKALRIVYNAKTSRPSVCNSMEVLLVHEDIAADFLPKLERLLVRDRIEAGLPPIRFRLDPQAARHIGGEAAGADDFDTEFLDYILAVKTVASVEEAVWHIETHSTHHSDGIVTENRHAADYFTTHIDSAAVYVNASTRFTDGGEFGLGCEMGISTQKLHARGPMGLKELTSYKYIVQGTGQVRE

SEQ ID NO: 15213 - protein, 415 aa, Mycobacterium tuberculosis
MTVPAPSQLDLRQEVHDAARRARVAARRLASLPTTVKDRALHAAADELLAHRDQILAANAEDLNAAREADTPAAMLDRLSLNPQRVDGIAAGLRQVAGLRDPVGEVLRGYTLPNGLQLRQQRVPLGVVGMIYEGRPNVTVDAFGLTLKSGNAALLRGSSSAAKSNEALVAVLRTALVGLELPADAVQLLSAADRATVTHLIQARGLVDVVIPRGGAGLIEAVVRDAQVPTIETGVGNCHVYVHQAADLDVAERILLNSKTRRPSVCNAAETLLVDAAIAETALPRLLAALQHAGVTVHLDPDEADLRREYLSLDIAVAVVDGVDAAIAHINEYGTGHTEAIVTTNLDAAQRFTEQIDAAAVMVNASTAFTDGEQFGFGAEIGISTQKLHARGPMGLPELTSTKWIAWGAGHTRPA

SEQ ID NO: 15214 - protein, 369 aa, Neisseria meningitidis
MKYKRIVFKVGTSSITHSDGSLSRGKIQTITCQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDALAEAAEHQADGSFFVPRAKGLRTQKQWLAFYSESRGSVYVDEGAEHALSEQGKSLLMSGIAGIEGHFSRMDTVTVYSKATKQPLGKGRVLFGSAAAEDLLKSRKAKGVFIHRDDWISITPEIRLLLTEF

SEQ ID NO: 15215 - protein, 114 aa, Coccidioides immitis
DVYLRPVAIFPDPFRRGENILVLCETWDSDGSPNKYNYRHEAARLMRANAHEHFWFGLEQEYTLLGPDGWPYGWPKGGFPGAQGPYYCGVGTGKVHCRDIVEAHYKACLYAGIN

SEQ ID NO: 15216 - protein, 440 aa, Methanosarcina mazei
MNLNNIRSSMTESTKSKDESMRSHLVKPGSVYDGIEPGELGETTESVQDRVRQLESRNSFLEEQCSQIESEKRYLENQKIKYEREIRKLQSELDRMKTSPLIIGTVIDVIKNDRIIVRSSNGPQFLVNVSQYIDEKKLLPGAKVALNQHTLAIAEVIPSTEEPFVAAMEVIESVEVDYDQIGGLDEQIQELQEAVELPLTSPERFARIGIEPPKGVLLYGLPGTGKTLLAKAVAHRTNATFIRVVGSELVQKYIGDGSKLVREIFEMARKKAPSIIFIDELDSIAARRLNETTGADREVQRTLMQLLAEMDGFDKRKNIRIIAATNRPDVLDPAILRPGRFDRLVHVPMPGIEARGKILKIHCEKMTLAEDIDFKKLAKATEGMSGADLKAIATEAGMFAVRRDKELVEMEEFLEAVEKVSMAADTQKMMPSNLPETMFV

SEQ ID NO: 15217 - protein, 335 aa, Archaeoglobus fulgidus
MIVSILGAGAMGSALSVPLVDNGNEVRIWGTEFDTEILKSISAGREHPRLGVKLNGVEIFWPEQLEKCLENAEVVLLGVSTDGVLPVMSRILPYLKDQYIVLISKGLIDFDNSVLTVPEAVWRLKHDLRERTVAITGPAIAREVAKRMPTTVVFSSPSESSANKMKEIFETEYFGVEVTTDIIGTEITSALKNVYSIAIAWIRGYESRKNVEMSNAKGVIATRAINEMAELIEILGGDRETAFGLSGFGDLIATFRGGRNGMLGELLGKGLSIDEAMEELERRGVGVVEGYKTAEKAYRLSSKINADTKLLDSIYRVLYEGLKVEEVLFELATFK

SEQ ID NO: 15218 - protein, 470 aa, Erwinia carotovora
MEQHASGSEGQFKRTMKARHLVMLSLGGVIGTGLFFNTGYIISTTGAAGTLLAYLIGALVVYLVMLSLGELSVAMPETGAFHVYASRYLSPATGYTVAWLYWLTWTVALGSSLTAAGFCMQYWFPQVPVWTWCLLFCALIYLLNVVSSRFFAEGEFWFSIVKVVTILAFIVLGAGAMFGFIPMQDGSPAPFFQNITASGWLPHGGLPILMTMVAVNFAFSGTELIGIAAGETENPQKVVPMAIRTTVARLVIFFLGTVLVLAAIIPMEEAGIAKSPFVLVFEKIGIPYAADIFNFVILTAILSAANSGLYASGRMLWSLSNEGTLPRRFSRLTRRGIPLFAISVSMLGGLLALFSSVVAPDTVYVALSAISGFAVVAVWLSICASHYMFRRHHIRSGKSLSELQYRAPWFPITPILGFLLCLLACVGLVFDPSQRIALWCGIPFVALCYGAYYFTQSVKKRGLTGVEDIA

SEQ ID NO: 15219 - protein, 448 aa, Glycine max
MSDHLPWAVPLGLDEFKSRAISSKIKSGTSGSSGSVMHRVEPGGAEYNYASASMGAKLLGSNKEAKGASNILSRDKDKYLRNPCSAEDKFVIIELSEETLVDTIEIANFEHHSSNLKAFELLGSLSFPTDVWVFLGNFTASNVRHAQRFVLQQPKWVRYLKLNLQSHYGSEFYCTLSVVEVYGVDAVERMLEDLIHTQDNLLAPGDGNADKMTVSPHPNPPESEDAHQNTFGGINSYPASDISSANHEKLNSNVPDPVEEIRQQVGRMPGDTVLKILMQKVRTLDLNLFVLERYMEDLNTRYVNIFKEYSKDIGGKDILIQNIKEDIRNLVDQQDAITKDGSDLKSWKSHISMQFGHLLRDNAVLRSEVNEVRRKQASLENKGVLVFLVCCIFSMLVILRLSLDMATSVYRVLQSVNRTDCSRKFCAVSSSWFLLLLNCIIIIFILTL

SEQ ID NO: 15220 - protein, 458 aa, Escherichia coli
MKNASNVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLAMILLLMCTMDDMRLSAILLPVWIVFLFVAFKTLRRK

SEQ ID NO: 15221 - protein, 534 aa, Glycine max
MNAIATASALTLPIFLRAGKLDTKRDLKGRFRVFAVFGEEEKKNAWAALFDVEDPRSKFPQNKGKVLDIYQALEVARHDIQYLDWRARQDVLTIMHLHEKVVEVLNPLAREYKSIGTLKKELAGLQDELAQAHRQVHISEARVTTALDKLAYMEELVNDRLLQDRSTAEVAQTSSSPSTSANSLVIEKRRQPRKSLNVSGPVQSYHPHLKNFWYPVAFSNDLKDDTMIPIECFEEPWVIFRGKDGKPGCVQNTCAHRACPLHLGSVNEGRIQCPYHGWEYTTDGKCEKMPSTQQLNVKIKSVPCFEREGMIWIWPGNDPPTATLPSLLPPSGFEIHAEIVMELPIEHGLLLDNLLDLAHAPFTHTSTFAKGWSVPSLVNFLTPASGLQGYWDPYPIDMEFRPPCMVLSTIGISKPGRLEGQSTRECSTHLHQLHVCLPSSKQKTRLLYRMSLDFAPLLKHIPLMKYLWRHFAEQVLNEDLRLVVGQQERMNNGANVWNFPVAYDKLGVRYRMWRDALERGVKQLPFSHSPHHID

SEQ ID NO: 15222 - protein, 417 aa, Erwinia carotovora
MLEQMGKAAKAASYQLAVLNTAQKDRALLTIADLLEVESATILAANVLDLADARQNGMSEALLDRLLLTQERLSAIASDVRQVCRLTDPVGQVIDGSMLDNGLKLERRRVPLGVVGVIYEARPNVTIDVASLCLKTGNAVILRGGKETYRTNAATVKVIQQALSQCDLPAAAVQAIESPDRELVNQLLKLDRYIDMLIPRGGAGLHKLCREQSTIPVITGGIGVCHIYADDSIDFDKALTVIESAKVQRPSACNSLETLLVNRSIADRFLPELSKKMAASGVTLHASSLAMPYLTSGPANVVAVEDANYNDEWLSNDLNVTLVDDLDAAVAHIREHGTQHSDAILTRSLSNAERFVREVDSSAVYVNASTRFTDGGQFGLGAEVAVSTQKLHARGPMGLEALTTYKWIGYGDDLIRA

SEQ ID NO: 15223 - protein, 379 aa, Lactuca sativa
MPPFLLPSPSRLPKKETNFRNNPFIFDASFLQNETSIPQQFMWPEDEKPHLDLPLPQLRVPPIDLNDFLTGDSLAVCNAAQLVDAACREHGFFQVVNHGIDQRLINEAHKIMDLFFGMPLLEKQKAQRKVGEYCGYASSFTNRFSSKLPWKETLSVRYSADPLSSNLVQDYFLKVMGEDFSYLGRVCQEYCEAMSKLSLSIIELLGMSLGIGQSYFRDFYEENDSIMRLNYYPPCQKPDQTLGTGPHCDPTSLTILHQDNVGGLEVFVDEKWHSIAPCSEAFVVNIGDTFMALSNGLYKSCLHRAVVNNHTPRKSLAFFLSPRMDKVVCPPKPLVEDVDKQRRYPDFTWSTFLEFTQKHYRADKNTLDAFSNWLKNGRK

SEQ ID NO: 15224 - protein, 478 aa, Unknown
  uncultured bacterium 580
MKPKTNIVWLKRDLRLTDHAPLYEATCRDEQFLVLYIYEPSLINDSHTDERHWRFIQQSLSVMEKILAKQSKQLSIAYGEADQIFSEIINQHEITNVFSHEETGLKLTYERDKKLKKIFNAKKIQWHEYQTNAVIRGLNNRKTWEKQWNKVMREEIKTINLAEANIISHNFPNYSIPKFRNDLNYQPGGCLPGQKEMHDFFETRGQDYFKFISKPDRSRTSCSRLSPYIAYGNLSMREVYQTLLKSWNKTGWRRSMAALSSRLHWHCHFIQKYESEIDIEDLPINRGYKDFPYKVINCEHEDFLAWANGETGYPLIDASMRALKKTGYLNFRMRAMVVSFACHYFMIHWKLVAKHLATLFLDFEPGIHYPQIQMQAGVTGINTIRIYNPSKQLQDHDPDTKFIRDWIDELSDQDKEYILGLPDDNFDLFSNSQNFYPTPAYDFFERTKYAKNLLWQWKKSSLVKSYNSKILSRHVKVR

SEQ ID NO: 15225 - protein, 549 aa, Haemophilus influenzae
MSESFAQLFEESLKGLETRQGSIVSGTVVAIQKGFVLVDAGLKSESAIPVAEFLNAQGELEIQVGDTVNVALDAVEDGFGETKLSREKAVRHESWIELEKAYEEKATVIGLINGKVKGGFTVELNGVRAFLPGSLVDTRPAREADHLLGKELEFKVIKLDQKRNNVVVSRRAVIESENSQEREQVLENLVEGSEVKGIVKNLTEYGAFVDLGGVDGLLHITDMAWKRVKHPSEIVNVGDEVTVKVLKFDKDRTRVSLGLKQLGQDPWAAIAENHPVNSKLTGKVTNLTDYGCFVEILDGVEGLVHVSEMDWTNKNIHPSKVVSLGDTVEVMVLEIDEERRRISLGLKQCKANPWTQFADTHNKGDKVTGKIKSITDFGIFIGLEGGIDGLVHLSDISWSISGEEAVRQYKKGDEVSAVVLAVDAVKERISLGIKQLEEDPFNNFVAINKKGAVVSATVVEADAKGAKVELAGGVEGYIRSADLTSEVAIGDVVEAKYTGVDRKSRIVHLSVKAKDQAEEAAAVASVNNKQEDIVIPNAMAEAFKAAKGE

SEQ ID NO: 15226 - protein, 355 aa, Apium graveolens
MAPSTITALSQEKTLNLDFVRDEDERPKVAYNQFSNEVPIISLAGLDDDSNGRRAEICRKIVEAFEEWGIFQVVDHGIDSGLISEMSRLSREFFALPAEEKLVYDTTGEKKGGFTISTHLQGDDVRDWREFVTYFSYPISARDYSRWPKKPEGWRSTTEVYSEKLMVLGAKLLEVLSEAMGLEKEALTKACVEMEQKVLINYYPTCPEPDLTLGVRRHTDPGTITILLQDMVGGLQATRDGGKTWITVQPVEGAFVVNLGDHGHYLSNGRFRNADHQAVVNSTSTRLSIATFQNPAQNAIVYPLKIREGEKAILDEAITYAEMYKKNMTKHIAVATQKKLAKEKRLQDEKAKMKI

SEQ ID NO: 15227 - protein, 302 aa, Alteromonadales bacterium
MPASFKINETTITQTIDDPWLKSKGIELLVKRDDLLHPLINGNKWRKLKYNLLKMQSQNKTELLTFGGAFSNHIHACAAAGKVFGLKTHGIIRGPNLDLSNPTIQFAQQCGMQLHVVNRIEYKLRNDSQYLAELQEKFPDAYILAEGGTNTYAVPGCAELAQSLPEHDYLICPTGSGGTLAGLIEGSNTATQIIGIAVLKQAQYLIDEVRELSCKAKSQTNWQLLCDFHGGGYGKFTPELWAFCQYMDITHNLPLEPIYSGKMMYAIWNLIEQDYFPSGSKIIAIHTGGLQGLKGLKYRKLI

SEQ ID NO: 15228 - protein, 617 aa, Gossypium hirsutum
MGLCTSKPSPNPSDSTNASINTRNNDIYRKPNSVSASPLPDGVNSKEDQGKQGEEEKESSNPNNEGKKSPFFPFYSPSPAHYLFSKKSPARSSTNSTPKRFFRRPFPPPSPAKHIRAVLARRHGSVKPNEAAIPEGSDAEAAGATGTGLDKSFGFSKHFGSKYELGDEVGRGHFGYTCTAKFKKGELKGQQVAVKVIPKAKMTTAIAIEDVRREVKILRALSGHSNLVQFYDAYEDHDNVYIVMELCEGGELLDRILSRGGKYTEDDAKAVMIQILNVVAFCHLQGVVHRDLKPENFLFTSKDENSQLKAIDFGLSDFVKPDERLNDIVGSAYYVAPEVLHRSYSTEADVWSIGVIAYILLCGSRPFWARTESGIFRAVLKADPSFDEAPWPSLSSEARDFVKRLLNKDPRKRLTAAQALSHPWIKKYNDVKVPLDILIFKLMKAYLRSSSLRKAALRALSKTLTVDELFYLKEQFALLEPNKNGTISLENIKAVLMKNATDAMKDARIPEFLASLNALQYRRMDFDEFCAAALTVHQLEALDRWEQHARCAYEIFEKEGNRPIVIEELASELGLSPSVPVHAVLHDWIRHTDGKLSFLGFVKLLHGVSSRTIAKAQ

SEQ ID NO: 15229 - protein, 369 aa, Spinacia oleracea
MTTAVTAAVSFPSTKTTSLSARSSSVISPDKISYKKVPLYYRNVSATGKMGPIRAQIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVEVY

SEQ ID NO: 15230 - protein, 294 aa, Spirulina sp.
AKTDIPVNIYKPKNPYIGKCLSNEELVREGGTGTVRHLIFDISGGDLRYLEGQSIGIIPPGTDNNGKPHKLRLYSIASTRHGDHVDDKTVSLCVRQLEYKHPETGETVYGVCSTYLCNLEAGADVAITGPVGKEMLLPEDEDATIIMMATGTGIAPFRAFLWRIFKEQHEDYKFKGLAWLFFGIPYSPNILYQQELEELQEEFPENFRLTLAISREQQNPEGGKMYIQDRIKENADQLWELIQKPNTHTYICGLKGMEGGIDEGMSAAAGKFDVDWSDYQKELKKKHRWHVETY

SEQ ID NO: 15231 - protein, 365 aa, Conium maculatum
MAPTTITALAQEKTLNLAFVRDEDERPKVAYNEFSNEIPIISLAGLENDSDGRRPEICRKIVEAFENWGIFQVADHGIDSALISEMSRLSREFFALPAEEKLRYDTTGGKRGGFTISTHLQGDDVRDWREFVTYFSYPIDARDCSRWPDKPEGWRSITEVYSERLMVLGAKLLEVLSEAMGLEKEALTKACVNMEQKVLINYYPTCPEPDLTLGVRRHTDPGTITVLLQDMVGGLQATRDGGKTWITVQPVEGAFVVNLGDHGHYLSNGRFKNADHQAVVNSSSSRLSIATFQNPAQNAIVYPLKIREGEKAILDEAITYAEMYKKNMTKHIEVATLKKLAKEKRLQDEKANMEKKSKSAHGISA

SEQ ID NO: 15232 - protein, 94 aa, Arabidopsis thaliana
  misc_feature (25)..(25): Xaa can be any naturally occurring amino acid
  misc_feature (60)..(60): Xaa can be any naturally occurring amino acid
  misc_feature (65)..(65): Xaa can be any naturally occurring amino acid
PLWLRHLLKYLPPQATMVAPFTGLXSSTSFPVTRKANNYITSITNNTGRLSCIKVWPPIXRRSFXTLSYLPDLSDLELPKEVDYLLLNKYIPCV

SEQ ID NO: 15233 - protein, 368 aa, Ammi majus
MAPTTLTALAQEKTLNSKFVRDEDERPKIAYNQFSDEIPVISLAGIDDDSDDKRSQICRKIVEACEGWGIFQVVDHGIDTDLISEMTRLAREFFALPAEEKLRFDMTGGKKGGFIVSSHLQGEAVQDWREIVTYFSYPVPARDYSRWPDKPEGWRSVTEVYSDKLMGLACKLLEVLSEAMGLEKEALTKACVDMDQKVIVNYYPKCPQPDLTLGLKRHTDPGTITLLLQDQVGGLQATRDGGKTWITVQPVEGAFVVNLGDHGHYLSNGRFKNADHQAVVNSNSSRMSIATFQNPAPNATVYPLKIREGEKAVMEEPITFAEMYKRKMSKDIEMAKLKKLAKEKLLQEQEAEKAKLQMTPKSADEIFA

SEQ ID NO: 15234 - protein, 315 aa, Aspergillus oryzae
MSLTNCRFYEEKYPEVDSYVMVNVKQIAEMGAYVKLLEYDNIDGMILLSELSRRRIRSIQKLIRIGRNEVVIVLRVDKEKGNILLLVGYIDLSKRRVSPEDVIKCEERYNKSKAVHSIMRHVAEATQTPLETLYQNIAWPLNRKYGHSHDAFKISITNTDVWNDVEFPSEAVKKELTQYISKRLTPHPTKVRADIEVTCFGYEGIDAVKAALRTAEEANTPDSQVKVKLVAPPLYVLTSQCLDKAIGIKQLEEAIQRIEAKIKEAGGGCSVKMAPKAVTEHDDAALQELMEKRERENMEVSGDESQSESDDGVPE

SEQ ID NO: 15235 - protein, 760 aa, Triticum aestivum
NRLLFCILNICKEILSYLPKVVGIDIVELALWAKENTLTLDNQENNNQEGQETSVATQTERKVTAKVTVENDLVSQAKDEEEDMEALLDTYVMGIGEADAFSERLKQELVALEAANVYQLLESEPLIEEVLQGIDAASATIDDMDEWLRIFNLKLRHMREDISSIESRNNGLEMQSVNNKGLVEELEKLLERLRIPQEFAASLTGGSFEESRMLKNVEACEWLTGAIRCLEVPNLDPSYVNMRAVREKRAARVRLKITFVRRASEFLRNYFSSLVDFMISDKSYFSQRGQLKRPDHADLRYKCRTYARLLQHLKSLDKSCLGPLRKAYCHSLNLLLRREAREFANELRASTKAPKNPAVWLEGSNSAGQNGSSADTSTVSDAYSKMLTIFIPLLVDESSFFAHFMCFEVPALVPAGAPNVNKRRSGANDPDDDDLSLMDPDGNDIKPDNTSVELGTLNDALQELLDGIQEDFYAVVDWAYKIDPLRCISMHGITERYLSGQKADAAGFVRKLLDDLESRISVQFSRFIDEACHQIERNERNVRQTGILAYIPRFAVLASRMEQYIQGQSRDLIDKAYTKLVSTMFTTLEKIAQSDPKTADIVLIENYAAFQNSLYDLANVVPTLAKFYHQASESYEQACTRHISSLIYLQFERLFQFSRKVDELTYTIAAEEIPFQLGLSKTDLRRVLKSSLSGIDKSIGAMYRRLQKTLTSDELFPSLWDKCKKEFLDKYESFVQMVTRIYGNEPIMPVAEMRDTLASF

SEQ ID NO: 15236 - protein, 366 aa, Anethum graveolens
MAPSTLTALAQEKTLNSKFVRDEDERPKIAYNQFSDEIPVISLAGIDSDDKRSEICRKIVEACEDWGIFQVVDHGVDSDLISEMTRLAREFFALPAEEKLRFDMSGGKKGGFIVSSHLQGEAVQDWREIVTYFSYPIQARDYSRWPDKPEGWRSITEVYSEKLMALACKLLEVLSEAMGLEKETITKACVDMDQKVIVNYYPKCPQPDLTLGLKRHTDPGTITLLLQDQVGGLQATRDGGKTWITVQPVEGAFVVNLGDHGHYLSNGRFKNADHQAVVNSNSSRMSIATFQNPAPNATVYPLKIREGEKAVMEEPITFAEMYKRKMSKDIELAKLKKLAKDKLLQEQDADKAKLQTTPKTADEIFA

SEQ ID NO: 15237 - protein, 173 aa, Oryza sativa
MKTTGGGGSPKEAVVPSAASGDTTLGRHLAHRLVQVGVSNVFAMPGDLKLTLLDHLIAEPGLHIVGCCNELNAGYASDGYAWARGVGACIVTFTVRGQLLHGRRRRSHRFWNQVTGDEAGAAFRNQERAGAAPSLPSAVARRSGSVVVDGGSASPSSPPSPSSETTASWDRHG

SEQ ID NO: 15238 - protein, 114 aa, Chrysosporium lucknowense
DVYLRPVAIYPDPFRRGDNILVLCETWDSDGSPNKYNHRHEAARLMRTHADEHFWFGLEQEYTLLGPDGWPYGWPKGGFPGAQGPYYCGVGTGKVHCRDIVEAHYKACLYAGIN

SEQ ID NO: 15239 - protein, 297 aa, Streptomyces coelicolor
MDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 15240 - protein, 114 aa, Chrysosporium queenslandicum
DVYLRPVAIFPDPFRRGENILVLCETWDSDGSPNKYNYRHEAARLMRAHANEHFWFGLEQEYTLLGPDGWPYGWPKGGFPGAQGPYYCGVGTGKVHCRDIVEAHYKACLYAGIN

SEQ ID NO: 15241 - protein, 163 aa, Mesoplasma florum
MENKTIYLAGGCFWGVQAFFDYQKGIIKTTVGYAQGDIDNPTYEEVCTGKTNHTETLKIEFNEKEISLKEILDLYFSIINPFLLNQQGNDRGTQYRTGIYSINEFDFTFVKKYLENFQKQTTQKVVVENEILKNFFDAEEYHQKYLDKNPNGYCHIDLSDYKK

SEQ ID NO: 15242 - protein, 114 aa, Uncinocarpus reesii
DVYLRPVAIFPDPFRRGDNILVLCETWDSDGSPNKYNFRHEANRLMRTHAHEHFWFGLEQEYTLLGPDGWPYGWPKGGFPGAQGPYYCGVGTGKVHCRDIVEAHYKACLYAGIN

SEQ ID NO: 15243 - protein, 638 aa, Blastopirellula marina
MCGITGAAWTDPQLAVSAEALRRMTDCISHRGPDDAGYLHRELENRNPYPAVPGVALGHRRLSIIDLAGGKQPLANEDETVWTIFNGEIFNFAALRGRLEGAGHTFRTHSDTETIVHLYEDEGPDCFRHFNGMFAIAIWDLRERRLVLGRDRLGQKPLYYYHHAGRIVFGSELKTLLALPDVPREIDPTAIDEYLTYQYVPHPNTILKGIKKLAPGELAVFSDAGLHVERYWKPDFTHEDRRPAALQDAELRELFDDAVRLRMQADVPLGAFLSGGVDSSLVVSSMQRQSDRPVKTFSIGFPQKEYDETSFARQVAEHLGTEHHEFQVTPSALEILPKLIWHYDEPMADSSAIPTWYVSQQTRAEVTVALSGDGGDELFAGYRRYRAVGLGAMIDRLGPLKRVLGAKLWQQLPSSGRQKSRMRQAKRFAEAIAMAPERRYLDWVSIFNETRRGQLYTDAFVAQLSDSDPFDFLKSAWRRCGKRDAITCASLADLTTYLPCDLNCKVDIASMAHGLECRQPFLDYRLVEFAAALPIGRKYQRGRGKQILRKVFGDRLPAQIWDRPKMGFGVPLDYWFRHELKELLIDSLLSEKALSRGLFREETVRQLLDEHMAGQFDHSARLWALLVLELWQREWIDA

SEQ ID NO: 15244 - protein, 53 aa, Archaeoglobus fulgidus
MAKYQCTICGYVYDEAEGDPESDVSPGTKWEDLPDDWVCPVCGATKDQFEKIE

SEQ ID NO: 15245 - protein, 378 aa, Acidobacteria bacterium
MTRMASTATNAKRDYYEVLQVTRTATDQEIKSSYRKLALQFHPDRNPDNKDAEEKFKECSEAYGVLSDSEKRAAYDRFGHAGLGGNGGSGGFDPNMVDFSEIFTDMFGMGDLFGRGRGRSRAQRGADLREDITLEFEQAVFGIETESRVRRHETCETCHGSGAAPGKAPVSCRKCGGRGQERFQQGFFSVSRTCGTCGGLGQVITDPCAGCRGQGAVVRERTIAVKVPAGVEDGTRIRYNGQGEAGTHGGPAGDLYIVLHVKEHKFFEREGKDLFCTVPVSFAQAALGTDIMIPTLEGEHKLHIPEGTQTGTQIKLRGKGVPVLNGHGKGDIFVEIKVQTPSKLNKRQRELLQELEAGASVENSPEKSLMSKMKDMFS

SEQ ID NO: 15246 - protein, 116 aa, Zea mays
  misc_feature (19)..(20): Xaa can be any naturally occurring amino acid
  misc_feature (26)..(26): Xaa can be any naturally occurring amino acid
  misc_feature (28)..(29): Xaa can be any naturally occurring amino acid
  misc_feature (32)..(32): Xaa can be any naturally occurring amino acid
  misc_feature (50)..(50): Xaa can be any naturally occurring amino acid
  misc_feature (52)..(53): Xaa can be any naturally occurring amino acid
  misc_feature (58)..(58): Xaa can be any naturally occurring amino acid
  misc_feature (65)..(65): Xaa can be any naturally occurring amino acid
  misc_feature (67)..(67): Xaa can be any naturally occurring amino acid
  misc_feature (88)..(89): Xaa can be any naturally occurring amino acid
  misc_feature (93)..(93): Xaa can be any naturally occurring amino acid
  misc_feature (97)..(97): Xaa can be any naturally occurring amino acid
RPPGPGHERRGNPDGPHNXXKNGNHXGXXDAXHKGAGKSRTAKAKSEEEXTXXQETGXGEKKDGXRXTEGNAHKDDTSKEPPERGARXXAANXRPPXPQKPRRQAPEGQGQAGARG

SEQ ID NO: 15247 - protein, 463 aa, Dunaliella salina
MQSKLLGLQDEISEARDKLRTSEARVAQNLKRVDELKAEAASLERMRLASSSSTDSTVSIASRGGAAVAATTSVPDHVEREGIQSRVRGSGMASTSYPSHVPQPSQAVRRGPKPKDSRRLRSSLELEDGLRNFWYPTEFAKKLEPGMMVPFDLFGVPWVLFRDEHSAPTCIKDSCAHRACPLSLGKVINGHVQCPYHGWEFDGSGACTKMPSTRMCHGVGVAALPCVEKDGFVWVWPGDGPPPDLPPDFTAPPAGYDVHAEIMVDVPVEHGLLMENLLDLAHAPFTHTTTFARGWPIPEAVRFHATKMLAGDWDPYPISMSFNPPCIALSTIGLSQPGKIMRGYKAEECKRHLHQLHVCMPSKEGHTRLLYRMSLDFWGWAKHVPFVDVLWKKIAGQVLGEDLVLVLGQQARMIGGDDTWCTPMPYDKLAVRYRRWRNMVADGEYEEGSRNRCTSQYDSWPDV

SEQ ID NO: 15248 - protein, 384 aa, Arabidopsis thaliana
  misc_feature (298)..(298): Xaa can be any naturally occurring amino acid
MEDLDPTYIQAPEHRSDSNFIPNQPEEIPVIDLSRLDDPEDVQNVISEIGDACEKWGFFQVLNHGVPSDARQRVEKTVKMFFDLPMEEKIKVKRDDVNPVGYHDGEHTKNVKDWKEVFDIYFKDPMVIPSTTDPEDEGLRLVYNKWPQSPSDFREACEVYARHAEKLAFKLLELISLSLGLPKERFHDYFKEQMSFFRINRYPPCPRPDLALGVGHHKDADVISLLAQDDVGGLQVSRRSDGVWFPIRPVPNALVINIGNCMEVIISLNLCHILLLYITLKDSFIINEYYYIINMIMXIWTNDKYWSAEHRVVVNTTRERYSIPFFLLPSHDVEVKPLEELVSPENPPKYKGYKWGKFYVSRNRSDFRKLEIENIQIDDFKVKT

SEQ ID NO: 15249 - protein, 112 aa, Magnetospirillum magnetotacticum
MKKIEAIIKPFKLDEVKEALQEVGLQGITVIEAKGFGRQKGHTELYRGAEYVVDFLPKVKLEIVLSDALVEGAVEAIRKSAQTGRIGDGKIFVSTIEEAIRIRTGETGSDAI

SEQ ID NO: 15250 - protein, 254 aa, Xanthobacter autotrophicus
MTTPPRGPDGRPLKVRVKKSRGRTTSSQKWLQRQLNDPYVARAKREGWRSRAAFKLIEMDEKARLLKRGMRIVDLGAAPGGWSQVAAKKIGLEEGLGKIVAIDLLEIEPIPGVAFAQMDFLAPDAPERLIAMLGGQADLVMSDMAANATGHKKTDHLRIVGLVELAVEFARQVLAPGGTFLAKVIQGGMEATLLADLKRDFTQVRHVKPAASRADSAELYVLATGFRGEADRAETDDAGTDGTGTAEAQAPRDQ

SEQ ID NO: 15251 - protein, 443 aa, Arabidopsis thaliana
MAMAELSTPKTTSPFLNSSSRLRLSSKLHLSNHFRHLLLPPLHTTTPNSKISCSVSQNSQAPVAVQENGLVKTKKECYGVFCLTYDLKAEEETRSWKKLINIAVSGAAGMISNHLLFKLASGEVFGPDQPIALKLLGSERSIQALEGVAMELEDSLFPLLREVDIGTDPNEVFQDVEWAILIGAKPRGPGMERADLLDINGQIFAEQGKALNKAASPNVKVLVVGNPCNTNALICLKNAPNIPAKNFHALTRLDENRAKCQLALKAGVFYDKVSNMTIWGNHSTTQVPDFLNARINGLPVKEVITDHKWLEEGFTESVQKRGGLLIQKWGRSSAASTAVSIVDAIKSLVTPTPEGDWFSTGVYTDGNPYGIEEGLVFSMPCRSKGDGDYELVKDVEIDDYLRQRIAKSEAELLAEKRCVAHLTGEGIAYCDLGPVDTMLPGEV

SEQ ID NO: 15252 - protein, 270 aa, Cenarchaeum symbiosum
MQASDTERPRIFKDVSEAQITRAIATEFNSVLLDAAESDVIIIGAGPAGLTASRELSGMGFRVLVIEQNNYLGGGYWLGGYMMNPVTVREPAQKIWDELGISYKQAADGLYITPGPNAVSKLIAGACDAGVKFLNLTKFDDLVLKNGRVAGVVVNWMPVSALPRNITCVDPIALEAKMVIDSSGHDSVAVKRLVDRGLVQWKGMDPMHVNAGEDDVVHMTGEVFPGLVAAGMSVTETHGLARMGPTFGSMLFSGKKAAEVTATKIKELQG

SEQ ID NO: 15253 - protein, 1044 aa, Pichia angusta
MTCSVPPLPEDISPRAAKKKLVIVGLGMVGLSFLEKLLSNDSKLNEYSIMVYGEEPYLAYNRVGLTEYFQHREFKNLLLSPEEFYQLRGEKWNYAIDEKVVDIDRRARIITTDKGNRASYDVLVLCTGSAAILPTDLLPPLTRKSYREMGCFVYRTIDDLYSMIDYCQGAKKTRAIVVGGGLLGLEAAKALYDMESFEDITIVHRSHWLLSQQMDQKGGSLLTSKVKELGITCRTGTTVSELLFDEDQNLKGVKYDNGQIEECSLLCYTIGIKPRDELTSCGLNAGSRGGFKVNNMLQTSDENIYAIGECASWNNMTFGLIAPGYEMADILAFNLTQGKLHQPKEFSEPSMGTRLKLMGVDVASFGDFFADRNGPKWLLADTTKKFVDLVFEDPIDATYTKLLFTKDGKYMLGGILVGDTSNYTKFSAMIRKPLPKSPSELLIGKSGEDDMEMLSDETQICSCHNITKGKLVEAVKNGCSSLADVKKCTKAGTACGGCEPTVKIIFEKELKKLGGKVSNNLCVHFDYSRAHWFSLIMVKNFRSFRRVMEELGNDPSSSGCEICKPTIGSILSTLYNRHLLKKEVHGLQDTNDRYLGNIQRDGTFSVVPRMSAGEITPEKLVSIGKIAKKYGVYTKITGAQRLDLFGVKKSDLLKIWKDLNEAGFESGQAYGKSLRNVKSCVGSTWCRYGIGDSVGLAVRLEERYKGIRSPHKMKGGVSGCVRDCAEFHSKDFGLCAVSGGFNIYVGGNGGMKPRHAQLLATNVRPDEVIPILDRYLMFYITTADRLQRTARWLENLDGGIEYLKDVIIRDKLGICKDLEAQMRHVVAGYYDEWAKAVSEEKENPIFKQFVNTPENQDCVEIVNERGQPRPAMWPEKAANQKFNEIRWSSVSWQEVCECSDLPLAEAGSSATVLVGDTQIALFRTSKNELYCSQNMCGHKRAFVLNQGLLSEDSDKNCYISCPMHKRNFYLKSGACKNDEALSIATFEVKEENGKVYAKLPPLKELDEVLGTSKWKVTSQETEAKQVRKITTEKNLVDKAILLDW

SEQ ID NO: 15254 - protein, 334 aa, Mycobacterium tuberculosis
MAGIASTVAVMGAGAWGTALAKVLADAGGEVTLWARRAEVADQINTTRYNPDYLPGALLPPSIHATADAEEALGGASTVLLGVPAQTMRANLERWAPLLPEGATLVSLAKGIELGTLMRMSQVIISVTGAEPPQVAVISGPNLASEIAECQPAATVVACSDSGRAVALQRALNSGYFRPYTNADVVGTEIGGACKNIIALACGMAVGIGLGENTAAAIITRGLAEIIRLGTALGANGATLAGLAGVGDLVATCTSPRSRNRSFGERLGRGETLQSAGKACHVVEGVTSCESVLALASSYDVEMPLTDAVHRVCHKGLSVDEAITLLLGRRTKPE

SEQ ID NO: 15255 - protein, 107 aa, Glycine max
  misc_feature (48)..(48): Xaa can be any naturally occurring amino acid
VHFCKLNETLIAIKALHGTTLEVPNPEEAVDHRERRYKIILRSTMGPXDVYLMSQFEEVSGADLPMIPLASSFGSIEQLMTEMVPTKCSGKELEPQTQLSSQAFSDL

SEQ ID NO: 15256 - protein, 97 aa, Guillardia theta
MATYKVKLSGEGVDKTIDCPDDQYILDAAEEQGIDLPYSCRAGACSTCAGKVAAGSVDQSDQSFLDDSQIGDGFVLTCVAYPTSDCTILTHQEEGLY

SEQ ID NO: 15257 - protein, 410 aa, Symbiobacterium thermophilum
MAERWDLVIIGGGPAGLSAAVYGARARMSTLLIEKGRPGGQAATTEEVENYPGLGRTTGPELMKQFREHAEALGATIVRGEVGAVELQGPVKTIRTKKGEVYEARAVILCPGAEPRMLGVKGEGRLRGKGVSYCATCDADFFTDLDVVVVGNGDAAVEEAIYLTRFASSVTLICIHPEGIMDANKAAQERLFATPKIKVIWQTMVEEILGEDHVEKVALRHLGTGERTELPCDGVFVFVGTTPRTEFLRGTGIELDRKGYIIADPDTMETNIPGVFAAGDARRKWLRQIVTAAADGAIAACAAEKFLAEEEQVDREILSPEEPVLAVFWSPADSLSVHVLQQAERIVAGMGGQMRLARIDCYKSARTAARLGVFDVPAVRIFHKGIPLATLTEDFNHLEEWVVGHLPARI

SEQ ID NO: 15258 - protein, 200 aa, Treponema pallidum
MNVYKRADFWAKKAAAAGYRARSVYKLAALDKKYSLLSRASRVLDLGAAPGSWTQYVLGTAAACTAVCAVDVQPIASDIQDARLQRVQGDLCAADTRARVACNAPFDLILSDAAPRTTGNRTVDTSASACLAAGVCAYVNFLSSDGGLVFKVFQGSEHLAILTHLRAHFGAVCSFKPPASRPRSCELYVVARFFRGTCGK

SEQ ID NO: 15259 - protein, 241 aa, Saccharomyces cerevisiae
MATIASEYSSEASNTPIEHQFNPYGDNGGTILGIAGEDFAVLAGDTRNITDYSINSRYEPKVFDCGDNIVMSANGFAADGDALVKRFKNSVKWYHFDHNDKKLSINSAARNIQHLLYGKRFFPYYVHTIIAGLDEDGKGAVYSFDPVGSYEREQCRAGGAAASLIMPFLDNQVNFKNQYEPGTNGKVKKPLKYLSVEEVIKLVRDSFTSATERHIQVGDGLEILIVTKDGVRKEFYELKRD

SEQ ID NO: 15260 - protein, 73 aa, Arabidopsis thaliana
  misc_feature (26)..(26): Xaa can be any naturally occurring amino acid
SYDTIVASTPHATIFARFNRQKAYTXFPATLKANNDITSITSNCGRVNSIHMLPPIGKNNFETLSYLPDLTDS

SEQ ID NO: 15261 - protein, 524 aa, Oryza sativa
MGLDLGALVLKSGGLLVSDYDSIVAINIFVALLCSCIVIGHLLEGNRWVNESITALVMGLITGGVILLVSGGKNSHILVFSEDLFFIYLLPPIIFNAGFQVKKKQFFRNFMTIILFGAVGTLISFVIISLAIGAIFSATDSVCTLQVLNQDETPLLYSLVFGEGVVNDATSVVLFNAIEDIDIANFDSLVLLAFIGNFLYLFFTSTLLGVVAGLLSAYIIKKLCFARHSTDREVAIMILMAYLSYMLSMLLDLSGILTVFFSGIVMSHYTWHNVTESSRITTKHTFATLSFIAEIFLFLYVGMDALDIEKWKLASSSPKKPIALSATILGLVMVGRAAFVFPLSFLSNLSKKETRPKISFKQQVIIWWAGLMRGAVSIALAYHKFTASGHTELRINAIMITSTVIVVLFSTMVFGFFTKPLLNLLIPPRPDIAADLSSQSIIDPLLGSLLGSDFDVGQPSPQNNLQLLLTIQTRSVHRVWRKFDDRFMRPMFGGRGFVPFVPGSPVERSIHGSQLGTVTEAEHS

SEQ ID NO: 15262 - protein, 164 aa, Unknown
  uncultured bacterium
RLRVGVCKSTDVPRVMNERGVAEFYKDKWENLGAEVVNPIGCQDCHDNKTMNLRITRPALVEAYQRMGRDVNKATHQEMRSLVCAQCHVEYYFKGKEEKYLTFPWDKGFSVEQMEEYYDRVEHVDWVHALSKTPMLKAQHPDYEIYTTGVHADRGVSCADCHMP

SEQ ID NO: 15263 - protein, 225 aa, Nostoc punctiforme
MRMLNSVLFALSSVDKNREPFISLALYHAFKWSVVSPILHTYFRGQIYGAENVPQSGPLLVVSNHASYFDPPIVSNCVRRPVAYMAKEELFNIPVLAQAIKLYGAYPVSRGSADRNAIRSALDYLNKGWAVGVFLEGTRTPDGRITDPKRGALLLAAKAKAPILPVSVCGTEKILQKGSSLPHAVPITVRIGNLIDAPTSTNKEELEALTQKCATVINKMHDLGR

SEQ ID NO: 15264 - protein, 911 aa, Hyphomonas neptunium
MPLSTPTPAKGAGRALGLTTFAFTACFAVWTIFAILGLQIQKELGLSETQFGLLVGTPILTGSLSRLFLGIWADQFGGRIVNLAVMLLSALATWLLTFATTYPEFLLAALGIGIAGGSFSVSITYVSKFFPPEKQGSALGIVGAGNVGAAVTKFAAPIVMASMGWKGVANVWAIALVLVALVFFFLTSDDPELAERRRTGAKPRSFASQFEPLRNIQVWRFSLYYFFVFGAFVALALWLPRYLIGVYGFDVKTAGMLAAAYSIPASIFRIYGGHLSDRVGARTVMYWTFLVSVVVTFFLSYPPTSYVVDGVRGPISFRLATGPVAFVIAIFVLGFFMSLGKAAVYKHIPVYYPKDVGAVGGLVGLMGGLGGFVLPILFGVLNDLTGIWTSCFMLLFLIVSASLIWMHLAIRHMEREAAGATLDSLPQLPEMQPIHGEREARALAPKLIEDWRPEEPQFWEETGKKIASRNLWLSIPALFLSFAVWMVWSVVVAKLPQIGFAYTTDQLFWLAALPGLSGATLRIFYSFMVPVFGGRLWTTLTTWSLMLPALGIGFAVQNPETPYWIMLVLALLCGFGGGNFASSMSNIGFFYPKREKGNALAMNAGLGNLGVSAMQFLVPLVITVGVFGFLGGQPQATEEGGELFLQNAGFIWVPLIIASAFAAWFGMNDLSSAKASFSDQAVIFKRRHNWIMCWLYTGTFGSFIGFSAAFPLLTKTQFPEINVLQIAFLGPLVGALSRSFTGWIADRFGGARVTLAVFVLMMVGTVGVLYFLANKDAPGAFIGFFVSFIVLFFATGVGNASTFQMIPAIMRKEIDRLEPQMSGADRLRQAEKESAAITGFTSAIAAYGAFFIPKSFGMSLAASGSAAPALYGFLAFYVSCLLVTWFVYARPGGLLFDVENRKRSGPATAAA

SEQ ID NO: 15265 - protein, 159 aa, Unknown
  uncultured bacterium
ACWWCKSTDVPRVMNEIGAANFYKKKWTDLGSEIINPIGCQDCHDPKTMNLRTTRPALIEAYQRQGKDITQFSRQEMRSLVCAQCHVEYYFKGDEKYLTFPWDKGFSADDMEAYYDNIEFTDWTHALSKAPMLKAQHPDYELFMTGIHAIRGVSCADCA

SEQ ID NO: 15266 - protein, 317 aa, Zea mays
MAGLVVSSQCFLKLLLVVSVFHVSFAARRLNELVQNQSQLLHYHNGPLLYGKIAVNLIWYGNFKPSQKAIITDFVTSLSSPASQSSQPSVATWWKTTEKYYHLSPRKASLSLSLGDQILDETYSLGKSLTGKNLVQLASKGGQRNSINVVLTSADVAVEGFCMSRCGTHGSSASHLKKNSKSYKFAYIWVGNSETQCPGQCAWPFHQPIYGPQSPPLVAPNNDVGLDGMVINLASLLAGTATNPFGNGYFQGPAEAPLEAASACPGVYGKGAYPGYAGDLLVDSTTGASYNVKGANGRKYLVPALYDPSTSSCSTPV

SEQ ID NO: 15267 - protein, 365 aa, Ashbya gossypii
MEFSVEGTQFSPPVKRIFDTAGTHDFQKSLTMYRLQSHLERYLKLVQGQKIPKSSQNRAVVRFVCILERLDALMDETPPRTGSARRFGDLACRDWHDRMQGELDGLLETLLPEAARRSAAELRYYLGSAFGSRERLDYGTGHELAFLAVVVALDMLGLWTEDKFTGEDMLYVWARYYALVHRLILTYNLEPAGSHGVWGLDDHLHLAYILGASQWAQDRNVPMQPSDILDPKAVARYSETNLYCNSIAFLLRVKTGHFAQHSPMLHDIAQTVPTWSKVTTGLIKMYRVEVLNKFPVVQHFWFGTGFFPWVDMAHGMSLPNYEAPSETSEKPAAGTAHTTTTTMPPPRMTANCGYGPLGRLVTPRR

SEQ ID NO: 15268 - protein, 162 aa, Unknown
  uncultured bacterium
ACWTCKSPDVPRLMDKVGIGEFYASNFHDFKDEVKNPIGCADCHDNKTMQLRISRPALKEAFERQGKDITKVSHQEMRSLVCAQCHVEYYFKGEKEKYLTFPWDDGITIEGMEEYYERTGHVDWTHAISGANMIKMQHPDYEVYMQGIHAFRGVSCADCHMP

SEQ ID NO: 15269 - protein, 437 aa, Vibrio parahaemolyticus
MSENEKNKPQGIYKYYENNPKSADEKVFGRVSYPDRRGFLKGAGLATMAAALGGFIPFHRNMPAGIIPAAFAEGLDDVMIEGKDGLTVLNDRPMNAETPPHLLNDDVTPTRRHFIRNNGIPPTDVNPETWTLTIDGLVDKPMSLSIADLKKNFDVVEQQLVVECGGNGRAFFDPKASGNQWTYGAVACSSWTGVRLADVLKAAGVKDGAIYTAHYGADKHLSGKEGKLPISRGVPIAKAMGSENLIAFAQNGEALHPMNGAPLRLVVPGWPGSCSQKWLTRIQIRDQIHDGPKMTGTSYRVPNRPVAPGENVAKEDFEIIERMPVKSLITSPQTNTEVNGNEIAIRGHAWSGDRKVTKVQISIDFGATWMDADLAAPANDGAWQTFNAKVKFPQAGYYEVWAKATDDQGVSQPFAIAWNPKGYLNNTFHRIALIVRS

SEQ ID NO: 15270 - protein, 953 aa, Mycobacterium tuberculosis
MIDGAPPSDPPEPSQHEELPDRLRVHSLARTLGTTSRRVLDALTALDGRVRSAHSTVDRVDAVRVRDLLATHLETAGVLAASVHAPEASEEPESRLMLETQETRNADVERPHYMPLFVAPQPIPEPLADDEDVDDGPDYVADDSDADDEGQLDRPANRRRRRGRRGRGRGRGEQGGSDGDPVDQQSEPRAQQFTSADAAETDDGDDRDSEDTEAGDNGEDENGSLEAGNRRRRRRRRRKSASGDDNDAALEGPLPDDPPNTVVHERVPRAGDKAGNSQDGGSGSTEIKGIDGSTRLEAKRQRRRDGRDAGRRRPPVLSEAEFLARREAVERVMVVRDRVRTEPPLPGTRYTQIAVLEDGIVVEHFVTSAASASLVGNIYLGIVQNVLPSMEAAFVDIGRGRNGVLYAGEVNWDAAGLGGADRKIEQALKPGDYVVVQVSKDPVGHKGARLTTQVSLAGRFLVYVPGASSTGISRKLPDTERQRLKEILREVVPSDAGVIIRTASEGVKEDDIRADVARLRERWEQIEAKAQETKEKAAGAAVALYEEPDVLVKVIRDLFNEDFVGLIVSGDEAWNTINEYVNSVAPELVSKLTKYESADGPDGQSAPDVFTVHRIDEQLAKAMDRKVWLPSGGTLVIDRTEAMTVIDVNTGKFTGAGGNLEQTVTKNNLEAAEEIVRQLRLRDIGGIVVIDFIDMVLESNRDLVLRRLTESLARDRTRHQVSEVTSLGLVQLTRKRLGTGLIEAFSTSCPNCSGRGILLHADPVDSAAATGRKSEPGARRGKRSKKSRSEESSDRSMVAKVPVHAPGEHPMFKAMAAGLSSLAGRGDEESGEPAAELAEQAGDQPPTDLDDTAQADFEDTEDTDEDEDELDADEDLEDLDDEDLDEDLDVEDSDSDDEDSDEDAADADVDEEDAAGLDGSPGEVDVPGVTELAPTRPRRRVAGRPAGPPIRLD

SEQ ID NO: 15271 - protein, 162 aa, Unknown
  uncultured bacterium
ACWRCKSTDVPRVMNERGVAEFYKDKWDHLGDQVVNPIGCQDCHDNKTMNLRITRPALVEAFQRRGKDIKQATHQEMRSLVCAQCHVEYYFKGKEEKYLTFPWDKGFRAEDMEAYYDSVQHDDFVNTLSRAPILKAQHPDYEIYKTGVHAERGVSCADCHMP

SEQ ID NO: 15272 - protein, 472 aa, Oryza sativa
MHLLASSSSIPMATTRATSTLLLLLLLVSATWAASAPTTSRARNVITHVKGFQGRLPFHLETGYVEVDNTNTVELFYYFIQSERSPADDPLILWITGGPGCSALSGLLFEIGPLKFDVAGYTEGFPQLFYFQDSWTKVSNVIFLDAPVGTGFSYAREEQGYNVTLTQTGQQLVVFLTKWLGDHPEFASNPLYIGGDSYSGYTVPVTALQIANDDDARARLNLKGYLVGNAATDVKYDSGGKVPFMHGMGLISDEMYEAARSSCRGDYVSTPTNADCANALQAISMATFAINPVHILEPICGFALRGRAMPETTMDQRLRLGLPVECRDNGYRLSYLWADDPEVRATLGIHEGSIASWSRCTALPLFRHDVDSAIPYHAELTQRGYRALVYNGDHDLDMTFVGTQQWIRTLGYNVVTAWRPWYSNRQVAGFTTVYDHNLTFATVKGGGHTAPEYRPKECLDMLDRWTSPAGEL

SEQ ID NO: 15273 - protein, 469 aa, Staphylococcus aureus
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNKTNSHGVPYLSMLVSSIALLIAALLNYIFPNAIQLFIYVTTLSTVLFLVVWAMIIVAYLMYLKKHPEAHKNSKFKLIGGKPIAYIILAFFFFVFILLFFSDETRAAIYISPFWFIFLFFFYKKYKTNAEKLAYEQRQNDSGHFRYDNQ

SEQ ID NO: 15274 - protein, 311 aa, Mesoplasma florum
MKKHINENLKDILIIGGGPAGLTAGVYAARAGMKTIILEKEAPGGKMVKTDTIENYPGFDSIKGPDLALKMYMQVMNLGAEFVYDEVIKIEKMDNYFIVTTLNGQIIEALSVIVATGTLENKLGIPGEDNLYGKGVSYCAVCDGAFHKGNPVAIVGGGYSAVEEGIYLSKFVSKLYVVVRKDHFRVDPVTLSKLEQLENVEFLMNSVVKKVNGIDKVESVEIENVITKEIKTVPVTGLFPYIGATPVTEFLENLNLDKNEGYLTGDAKLKSNIKGLFIAGDVRDVPLRQIAIAAGDGALAGQMAVNYVQEL

SEQ ID NO: 15275 - protein, 596 aa, Pichia stipitis
MAEVSLGRYLFERLYQLQVQTIFGVPGDFNLSLLDKIYEVEDAHGKNSFRWAGNANELNASYAADGYSRVKRLGCLVTTFGVGELSALNGIAGSYAEHVGLLHVVGVPSISSQAKQLLLHHTLGNGDFTVFHRMSNNISQTTAFISDINSAPAEIDRCIREAYVKQRPVYIGLPANLVDLNVPASLLESPINLSLEKNDPEAQDEVIDSVLDLIKKSLNPIILVDACASRHDCKAEVTQLIEQTQFPVFVTPMGKGTVDEGGVDGELLEDDPHLIAKVAARLSAGKNAASRFGGVYVGTLSKPEVKDAVESADLILSVGALLSDFNTGSFSYSYRTKNIVEFHSDYTKIRQATFPGVQMKEALQELNKKVSSAASHYEVKPVPKIKLANTPATREVKLTQEWLWTRVSSWFREGDIIITETGTSSFGIVQSRFPNNTIGISQVLWGSIGFSVGATLGAAMAAQELDPNKRTILFVGDGSLQLTVQEISTIIRWGTTPYLFVLNNDGYTIERLIHGVNASYNDIQPWQNLEILPTFSAKNYDAVRISNIGEAEDILKDKEFGKNSKIRLIEVMLPRLDAPSNLAKQAAITAATNAEA

SEQ ID NO: 15276 - protein, 444 aa, Prevotella ruminicola
MKATEVIEKLKAKFPGQPEYIQAVSQVLGTIEEEYNKHPEFEKANLIERLCVPDRILQFRVSWVDDNGNVQTNLGYRVQHNNAIGPYKGGLRFHKSVNASILKFLAFEQTFKNSLTTLPMGGAKGGSDFDPHGKSDMEVMRFCQAFMNELYRLIGPDEDVPAGDIGVGGREVGYMFGQYKKLTHQFQGILTGKGLEFGGSLIRPEATGYGNVYFLEDMLKTRGESLEGKTVLVSGSGNVAQYTIEKLLQLGAKPVTCSDSNGYIYDPDGIDAEKLAFIMELKNVKRGRIKEYAEKYGVKYVENARPWGEKADIATPCATQDEINEAEAKTLIANGVFAVSEGANMPTEPAAIKVFQDAKILYCPGKASNAGGVATSGLEMSQNSERLSWTREEVDTKLHNIMDEIHANCVKYGTEPDGYINYVKGANVAGFMKVAKAMMAQGIY

SEQ ID NO: 15277 - protein, 381 aa, Vibrio parahaemolyticus
MSKRDFYEVLGVSRDASERDIKKAYKRLAMKFHPDRNQGDESAADKFKEVKEAYEVLTDSQKKAAYDQYGHAAFEQGGGGFGGGFGGGGADFGDIFGDVFGDIFGGGRRGGGGHRAQRGADLRYNMELTLEEAVRGVTKEIEVPTLVHCDSCDGSGAKKGSSAETCGTCHGHGQVQMRQGFFAVQQTCPTCHGKGKIIKDPCNECHGQGRKQKTKTLNVKIPAGVDTGDRIRLSGEGEAGEMGAPSGDLYVQVHVKEHHIFERDGNNLYCEVPVSFAMAALGGEVEVPTLDGRVSLKVPSETQTGRMFRMRGKGVKGVRGGGIGDLIVKLVVETPVNLSSRQKELLKEFEESCGGEAATKHKPKSEGFFNGVKKFFDDLTS

SEQ ID NO: 15278 - protein, 112 aa, Xanthomonas campestris
MKLITAIIRPFKLDEVREALSAAGVSGITVTEVKGFGRQKGHTELYRGAEYVVDFLPKIKIETVVTDDRLDAVVEAIQNAAGTGKIGDGKIFVTAIEQVVRIRTGEIGADAL

SEQ ID NO: 15279 - protein, 323 aa, Cenarchaeum symbiosum
MAAEPEGGVLVEKGPPKEPRKKTKYDVIIIGAGPAGYTAGIYCSRARRDTLILSGILPGGQLVNTTDVENFPGFENGIMGPDLMINFRKQAERMGTTIVDDEVVNVDFRHRPFKVLTSEEEYEAKAVIVGTGATPRKLGVEGEKAFAGKGVSYCATCDGPFFKNMELVVVGGGDSAMEEATFLTKFATTVHVVHRRKELRASKIMQERAHDDEKIRFHLGYEVKEIRGNGKVQQVVLASPDGEEQMDTGGVFVAIGHDPNTELFKGQLETDDQGYIVLKGASQTSVPGVFAAGDVHDRRYRQAITAAGFGCMAGIDVNNYLDE

SEQ ID NO: 15280 - protein, 134 aa, Zea mays
FGSRLSQKPKPKGVTFIFIIQSFQRSSFFFFSSESRKHALAEVKLRFCPSSGGVGEEHVRRNNNIDIDMARCFGLGSVLVLAALAASMVVLPLMLPPLPPPPLVLLFFPVGIMAALMLLAFSPSDQNGVVYAST

SEQ ID NO: 15281 - protein, 258 aa, Staphylococcus aureus
MAVISMKQLLEAGVHFGHQTRRWNPKMKKYIFTERNGIYIIDLQKTVKKVDEAYNFLKQVSEDGGQVLFVGTKKQAQESVKSEAERAGQFYINQRWLGGLLTNYKTISKRIKRISEIEKMEEDGLFEVLPKKEVVELKKEYDRLIKFLGGIRDMKSMPQALFVVDPRKERNAIAEARKLNIPIVGIVDTNCDPDEIDYVIPANDDAIRAVKLLTAKMADAILEGQQGVSNEEVAAEQNIDLDEKEKSEETEATEATEE

SEQ ID NO: 15282 - protein, 78 aa, Mycoplasma pneumoniae
MQPKFNNQAKQDKLVLTGKILEIIHGDKFRVLLENNVEVDAHLAGKMRMRRLRILPGDLVEVEFSPYDLKLGRIIGRK

SEQ ID NO: 15283 - protein, 966 aa, Unknown
  Oceanospirillum sp. MED92
MPTQNQAPLATLEQTDAFIARHIGPSAAEQQAMLKELGVADLDQLITQTVPEDILVKSPINLPDSRTEEEVLTYLKSVAAKNKINTSMIGMGYTDTIVPNVILRNVLENPGWYTAYTPYQPEVSQGRLEAILNFQTMVLDLTGLDLANASLLDESTAAAEAMTLCKRMSKAKKANTFLIDKNVHPQNISVIETRAEPLGYEVIVGDVAELIDQHECFGVLVQYPGTFGDVNDYAELIEKAHDKKALFCAAADIMSLVTLKSPGEMGADVVFGSAQRFGVPMGFGGPHAAFFATRDAYKRSVPGRIIGVSVDSRGNKALRMAMQTREQHIRREKATSNICTAQVLLANMAGFYAVYHGPQGLKTIAGRINRFASILAKGLQSKGVELVNQSWFDTITIKLDNAEAVYSKALEAGINLRNTGDNQLGMTCDECTSRETINTLWDCILGEDHGLNLEQIDAEIAASGENSYAANLARESEILTHPVFNSYHSETEMLRYLKKLENKDISLAHSMIALGSCTMKLNATAEMIPVTWPEFGKLHPFAPMDQAQGYKQLIDELEEQLKAITGFDAVCMQPNSGAQGEYAGLLAIRKYHQANGDGHRNICLIPTSAHGTNPASAALADMKVVLTACDENGNVDVADLRAKAEQHKDDLSCLMITYPSTHGVYEEDIREICQIVHDNGGQVYMDGANLNAQVAVSQPAEIGADVSHMNLHKTFCIPHGGGGPGMGPIGIKAHLAPFVANHPIQQIDGPNPENGAVSAAPWGSASILPISWVYIALMGGTGLRAATENAILNANYLSKKLGEHYPVLYTGRNDRVAHECIIDMRPLKESSGITEEDVAKRLMDFGFHAPTMSFPVAGTLMIEPTESESKAELDRFIEAMAQIREEIGQVEDGDIDAENNPLRNAPHTMADLIGGDWDRPYSFEQGAFPVARLHTSKVWPTVNRIDNVYGDRNLFCSCIPVEDYAE

SEQ ID NO: 15284 - protein, 677 aa, Prochlorococcus marinus
MTHINKGNPFPLGSSLTAKGVNFSLIATNAAFVEILLFEKEDSISPKNIFKLDHNHNTGPYWHAEIENLNEGCIYAFRINQKNNGINNNYEKKVLLDPCSRGITGWGIYKRENALNTNDNTNSCLKSVVCDRKLFNFEDYPRPKHSWEETIIYELHIRAFTESTDKDKSCFKKFLKKIPYLKELGITTIELLPVFCFDPTDAPNGLENFWGYSPINWFTPHFEYLSNESAEKNREEFRRLVEECHKADIEVILDVVYNHTSEGDSQGPVISWKGIDENLYYFIGKDKNYQDVSGCGNTIAANRGLVRKLIIESLKCWASELGVDGFRFDLGIALSRGENLSPLDNPPIFEDIECEPELIDIKFISEPWDCGGLYKLGDFPSKTTFTWNGHFRDDLRRFWKGDKDTAWNMSDKIKGTPSMYKEDNIFPKSINFITSHDGFTLKDLVTFNRKHNFANREQNRDGDNHNNSWNHGTEGPTKNLLINDLRKRQQRNLILSLLISKGVPMILMGDEIGRSQGGNNNSWCQNNLLGWMNWDHDQQDLELLEYSKYVIKIRKKLINIFNPSFLPNNQNQKNIPIYHWHGTKLDSPDWSSWSHTVAFSINKGKTNPLVWIGLNAYSKSIDFPLPKCKYNWLKVIDTSAPEIFEPLTINEKSVSIKSRSSLLIISEEVFGAKNNIF

SEQ ID NO: 15285 - protein, 763 aa, Picea abies
MPAGFIIPARHVPPLMARHTKAGYTTSSGLSLAQPNMAEGQFDMSQTADSEIAKIREEEFESKSGSDNVEGASGEDQDGERRPRKKRYHRHTQHQIQEMEMFFKECPHPDDKQRKELSRELGLEPLQVKFWFQNKRTQMKTQHERHENTQLRSENEKLRSENMRYREALNNASCPNCGGPAALGEMSFDEQQLRMENARLREEIDRISGIAAKYVGKPLLSFGPSPLSSIPRSNLDLAVGSYGVQPNIGPDIYGSSSGGEIGNRSLVGPTEGEKPMVVELAVAAMEELVRMAQLGEPLWTSHPEDSTDILNEDEYIRTFPRGIGPRPYGLKAEASRETAVVIMNAINLVETLMDVNQWSSMFPGIVSRPFTVDVFSTGVAGNYNGALQVMHAEFQVPSPLVPTREIYFVRYCKQHSDSIWAVVDVSLDSLRGNSSSVIRCRRRPSGCLIQEMPNSYSKVTWVEHVEADDRAVHHIYRQLVNSGMAFGAKRWIATLQRQCERLASVLASNIPARDLGVIPSPEGRKSILKLAERMVTSFCAGVSASTAHTWTTLSGSGAEDVRVMTRKSIDDPGRPPGIILSAATSLWLPVPPKKVFDFLRDENSRNEWDILSNGGLVQEVDHIANGQDPGNCVSLLRVNTVNSNQSNMLILQESCTDASGSFVIYAPVDIVAMNVVLSGGDPDYVALLPSGFAILPDSPKCMAVTNSGINDLGTGGSLLTVAFQILVDSVPTAKLSLGSVATVNSLISCTVDRIKAAVMRENP

SEQ ID NO: 15286 - protein, 663 aa, Arabidopsis thaliana
MSAYTSLNFLFLLTFFIGSLRVSAQLQDPTYVGHVCTNRISRNSIYFSNLQTLLTSLSSNNAYFSLGSHSLTKGQNSDMVFGLYLCKGDLSPESCRECVIFAAKDTRSRCPGGKEFLIQYDECMLGYSDRNIFMDTVTTTTIITWNTQKVTADQSDRFNDAVLSLMKKSAEEAANSTSKKFAVKKSDFSSSQSLYASVQCIPDLTSEDCVMCLQQSIKELYFNKVGGRFLVPSCNSRYEVYPFYKETIEGTVLPPPVSAPPLPLVSTPSFPPGKGKNSTVIIIAIVVPVAISVLICVAVFSFHASKRAKKTYDTPGANDEEDDITTAGSLQFDFKVIEAATDKFSMCNKLGQGGFGQVYKGTLPNGVQVAVKRLSKTSGQGEKEFKNEVVVVAKLQHRNLVKLLGFCLEREEKILVYEFVSNKSLDYFLFDSRMQSQLDWTTRYKIIGGIARGILYLHQDSRLTIIHRDLKAGNILLDADMNPKVADFGMARIFEIDQTEAHTRRVVGTYGYMSPEYAMYGQFSMKSDVYSFGVLVLEIISGRKNSSLYQMDASFGNLVTYTWRLWSDGSPLDLVDSSFRDSYQRNEIIRCIHIALLCVQEDTENRPTMSAIVQMLTTSSIALAVPQPPGFFFRSNHEQAGPSMDKSSLCSIDAASITILAPR

SEQ ID NO: 15287 - protein, 338 aa, Streptococcus pneumoniae
MEKQTVAVLGPGSWGTALSQVLNDNGHEVRIWGNLPEQINEINTHHTNKHYFKDVVLDENIIAYTDLAETLKDVDAILFVVPTKVTRLVAQQVAQTLDHKVIIMHASKGLEPDSHKRLSTILEEEIPEHLRSDIVVVSGPSHAEETIVRDLTLITAASKDLQTAQYVQKLFSNHYFRLYTNTDVIGVETAGALKNIIAVGAGALHGLGFGDNAKAAIIARGLAEITRLGVALGASPLTYSGLSGVGDLIVTGTSIHSRNWRAGDALGRGESLADIEANMGMVIEGISTTRAAYELAQELGVYMPITQAIYQVIYHGTNIKDAIYDIMNNEFKAENEWS

SEQ ID NO: 15288 - protein, 264 aa, Dianthus caryophyllus
MLNFGATARNGVVSTRRWKSDTCIDLGPSDVRSEAHVLAVDDSLIDRKVIERLLKTTSCKVTVVDSGMRALEFLGLDAEQRTSVVDGLKIDLIITDYCMPGMTGYELLKKIKESSTFKETPVVIMSSENVIARIDRCLEEGAEDFILKPVKLSDVKRLRDYMTNKYDKSNSRVISGTNKRKQMDGSDQSYDSSSSSSSSSSLSLSPISTQSQPLISPSSSTPSSPCGPLDSNSMPSSPSGPSDTPSRRRRMAVDVDDDQTAVMP

SEQ ID NO: 15289 - protein, 146 aa, Rhizobium leguminosarum
MRYLHTMVRVKDLDTSLAFYTTLFGLEEIRRHENEKGRFTLVFLAARDDLDRARSEKAPCLELTYNWDTEDYSGGRNFGHLAYEVDDIYATCQNLMDNGITINRPPRDGNMAFVRSPDGISIEILQKGNPLPATEPWASMGNTGAW

SEQ ID NO: 15290 - protein, 323 aa, Zea mays
  misc_feature (164)..(164): Xaa can be any naturally occurring amino acid
  misc_feature (182)..(182): Xaa can be any naturally occurring amino acid
  misc_feature (189)..(189): Xaa can be any naturally occurring amino acid
MSRYSSTQSIIYVHVRINFVEAGLLIFLPICCLFIYRTNLPQIKVQLVNFFLFVATKERTGYIYYILTFGFLFWYGCLAGNGTALVLFLSPVPTFIRIWKKGSVEQYSPIPYVATLLNCMMWVLYGLPLVHPHSMLVITINGTGMLIQLTYVALFLVYSRGGAXRRKVSLLLAAEVAFVGAXVAALVLXWAHTHERRSMVVGILCVLFGTGMYAAPLSVMKMVIQTKSVEYMPLFLSLASLVNGICWTAYALIRFDLYITIPNGLGVLFALAQLLLYAIYYKNTQKIVEARKRKAGQVAMTEVVVDGSRASNNNNNNGGSGTY

SEQ ID NO: 15291 - protein, 850 aa, Oryza sativa
  misc_feature (173)..(173): Xaa can be any naturally occurring amino acid
MEMEMEDNKAPSPPSPMESDVAGEKRKREDDASSSAVLAAANNTGGAQHPMWKTSLCSFFRRRAASSADGCSHGDSCRYAHSEEELRPRPDGTWDPTSDRAKKLRKVAADEVEEEVVTIDDKALDKCLVGLPRGWANDRLKTFLQDKGISYATAKKKKGMTVGFVTFENIEQXKNAIEVLTENQSGGKEIKIADANRRSHQKLHTEKPVSDNGVTTENGTSVDVPPGETSAPEAAISNKKSVRDAVTPLAHMSYNDQLEHKKNSVAQILKRLTRNARKACPTGIPLPDWVFKSKEIGGLPCKLEGILESPVINGYRNKCEFSVGFSLEGKKTVGFMLGNFREGVTAVEEPVDCPNVSEISCKYALMFQDFLQSSSLPVWNRVDNCGFWRQFTVREGRCQAQAVAQNAENQISEVMLIVQVCSTGVDDAVMKDEFDKLTVALQQGAATCSPPLPLTTIVVQDHKGISNAAPADCPLIPLLVPKVDQSEGTVDKTRIHDHIGNLWFSISPTAFFQVNTLAAERLYTLAGDWANLNSGTLLFDVCCGTGTIGLTLAHRVGMVVGIEMNESAVSDAERNALINGVSNCRFVCGKAEDVMGSLLTEYLGSPQQDIPVSEGAVSGTVKDEEVIDSSKNSGENLDSSMQKNDNGESQQLGDAPADSSSSAIDEIKGNSNDRVGNGLEGSHDEYNEVAGEDIHGEASLINESVDLKVSDCLEDRKTSDDGSSISNNDVTAATACQFEDIVAIVDPPRVGLHPTVIKALRTHPRIRRLVYISCNPDSLVANAIELCTPSSEKQEKNKGNRGWRTMSSAGLARQRTKSMPNSEPFVPKRAMAVDLFPHTSHCEMVMLFER

SEQ ID NO: 15292 - protein, 495 aa, Magnaporthe grisea
MPLAAETKRIVDQFEYTDDDVNKGVKEFLRQMDEGLAKDGTSLSQIPTYVAAVPSGKEQGLYLAVDLGGTNFRVCSVHLNGDNTYDLNFNKVAIPKELMVAKTSEELFAFLAKQIEVFLKDHHEDHFESLKRRREATSATNGYREEDVFRLGFTFSFPVDQVGINKGNLIRWTKGFDIDDTVGKDVCALLQAELDKLKLPVKVAALVNDTVGTLMARAYTSPSKKGTILGAIFGTGTNGAYMEKYDSIKKGLKGADYVDTTGEMIINAEWGSFDNQLNVLPSTPWDDALDRESNNPGVQMFEKRVSGMFLGEILRQAVVDAVKNDKVQLFKQVQVNSSSSRLFTSYGVDSAIMSDAAEDNTPELATLRKKLSSEVGLNDVSVEDAQAFKAISAAVGRRAARLSAVAVAAVVLKTGKLTHPDWKGEQIDIGVDGSLFQFYPQFPDMIYEALRVIDGIGEKGAEQITIGLTQDGSGVGAALIALIAAEMEKSASGSK

SEQ ID NO: 15293 - protein, 95 aa, Dunaliella salina
SYMVTLKTPSGEQKVEVSPDSYILDAAEEAGVDLPYSCRAGSCSSCAGKVESGTVDQSDQSFLDDDQMDSGFVLTCVAYATSDCTIVTHQEENLY

SEQ ID NO: 15294 - protein, 95 aa, Equisetum arvense
AYKTVLKTPSGEFTLDVPEGTTILDAAEEAGYDLPFSCRAGACSSCLGKVVSGSVDESEGSFLDDGQMEEGFVLTCIAIPESDLVIETHKEEELF

SEQ ID NO: 15295 - protein, 424 aa, Bdellovibrio bacteriovorus
MEHKIEPLYDGPLFRNAIQTLDEAAKIINCDPNILERLKRPRRCITVSVPVRMDDHSVKVFTGYRVQYSPTLGPYKGGIRYHQNVDLSEVVGLAALMTFKNSVLGLPLGGAKGGITVDPTKLSRTEKQNLTRRYASEIGPFVGPTKDIPAPDVGTDPQTMAWFMDTYSQEQGGFAQPGVVTGKPVEIGGSLGRNHATGLGVVYVAEKAFEVCNMSMKGASIAIQGFGNVGSFAAKFAHERGARIVAVSDVSGGIFNGDGLDINEVNEYIKAHKFLKGYPKAQPISNEELLEVKCDALFPCALENQIDTHNAEKIQAKIIVEGANGPITNAATKILHKRGVFIAPDVIANGGGVIVSYFEWVQDTMSYFWDEDEVNGRLKGIITKAFDKGYSLAKEKNIDMRSAAMAVSVQRLERAMLLRGLYPR

SEQ ID NO: 15296 - protein, 95 aa, Equisetum telmateia
AYKTVLKTPSGEFTLDVPEGTTILDAAEEAGYDLPFSCRAGACSSCLGKVVSGSVDQSEGSFLDDGQMEEGFVLTCIAIPESDLVIETHKEEELF

SEQ ID NO: 15297 - protein, 272 aa, Unknown
  Candidatus Protochlamydia amoebophila UWE25
MAQNKNQTLPISIKDLLEAGAHFGHQTSRWNPKMKRFIFEERNGLYIIDLAKTLQQIRNAVDIVRDVVAKHKSILFVGTKKQAKAVLRELSEQCGEFYVCERWLGGMLTNLSTIRQSVKKLERIEKRISTGGEGLTKKEISLLTKDQIKLEKNLSGVRSMRKPPGLVIVVDPSKEHLAVAEANKLGIPVMGLVDTNCDPDPIEHVIACNDDALKSIKLILETLAKAIIDKKNDIKVYASKEEQTEEAEEETLSSKYREQDFQEAKSGARGEK

SEQ ID NO: 15298 - protein, 161 aa, Unknown
  uncultured bacterium
ACWSCKSTDVPRVMNEIGAANFYKKKWTDLGSEIINPIGCQDCHDPKTMNLRITRPALIEAYQRQGKGITQFSRQEMRSLVCAQCHVEYYFKGDEKYLTFPWDKGFSADDMEAYYDNIEFTDWTHALSKAPMLKAQHPDYELFMTGIHAIRGVSCADCHMP

SEQ ID NO: 15299 - protein, 138 aa, Glycine max
MFTSLHTPILHPRYCHHPTPSCTQFSPLALPPFHRTLSFLAPPPLLPAAPALSAASAAKPDKSGEQKWVHEGLIMESLPNGMFRVRLDNEDLILGYISGKIRKNYVRILPGDRVKVEVTRYDSSKGRIVYRLRSSTPS

SEQ ID NO: 15300 - protein, 116 aa, Zea mays
  misc_feature (41)..(41): Xaa can be any naturally occurring amino acid
RRPGGRCIRYLASTLAPTLTALATAAVALRIRPARCYRQIXNKPYPKSRYCRGVPDPNIRIYDVGMKRKGVDEFAYCAHLVSCEKENVSREALEAARIACNHYMTRSVVNDVFHLT

SEQ ID NO: 15301 - protein, 136 aa, Conocephalum conicum
MARTKQTARKSTGGKAPRKQLATKAARKSAPATGGVKKPHRYRPGTVALREIRRYQKSTELLIRKLPFQRLVREIAQDFKTDLRFQSSAVLALQEASEAYLVGLFEDTNLCAIHAKRVTIMPKDIQLARRIRGERN

SEQ ID NO: 15302 - protein, 708 aa, Myxococcus xanthus
MSREVWPGKPWPRGATFDGSGVNFAIYSQVATRVEVCLFDPADPAREIERFGLPESTDFVHHGYVPGLEPGTLYGLRVHGPYEPTKGHRCNPHKLLVDPYAKALYGDVDWRQPVFGYPLGHEQQDLARDERDSAAGVPKSVVVSDYFDWGNDRRPDINWRETVLYEAHVRGLTMRHPGVPEHLRGTYAGLACPPVIEHLLKLGVTSVELLPVHAFADDSFLDDKKLSNFWGYNTLGYFAPEQYYASRKTPGAAVAEFKAMVRDLHAAGIEVILDVVYNHTCEGNHLGPTLSLKGIDNASYYWLMPDGRHYLDFTGCGNSINASNPQAARLIIDSLRYWVTEMHVDGFRFDLATVLGRTGEGAFDRDAALFQILHQDPVLGRVKLIAEPWDVGLGGYQVGGFPPPWREWNGKYRDALRRYWKGDENLASEMGYRITGNADLYAEARRRPQASINFVTAHDGFTLHDLVTYSHKHNEANGEHNRDGADDNQSWNCGVEGETDKADVIALRERQKRNLLASLFLSTGIPMIVAGDEMGRTQGGNNNAYCQDNELSWVDWNLDERRRKLLAFTRKLIHFRHRQPVLQRRRFFKGQHLWDSEHKDLTWFRPDGPEMKAEDWEKPFVRSLAFLLGGDAIPTPDERGQRIIGDALLILLNSHHEPVTYKLPPAAQSQRWELELCTTDDNRGPEPVKGETFELIGRSLAVFRQVAD

SEQ ID NO: 15303 - protein, 161 aa, Unknown
  uncultured bacterium
ACWTCKSTDVPRVMDEIGASDFYKKKWKDLGAEIVNLIGCQDCHDPKTMNLRITRPALIEAFQRQGKDITSFSRQEMRSLVCAQCHVEYYFKGDGKYLTFPWDKGFNADSMEAYYDAMEFTDWTHALSKAPMSKAQHPDYELFMTGIHAIRGVSCSDCHMP

SEQ ID NO: 15304 - protein, 489 aa, Ostreococcus tauri
MPFVHAAERTCGDPGKPKPAPVDVRMVDLGTESDHEWEQIGLEDLGVAPASDRRVDWSAGIRADWDISEGGAVETWSQFTAVGLDRFEAEHGRADPEAGVTVSRLSPYLRFGMISPRTVYHDLVKKDGKNISKTFWHRLYRRELAYWQLHHWPDLPKTSVRSHYENRAWLSGDEADEALRRWQRGETGFPVVDCGMRRLWRTGWMHQTERMITATFLVDYLGVHWTRGADWFMRTLVDADEAINSMMWQNAGKSGLDQWDFFEGTLAPDGSARAHDPHGDAIARWIPELAALPRGYLRHRPWEASKATLAECDVELGSTYPRRMIVDLDRARQRMLDDVTTIRHAELVRAGGLVKPGSMEDLVVAPRAAVVRGAADLARVSTRKEFKRSLKALKASIAGIDLPSNPSSKPHGKSRANASRPKVSAASRPKSGPRSGRLPAPDRDAVRASRREAKRLDAAFRGRVFHHLPVDDLDDRDAAPPRVGRRPAR

SEQ ID NO: 15305 - protein, 149 aa, Kineococcus radiotolerans
MSPDLPFVRPQNLVGRKPAGPDGGTRSFFDEVGGHETFVRLVDAFYEGVAADEVLRPMYPEADLGPARQRMLMFLEQYWGGPATYSEQRGHPRLRMRHASFKVNPDARDRWLTHMRAAVVSLGLAPAQEGVLWDYLDRAAHSMLNTFED

SEQ ID NO: 15306 - protein, 162 aa, Unknown
  uncultured bacterium
ACWTCKSTDVPRVMNERGVAEFYKDKWDHLGDQVVNPIGCQDCHDNKTMNLRITRPALVEAFQRRGKDIKQATHQEMRSLVCAQCHVEYYFKGKEEKYLTFPWDKGFRAEDMEAYYDSVQHVDFVNTLSRAPILKAQHPDYEIYKTGVHAERGVSCADCHMP

SEQ ID NO: 15307 - protein, 179 aa, Haemophilus somnus
MKKHHVDVLITEEDVRSRIQELGREITQFYQHKHVNKLVVVGLLRGSFMFMADLVREIKLPIEIEFMTTSSYGNEMTTNHDVRIAKDLDGDIKNEDVLIVEDIIDTGYTLEKVREILLLRSPNSLAICTLLDKPSRREVDVPVEWVGFTIPDEFVVGYGIDYAQCYRNLGYIGKVTLEE

SEQ ID NO: 15308 - protein, 571 aa, Ashbya gossypii
MCGIFACYRKDDIESFKPTALRLSKRVRHRGPDWSGNVIKNDTILVHERLAIVGLDSGAQPINSPDGNYVLCVNGEIYNHIHLREECSDYEFTSLSDCEPIIPLYLKYDVETPQHLDGMFAWCLYDVQRDRIVAARDPIGVTTLYMGKSSSSPRTRYFASELKCLVDECDEITAFPPGHVYDSDTDKLTRYFKPDWIDETRIPSQPVDYKAVRTTLEKAVRKRLMAEVPYGVLLSGGLDSSLIASIAARETERANREAGDVYADGKHLAGMDDRGLLHTGGWSRLHSFAIGLPNAPDLQAARKVAKFIGSIHHEHTFTLQEGLDALDDVIHHLETYDVTTIRASTPMFLLSRKIKAQGVKMVLSGEGSDEIFGGYLYFAQAPSPAEFHTETVKRVNNLHLADCLRANKSTMAWGLEARVPFLDREFLQLCMNIDPAEKMIAPQKGRIEKYILRKAFDTSDEPGVDPYLPEEILWRQKEQFSDGVGYSWIDGLKDAAERAISDEQFANPNPAWGDDIPTTKEAFWYRLKFDALFPQPTAAATVMRWVPKADWGCAEDPSGRYAKIHDQHISS

SEQ ID NO: 15309 - protein, 162 aa, Unknown
  uncultured bacterium
ACWTCKSSDNPSLWNELGMEGYDAMFFDDMTPRLNNPIGCANCHEEGTMRLIVTNPSLENALKAQGKDWTAYSRQEMRSLVCANCHVEYYFEGPEKLLVFPWGKGTRLDQIVEYYEEEGFKDWTYPGTGTPMLKAQHPDYETFTAGSTHYNAGVACADCHMP

SEQ ID NO: 15310 - protein, 519 aa, Ipomoea quamoclit
MATLTLILCTLLFAIFLYFLILRVKQRYPLPLPPGPKPWPVLGNLPHLGEKPHQSIAAMAQKYGPLMHLRLGFVDVVVAASAAVAAQFLKVHDANFSSRPPNSGAEHIAYNYQDLVFAPYGPRWRMLRKITSVHLFSAKALDDFSHVRQEEVATLTRSLASAGKTPVKLGQLLNVCTTNALARVMLGRKVFNDGSSKSDPKAEEFKSMVEEMMVLAGSFNLGDFIPVLGWFDLQGIVGKMKKLHARFDAFLNAILEEHKFVNNQHTTSSKDVDFLSTLLRLRDSGADMDGEEGKLTDTEIKALLLNLFTAGTDTSSSTVEWAFAELLRNPKILSQAQQELDLVVGTNRLVTESDLTQLPFLQAIVKETFRLHPSTPLSLPRIGAESCEINGYFIPKGATLLVNVWAIARDPNAWTNPLQFNPNRFLPGGEKTNVDIKGNDFEVIPFGAGRRICSGMSLGIRMVHLLIATLVHAFDWDLVNGQSVETLNMEESYGLTLQRAVPLMLHPKPRLQPHLYTLN

SEQ ID NO: 15311 - protein, 162 aa, Unknown
  uncultured bacterium
ACWSCKSTDVPRMMNKIGAGDFYKTPWKDMGQEIINPIGCQDCRDPITMNLRITRPALVEAFQRQNKDITQSTHQEMRTLVCAQCLVEYYFKGKDEKYLTFPWDKGFSVDDAEKYYDEYEFTDWVHSISKTPMLKAQHPDYELFRMGIHFERGVSCADCHMP

SEQ ID NO: 15312 - protein, 356 aa, Unknown
  Silicibacter sp. TM1040
MARFHPLEVTDIKKTIRDAVVVTLKPLNGAAAEFDFTQGQYLTFRRDFDGTELRRSYSICAGKDEGILQVGIKRVDGGAFSTWANTVLKVGDTVEAMPPQGRFFTDLDAAAEKHYLGFAGGSGITPVLSILKTTLQAEPQSRFTLVYANKGINSIMFREEIEDLKNRYMGRLSVIHVLETDAQEVDLFTGLVTQEKCAELFERWIPIQSVDTAFICGPEPMMLGIAEALRTAGLSDEQIKFELFASNQPGRAAKKATSGDAAASAPVTAAITLDGATRSVTLDRNTSVLEAALENAMDAPWSCRAGVCSTCRCRVIEGEVEMAANHALEDDEVAKGFVLSCQAYPLSDALVVSYDE

SEQ ID NO: 15313 - protein, 195 aa, Brassica napus
MDAVTDLKRPREEDDNAAAAKPACFSSVIPGWFSEMSPMWPGEAHSLKVEKVLFQGKSDYQDVIVFQSATYGKVLVLDGVIQLTERDECAYQEMITHLPLCSIPNPKKVLVIGGGDGGVLREVARHPSVEHIDMCEIDKMVVDVSKQFFPNVAIGFEDPRVNLVIGDGVAFLKNAAQGSYDAVIVDSSDPIGPAK

SEQ ID NO: 15314 - protein, 467 aa, Bacteroides fragilis
MEKISRTKIVDLMKREDFGAMVNVKGWVRTRRGSKQVNFIALNDGSTINNVQVVVDLANFDEEMLKQITTGACLSVNGVLTESVGAGQKAEVQAREIEVLGTCDNTYPLQKKGHSMEFLREIAHLRPRTNTFGAVFRIRHNMAIAIHKFFHEKGFFYFHTPIITASDCEGAGQMFQVTTMNLYDLKKDANGSIVYDDDFFGKQASLTVSGQLEGELAATALGAIYTFGPTFRAENSNTPRHLAEFWMIEPEVAFNEIQENMDLAEEFIKYCVRWALDNCADDVKFLNDMFDKGLIERLEGVLKEDFVRLPYTEGIKILEEAVAKGHKFEFPVYWGVDLASEHERYLVEDHFKRPVILTDYPKEIKAFYMKQNEDGKTVRAMDVLFPKIGEIIGGSERESDYNKLMTRIEEMHIPMKDMWWYLDTRKFGTCPHSGFGLGFERLLLFVTGMSNIRDVIPFPRTPRNADF

SEQ ID NO: 15315 - protein, 567 aa, Ehrlichia canis
MENFQIKTNLGSEDYLQNIKKIKSNKFISHNLEAEDSEDDNSSEFQNALKEFIDDSVKEGQIIEGTIVCIDKGYVTIDSGLKSESIVSLKEFELGDDYQNIGIGSKVKLYLEKIEGRNGSVVLSREKAIRDELWQKLEEAAERKEDVEGVIFSSIKCGYTVDIKGVVAFLPASHVALRQVKDITPLLGKKQKFRILKMDNKQGNIVVSRKAILEESLADAKSLYLSQLNEGDIIEGKVKSITKYGVFIEIHESPSVGVVDGLLHITDISWSRVSHPSAVFSCGQTVKTKIIKIDRENKKISLGVKQLEESPWSNIEKKYPVDSIHKGIVTSIEDYGVFVELETGIEGLVHVSEVSWTKNSLPINQLFMRGEEIQVKVLSIDTAKSRMSLSMKRCQENPWQAFTLKYPLGSVVSTKIKNITNLGIFVSFEDNTLNDGIEGLIRTTELSWSLSPEAAVKKYSIGDSVEAKILMINPNKSKIDLGVKQLEYDPFLDLLKKTNLGDKIPVTVTKVVEDTGILVDVFNGSNSFNLLIEQEYLPDNKKFFPGDKLEAEVLLIETYNMVLSLKH

SEQ ID NO: 15316 - protein, 100 aa, Zea mays
MAVLSAADASPVSAIGFEGYEKRLEITFSEAPVFVDPHGRGLRALSRAQIDSVLDLARCTIVSELSNKDFDSYVLSESSLFIYPLKNVIKTCGTTKLLLT

SEQ ID NO: 15317 - protein, 167 aa, Arabidopsis thaliana
MEKVVDLFGVGEANSQKLLEGGKDLSEIQQGLFIGSVAEANNKDFLKSSNITHVLTVAVALAPPYPDDFVYKVIEVVDRSETDLTVYFDECYSFIDQAIQSGGGVLVHCFMGMSRSVTIVVAYLMKKHGMGFSKAMELVRSRRHQAYPNPGFISQLQQFEKSIQGNA

SEQ ID NO: 15318 - protein, 149 aa, Pisum sativum
MATTPALYGTAVSTSFLRTQPMPMSVTTTKAFSNGFLGLKTSLKRGDLAVAMASYKVKLVTPDGTQEFECPSDVYILDHAEEVGIDLPYSCRAGSCSSCAGKVVGGEVDQSDGSFLDDEQIEAGFVLTCVAYPTSDVVIETHKEEDLTA

SEQ ID NO: 15319 - protein, 623 aa, Oryza sativa
MDADSPRRPTTVPSNTPQVSGLIPWYQGLIPRYHPVSWVPSIRYRSIPNWYQSAAPPRRRRRRMEAVGVAPAPAGVPEKKLLEVKESRKAAPAAPSTSMAAKWAMKKKLVGGDAGYVLEDVPHLTDYLPELPTYPNPLQDNPAYSVVKIPLFHSPTTLGTKRLTFLHTTCAPSSSCRQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPVKDSSKCNGTAAPV

SEQ ID NO: 15320 - protein, 828 aa, Shigella flexneri
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNSRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 15321 - protein, 96 aa, Phytolacca americana
ATYKVTLVTPSGTQTIDCPDDTYVLDAAEEAGLDLPYSCRAGSCSSCTGKVTAGTVDQEDQSFLDDDQIEAGFVLTCVAFPKGDVTIETHKEEDIV

SEQ ID NO: 15322 - protein, 146 aa, Arabidopsis thaliana
KTGGGRPFPAPPRGRNQQPTCPKPGPGDREKTCALLLRVITKSGGHHTSEDYAVRGKEPKEEAHIYTWEDARLCELTDLGKERFVAARRRKDRESFAFVYSNNKGCYNVREVGETMAYTNRKRPDDERTLFELSFVIGDYLDVAIY

SEQ ID NO: 15323 - protein, 291 aa, Thermobifida fusca
MPTVTLLVNPASGRRRAAVVASALRERLRARGAQVRLLMGESAGDSARLVDQLVAQRPDVLVTVGGDGLVHLALQAVVGTDIPLGVVGAGTGNDIARELGLPRAPDAAAQAILAGHTRQVDTVHVAGRHYLSVLACGFDSRVNERVNRFRRSLGRLDYVAGVLAELGAFTPLDYTVDVDGQRVQTTGMLVAVANTRCYGGGMLICPQARPDDGLLDVIVVREVGRLRFLRLFPRVFTGSHLELPEVTVLRGRHVSLSVAGDVVAHADGERLAAPPLVCEVRPGSVRMVTDH

SEQ ID NO: 15324 - protein, 96 aa, Phytolacca acinosa
ATYKVTLVTPSGTQTIDCPDDTYVLDAAEEAGLDLPYSCRAGSCSSCAGKVTAGTVDQEDQSFLDDDQIEAGFVLTCVAYPKGDVTIETHKEEDIA

SEQ ID NO: 15325 - protein, 286 aa, Unknown
  Azoarcus sp. EbN1
MSLPDIPSPRPGPLAGHVYLVGAGPGDPELLTLRGARLIAGADAVVFDNLVSPVIVDLAPPAAERHYVGKKASDHTLPQGEINRLLVRLAQAGKRVVRLKGGDPFIFGRGGEEMEVLVGAGITVEVVPGVTAAAGIAAYAGIPLTHRDHARSVIFTTGFLKNGALDLDWPMLARPGQTLVVYMGISRLAEICRELIAHGLPATTPAGVVERGTTRAQRVAVGTLATLADVVRDADIRPPALTIVGDVVGLYPRLAWFSPEQVDPVRHAPHVGCTGVHPEPDCDSAT

SEQ ID NO: 15326 - protein, 356 aa, Beta vulgaris
MALLNDLINLNLSETSDKIIAEYIWIGGSGLDMRSKARTLTGPISDPAKLPKWNYDGSSTNQAPGEDSEVILYPQAIFKDPFRRGDNILVMCDAYTPAGEPIPTNKRYNAEKIFSHPDVVAEEPWYGIEQEYTLLQKDINWPLGWPTGGFPGPQGPYYCGVGADKSFGRDIVDAHYKACIYAGVNISGINGEVMPGQWEFQVGPTVGISSGDQVWVARYILERIAEIAGVVVSFDPKPVKGDWNGAGAHTNYSTKSMREDGGINVIKAAIEKLSLRHKEHIAAYGEGNERRLTGRHETADITTFSWGVANRGASVRVGRDTEKDGKGYFEDRRPASNMDPYVVTSMIAETTILGKP

SEQ ID NO: 15327 - protein, 834 aa, Agrobacterium tumefaciens
MSSELTRRNLLKAHAAGIAAATAGIALPAAAQPVPGGVSALQIKWSKAPCRFCGTGCGVMVGVKEGKVVATHGDMQAEVNRGLNCIKGYFLSKIMYGKDRLETPLLRKKNGVYAKDGEFEPVSWDEAFDVMAQQCKRVLKEKGPTAVGMFGSGQWTIFEGYAATKLMRAGFRSNNLDPNARHCMASAAYAFMRTFGMDEPMGCYDDFEHADAFVLWGSNMAEMHPILWTRIADRRLGFDHVRVAVLSTFTHRSMDLADIPMVFKPGTDLVILNYIANHIIKTGRVNEDFVRNHTKFVRGVTDIGYGLRPDDPVEVNAANSADPTKTEAIDFETFKEFVSEYTLEKTAAMTGVEAGFLEELAELYADPKRKVMSLWTMGFNQHVRGVWANQMVYNIHLLTGKISEPGNSPFSLTGQPSACGTAREVGTFAHRLPADMTVTNPEHRKHAEEIWRIPHGIIPEKPGYHAVQQDRMLHDGKLNFYWVQVNNNVQAGPNTKNETYLGYRNPENFIVVSDAYPTITAMSADLILPAAMWVEKEGAYGNAERRTHVWHQLVEASGEARSDLWQLVEFSKRFTTDEVWPAEILDANPAYRGKTLYEVLYKDSDVGKFPLSEINADYKNQESSDFGFYLQKGLFEEYAAFGRGHGHDLAPYDAYHEVRGMRWPVVDGKETLWRYREGYDPYVKPGEGVKFYGNKDGRAVIIAVPYEPPAESPDQEFDTWLVTGRVLEHWHSGSMTMRVPELYKAFPGARCFMNADDARKRGLNQGAEIRIVSRRGEIRSRVETRGRNRMPPGVIFVPWFDASQLINKVTLDATDPISKQTDFKKCAVKIEPVA

SEQ ID NO: 15328 - protein, 123 aa, Glycine max
DRERPRVRKCNEMPKDAPTLTAAGANPAEDEASLKDLSVQTENKASSASPAPDDPKASDEKTLAEENQKLKELLQKLLASGNDQMGVITDLSEKVKVLERRLARKKRPKVRVHKPSRHASCVH

SEQ ID NO: 15329 - protein, 269 aa, Streptococcus mutans
MNHMKRNFEHVKRIVIKIGTSSLVLPSGKIDLNKIDQLAFVISNLMNRELDVILVSSGAMGFGLDILKMDKRPAEVARQQAVSSVGQVAMMSLYSQIFSHYQTNVSQILLTRDVVEFPESLENVTNTFETLLSMRIVPIVNENDAISVDEMDHTTKFGDNDRLSALVANITNSDLLIMLSDIDGLFDKNPTIYDNAVLRENVTEITEEILKSAGGAGSKFGTGGMMSKIKSAQIIFDCDRQMILMNGANPRDILRALDGKMIGTLFAKE

SEQ ID NO: 15330 - protein, 416 aa, Streptococcus mutans [sequence omitted]

SEQ ID NO: 15331 - protein, 77 aa, Nephroselmis olivacea
MNKQGLFQMEGLVIESLPNAMFRVRLQNGFVILAHISGKIRRNYIRIIVGDRVLCELTPYDLTKGRIVYRQRSTPRP

SEQ ID NO: 15332 - protein, 147 aa, Spinacia oleracea
MAATTTTMMGMATTFVPKPQAPPMMAALPSNTGRSLFGLKTGSRGGRMTMAAYKVTLVTPTGNVEFQCPDDVYILDAAEEEGIDLPYSCRAGSCSSCAGKLKTGSLNQDDQSFLDDDQIDEGWVLTCAAYPVSDVTIETHKEEELTA

SEQ ID NO: 15333 - protein, 65 aa, Daucus carota
DNIQGITKPAIRRLARRGGVKRISGLIYEETRGVLKIFLENVIRDAVTYTEHARRKTVTAMDVVY

SEQ ID NO: 15334 - protein, 133 aa, Myxococcus xanthus
MPSPDDLPYHRLGGTDAAMALAEAFYDAMDAHEPELARLHELDAEGRVNRGTRERFGLFLAGWLGGPQDYTERHGHPRLRMRHGHLSIGVAMRDAWVRSMQRAMDARGISGGLRRFLDARFAHVADFLRNVEE

SEQ ID NO: 15335 - protein, 306 aa, Listonella anguillarum
MQYFPLFLNLLGKPVLVVGGGEVACRKVEALIRAGAQVTVVSPKIERYLLELVEQNRCQWVQNFYSSELLTKEYWQVWATTDNPSLNHQVHKDARKTGVLVNVVDDQPYCDFITPSMVNRGRIQIAISSGGASPVLVRNIRETLEAVLPQNLSLLADFAASKRNSIKQSLNSVSARRKFWEAFLSDSKTENVVSREELERLYQQALLVPIEESAQCTWISCGDDVEMLPIKALRYMQRAEVVFYEQHSPFELIDLVRRDAERESFKNAAQLAEKLEQAKSDRKRICILLPRNRAEYALLVGKDLML

SEQ ID NO: 15336 - protein, 175 aa, Unknown
  uncultured bacterium
ACWTCKTPFAPKLQKELGKAYFADPYLAVHAKIPKEFQQLGAACGDCHNNKTQDLELSRWTLQQALAHTGKDYQQVSRQEARSLVCAQFHVTYIVPKDAEMKSTTVFFPWQGSKQEAISIENIIKVIRSDPAHLEWKQAVTGFKVGFIRHPEYEFFTYNSVHRKANVACADCHMP

SEQ ID NO: 15337 - protein, 246 aa, Oryza sativa
MDNQQLPYAGQPAAAGAGAPVPGVPGAGGPPAVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAGGPAGAVGAAGPAAGLPYYYPPMGQPAPMMPAWHVPAWDPAWQQGAAPDVDQGAAGSFSEEGQQGFAGHGGAAASFPPAPPSSE

SEQ ID NO: 15338 - protein, 563 aa, Silicibacter pomeroyi
MRAIVIGAGMGGLMTALALRQSGVFSAIEVYEQTRQPSTAGAGLNIPPNGARICRWLGVDLDGGDPKGPDGAIDGGRAAILKSTRQFNTDGSVTERPFDHVTAVGDGAGFHHMHRLDLLMCLYKRVFEFGPDSGTPCPISVHMDSRLTGLEQSQGGVTAAFANGHTATGDILVGADGINSATLSLAWPSPRPRRWTEVTCFRGLIPRETVAALRKPDGSPLDYNPIHSFSMDRHKTDRSGATTYWVRGGELLNVWIARYEPDSTAFEQEEGDWFPISREEITRDVGAAFAELPNRDDLVALAGAMVRPTKWGLYDRDALDSWVQGRICLLGDAAHPMLPTFGQGAAQAFEDAAALGCAFALHRRDVATALLHYERVRHYRASRFQLGSKFAFDHLRPKDTEAQKALLEGLDERVTPAFSHDKRGGENDAWIYAFDARNIGPTLPAKKWGPWDYREASKEDHAKATQSLWRPEVPADGARRVTRAEVARHNTRDDCWIIVSGKVYDITAWAPHHPGGAGIARIYAGKEATAEFGDYHSAQAVAHMAHFCIGELVETSDDIQPPA

SEQ ID NO: 15339 - protein, 472 aa, Oryza sativa
MVVTDECLEMIAASFRNFQVLRLVSCDGFSTAGLAAIAAGCRVGRHLRELDLQENEIEDCSIHWLSLFPESFTSLVTLNFSCLEGEVNITVLERLVTRCHNLKTLKLNNAIPLDKLASLLHKAPQLVELGTGKFSADYHSDLFAKLEAAFGGCKSLRRLSGAWDAVPDYLPAFYCVCEGLTSLNLSYATVRGPELIKFISRCRNLQQLWVMDLIEDHGLAVVASSCNKLQELRVFPSDPFGAGFLTERGLVDVSASCPMLESVLYFCRRMTNEALITIAKNRPNFTCFRLCILEPHTPDYITREPLDAGFSAIVESCRGLRRLSISGLLTDLVFKSIGAHADRLEMLSIAFAGNSDLGLHYILSGCKSLKKLEIRDCPFGDKPLLANAAKLETMRSLWMSSCLLTLGACRQLARKMPRLSVEIMNDPGRSCPLDSLPDETPVEKLYVYRTIAGPRCRMKIHSLFQDMEMHGL

SEQ ID NO: 15340 - protein, 381 aa, Arabidopsis thaliana
MSDDEEPPLKKNKLPVEEPTLIPSLPDPRVRSILARVSRLSYRSLSLVCKRFHSLLTSGEIYRFRSLSGYTENCLYVCLRFSHTGRSHRWFMLREKNKSSGYVLAPIPISHSPSLHASSIVAVGSKIYKIGGVMDGSSVSILDCWSHRWLEAPSMQMERDRPSANLIDGKIYVTGGCHRGSYNPSKWMEVFDLKTETWEPVLCRSDRLTFESYHERTNNLLVDGKLYIFWADKGVVYNPKDDTWDSLEVPEMDMCLTLFYCCVIENVLYDFFYEELDIKWYDTKARTWRSLLNGMRELHKFVRHASVTLADYGGKMVMFWDKFVASGDGLGFHKTMMWCAMIALERSDSGEIWGKVEWFGPVLPNQIPLEYAFEYVGSVKV

SEQ ID NO: 15341 - protein, 165 aa, Unknown
  uncultured bacterium
ACWSCKSPDVPRVMNQEGVAGFYRGTWDTKGPEVINPIGCADCHDSKTMNLRISRPALVEAFSNMGKDITKASHQEMRSLVCAQCHVEYYFNKQMEEGVQYLVFPWKNGTSVEEIEKYYDEIGFYDWTHALSRTPMLKAQHPDYEVYLTGVHASRGVSCADCHMP

SEQ ID NO: 15342 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 15343 - protein, 185 aa, Unknown
  uncultured marine gamma proteobacterium EBAC20E09
MIHYTKNISLESNVPNNLKEIILGAGCFWGVEKKFWDLDGVYLTSVGYSGGHTDNPTYEDVCYKNTNHAEVVKVIYDPNIIELKKILKVFWECHDPTQGMRQGNDVGSQYRSVIYSSDTSDLDIANESKEIYQKELEKNNYSTITTEIDIVKNYFLAEEYHQQYLAKNPNGYCGIGGTGCTFPNE

SEQ ID NO: 15344 - protein, 864 aa, Penicillium griseoroseum
MASITTQTITESETISFKNAQITVEDIIPSPGEPDIPLPPPSKNPVDILDVDKGTPDNHVPRDPRLIRLTGVHPFNVEPPLTALYKEGFLTSPELFYVRNHGPVPQVRDEDIPDWEISIEGLVEKPLVLNFREVLQKYNQITAPITLVCAGNRRKEQNTVRKSKGFSWGPAGLSTALFTGPMMADILRSAKPLRRAKYVCMEGADKLPNGFYGTSVKLNWAMDPNRGIMLAHKMNGEDLRPDHGRPLRAVVPGQIGGRSVKWLKKLILTDAPSDNWYHINDNRVLPTMVSPEMSALDRKWWTDERYAIYELNVNAAAVYPQHEEEIDLSTAGPTYTVKGYAYAGGGRRITKVEISLDRGKSWRLSEIEYAEDKSRDFDGDLFGGKVDMWWREASFCWSFWSLDVPVADLETSDAILVRAVDEALSAMPRDMYWSVLGMMNNPWFKVAITKEGNPLEFEHPTHPSKGGRWMERVKKTGGDLLNGNWGERVKGEELVEPEPVKEINMKKDGVNRQIDLQELKANSTSEKPWFVVNGEVYDGTGFLEGHPGGAISITSSAGLDVSEDFLAIHSETAKAMMPDYHIGTLDKASLQALKSDSAGGSSEPREVFLQSRTWTKATLTEKRDVSWDTRLFVFDLEHNKQTLGLPIGQHLMIKVQDPSNNEAVIRSYTPMSDTNLIGKMELLIKVYFPTDSIPGGKMTMALDKLPLGSEIDCKGPTGRFEYLGNGRVSISGKERHLRSFKMICGGTGITPVFQVLRAVMQDAQDPTTCVVLDGNRQEEDILCRSDLDAYVETDSRKCTVVHTLTKGSDTWTGRRGPHFRGTSPEYAPPEEQSMVLVCGPGPMEKSARNILLAQGWARSDLHFF

SEQ ID NO: 15345 - protein, 161 aa, Oryza sativa
  misc_feature (92)..(92): Xaa can be any naturally occurring amino acid
  misc_feature (107)..(107): Xaa can be any naturally occurring amino acid
MAGVSVRRARSVRASLFSPKPATPKDARPAKVQEMFVYEINERDRESPAYLRLSAKQTENALGDLVPFTNKLYSGSLDKRLGISAGICILIXGVFEGAYGQVKLNQXIVFPFKIFYTFYLKGIPDLPRELLCTPVPPSPTVEPTPAAKGTEAHACLNNFNN

SEQ ID NO: 15346 - protein, 759 aa, Saccharomyces cerevisiae
MPAPKLTEKFASSKSTQKTTNYSSIEAKSVKTSADQAYIYQEPSATKKILYSIATWLLYNIFHCFFREIRGRGSFKVPQQGPVIFVAAPHANQFVDPVILMGEVKKSVNRRVSFLIAESSLKQPPIGFLASFFMAIGVVRPQDNLKPAEGTIRVDPTDYKRVIGHDTHFLTDCMPKGLIGLPKSMGFGEIQSIESDTSLTLRKEFKMAKPEIKTALLTGTTYKYAAKVDQSCVYHRVFEHLAHNNCIGIFPEGGSHDRTNLLPLKAGVAIMALGCMDKHPDVNVKIVPCGMNYFHPHKFRSRAVVEFGDPIEIPKELVAKYHNPETNRDAVKELLDTISKGLQSVTVTCSDYETLMVVQTIRRLYMTQFSTKLPLPLIVEMNRRMVKGYEFYRNDPKIADLTKDIMAYNAALRHYNLPDHLVEEAKVNFAKNLGLVFFRSIGLCILFSLAMPGIIMFSPVFILAKRISQEKARTALSKSTVKIKANDVIATWKILIGMGFAPLLYIFWSVLITYYLRHKPWNKIYVFSGSYISCVIVTYSALIVGDIGMDGFKSLRPLVLSLTSPKGLQKLQKDRRNLAERIIEVVNNFGSELFPDFDSAALREEFDVIDEEEEDRKTSELNRRKMLRKQKIKRQEKDSSSPIISQRDNHDAYEHHNQDSDGVSLVNSDNSLSNIPLFSSTFHRKSESSLASTSVAPSSSSEFEVENEILEEKNGLASKIAQAVLNKRIGENTAREEEEEEEEEEEEEEEEEEGKEGDA

SEQ ID NO: 15347 - protein, 468 aa, Leptospira interrogans
MISRMISKRKEDRMKSNARVCVVGAGPSGIAAGKNCVEYGLDVVIFEKNDKVGGNWVFNAKTGHSSVYENTHIISSKVWSEYEDFPMPEDYPEYPNHKQLQAYFESYAKHFGVYKKIRFHHTIQKITKTPNEEWKVEYTNASKKKKVEFFDVLMVANGHHWDPKYPEYEGKFTGKFLHSHDFKGVTNEWKGKDILVIGAGNSACDVAVESARVANSVKLSMRSPQWFFPKFLFGMPSDVFAAKTPNWIPSIIKQFALSKLIYILQGSYKNYGLPENKNLALSHHPTLNSDLLDFIRHGRINPRPAIKKLHGKEVEFIDGTKERFDIICACTGFWTTFPFFDKSFIDFQHVEKIPLFRKMIHNDFQNLYFIGLFQPVGCIWPMADYQAKLACLEILGKYKRPKNLKAAIQYEIDHPHFTFERGQRHAVEVDYHSFRKELRLELLKAGVDIGKPPGGNKSLYKNFPKAAS

SEQ ID NO: 15348 - protein, 259 aa, Methanocaldococcus jannaschii
MDNNRKVIIVGAGPGDPELITIKGKKAIEEADVIIYAGSLVNEKLLEYNKKNAEIYNSANMNLEEIIDVMVKAVNQGKKVVRLHTGDPSIYGAIKEQIDELSKYGIDVEIIPGVSSLFAATASLKVELTLPEVSQTVIITRPEGRTPMPEKEKLRDLAKHQSTMAIFLGVSMIDKVVKELIEGGYREETPVAVVYHASWDDEKIVRGTLKDIAEKVKKEGIKKTALIIVGEVLNPKYYAYSKLYDKNFEHEYRKSHKKF

SEQ ID NO: 15349 - protein, 776 aa, Unknown
  Nocardioides sp. JS614
MSANTEQASTDRTQDVWGERTPHPRATPWPTRVDLHLEDGLAEDQVDSWVASACLLCSNGCGVDIAVKDGKMVGVRGRETDRVNHGRLGPKGLYGSTPWSHSPDRLTTPLVREHGELVETDWDTAMGRIVARSKQLLEEQGPLSHGFYTSGQLFLEEYYTLAVIGKAGLGTPHMDGNTRLCTATAAAALKESFGADGQPGSYEDIEHCDALFLYGHNMAETQTVLWSRILDRTRGEDPPKVVCVDPRRTAVAAEAERTGGVHLAPKVGTNLALMNALIRELLEHDAWVDHAWVDAHTIGLEGLRAAVAPYTPEQAAEICGVDPDEVRRAARIFGESEAVLSTVLQGFYQSHQATAASVAVNNLHLLRGMIGRPGAGLLQMNGQPTAQNNRETGADGDLTGFRNWDNPTHVQELADHWNVDPMTIPHWAPPTHAMQIFSYAQAGTVGLLWISATNPAVSMPETERIRSILSGDQCFVVVQDLFLTETAQLADVVLPAAGWGEKTGCFTNVDRTVHLSQQAVDPPGEARSDLDIFLAYADAMGFEDQDGGPLITWRTPEETFAHWSAATRGRPCDYTGITYELLSGPTGVQWPLGVERLYADAQFPTHTEQCETFGHDLTTGATVTEQEHRAQAPAGRAFLKGAPYSPPHEEPSAEYPFRLTTGRTVYQFHTRTKTARSRPLDACAPHAWVELAPADSQRLGIADGDLVRLESPRGSVDVPARVTEVTEGAVFVPFHYGDHPANELTMTVWDPVSKQPTFKTAACRVTRLGAGTGEEG

SEQ ID NO: 15350 - protein, 356 aa, Unknown
  Synechococcus sp. WH 5701
GLEQRLADAAAAHHQGIPVPVSEALGASGAPAAGAGVAMGWATRGMAHDGSMSLRIGIYGQGAWGRALGQVFGQGGHRISTWSRRAGGEPSQLLPHQDVIVCAIAMAGVPELSQRLSPVWPSGLPLISCTKGLNLQQLLSASQLWQGAIPSLSSLVLSGPNLAGELEGGLPAASVLASLHSDLAQSLQQELSSDQLRLYTNNDPIGTELSGALKNVMAVAAGVCDGLGLGANAKASLLTRGLAEMGRLSQQLGGDPDTLYGLAGLGDLLATANSRLSRNYRFGLHLAEGLSAEEAIRAIGATVEGPSTAVAALALAEQGGVRLPICAQVVALIEGRISPPEAVRALMERDLKTEER

SEQ ID NO: 15351 - protein, 441 aa, Magnaporthe grisea
MAAELRERVAKPHIDHYLSPDTHGLKKPKSSSNEIKSEKRREPRQEHPAGDEKYGRVVAILRRLAFVSYFAICVCTILMTQVIGAPLYWYNRDWYYSWMSMTKAHFGITITTMTKWWGPTIIRISGDDSMDGQIRQKPDGTVEFAFPERLVMIANHQLYTDWLYLWWVAYANSPQMHGWIYIILKESLKYIPVIGTGMMFYGFIFMSRKMAVDKPRLAHRLQKLKTSSADPSASAGRSLNPMWLLLFPEGTNASANGQIKSGKWAEKIGVKNPQHMLLPRSTGMHFILSELKGTVEYLYDCTVAYEGIPRGDFGEQYFTLSSTYFEGRPPKSVNFHWRRFRVADIPLDTPEAFDEWMRERWYEKDDLMDKYLTNGRFPSSKVAIVGAKSSDDAYIETEVRPRWPGEVMQLFSVVGPGLLVEVDVGFRIRWNCGVHNICRKI

SEQ ID NO: 15352 - protein, 341 aa, Xanthomonas campestris
MSDWTHKIAVLGAGSWGTALAALLARHGHPTVLWGRDAAMVDTIDRTHENARYLPGIALPDSLRATTDLQAAVADATWILVVVPSHAFTETIRLIAPLRPAGAGVAWATKGFEPGSGRFLHEVARDILGPSVPLAVVTGPSFAKEVTLGLPTAITVHGDDAAFAQVVADAMHGPTFRAYTGDDMVGAELGGAMKNVLAVATGVADGMQLGLNARAGLITRGLNEMLRLAAVIGARPETLMGLAGLGDLVLTCTGDLSRNRRLGLALGRGQSLDDAIREIGQVVESVQTADEVMRQAEHHGIELPISNAVRAVLHGEITPEAGLKELLARERKPEYPQTLFT

SEQ ID NO: 15353 - protein, 275 aa, Triticum aestivum
  misc_feature (262)..(262): Xaa can be any naturally occurring amino acid
MGAPEVHHLFHNPIADHSFSADQSTLAVARDTSVELYGKVGSAFKLKDSLKGHDKTVTGVDIAPNSGRIVTCSQDRNAIVWEPSPEGYKPTLVLLRISRAATFVRWSPSENKFAVGSGDRVIAVCYFEEENDWWVSKHLKKPIRSTITSVAWHPNSVLLAAGSTDAHARVFSAFIKGMDARPPPGVWGERLPFNTVCGEYLNNSAGWVHSVSFSPSGDSLAFAAHDSSITVVYPSGPDQAPRAVVTVSTQQLPFQSLIWTQXDEIIAAGYDCEAF

SEQ ID NO: 15354 - protein, 295 aa, Borrelia burgdorferi
MKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINITRQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIK

SEQ ID NO: 15355 - protein, 1116 aa, Xanthomonas axonopodis
MNAVASLQADAEQSAVVADQRWYKDAIIYQVHVKSFFDSNDDGIGDFPGLISKLDYIAELGVDTIWLLPFYPSPRRDDGYDIAEYMAVHPDYGSIEDFEHLVAHAHARGIRIVTELVINHTSDQHPWFQRARNAPAGSPERDFYVWSDTDQEYEGTRIIFCDTEKSNWTWDPVAGQYFWHRFYSHQPDLNFDNPAVLDAVLEVMRFWLDRGVDGLRLDAVPYLIERAGTSNENLPETHAILRKIRATLDAEYPDRMLLAEANMWPEDTQQYFGQNADECHMAFHFPLMPRMYMAIAREDRFPITDIMRQTPEIPESCQWAIFLRNHDELTLEMVTDSERDYLWQTYAADRRARINLGIRRRLAPLLERDRRRIELMTSLLLTMPGTPVLYYGDEIGMGDNIHLGDRDGVRTPMQWSIDRNGGFSRADPAQLVLPPVMDPLYGFQAVNVEAQIRDQHSLLTWTRRVLSVRKRYQAFGRGSLRFLYPGNRRMLAYLRCYQDETVLCVANLSHTLQAVELDLSEFEGRVPVDIIGGGSFPPIGRLTYLLTVPPFGFYAFQLVSEGTLPDWHVPSPVPLPDYRTLVLRSDADESAALLPHLPTLEGEILPAWLSARRWFSAKDQVLRSVRIARRTPLPGDEPMTLLELEVALEDGRHERYMLPVGIVWEREQPSTLAEQLALARVRQGREVGYLTDAFALKPMVRGVIDALRSHAALDFCDGDDAAQQGQVCFEATPALATLDIPQDPEIRWLSAEQSNSSLVVADKAVFKLLRHVAVGANPEIEIGRRLTEMGYANAAPLLGSVSRIGGQGTVTTIALLQGFIRNQGDAWRWTLDHLARSFDEYATAQTDEARAEAVAGYDAFAAVVGKRLAELHEALSRGTDDADFAPQRIDLPTANDVVAGVGRQVEEMWETVNARLAGSEDSAEREALEAVLAQRPQLDALLAKAPSVLADSLLTRVHGDFHLGQILVAFDDVVLIDFEGEPAKPLAERRAKASPLRDVAGFLRSLDYASEVSARGEEGTAARAGVGVDTHLDQFLVQFRRRSTQAFLDAYHAVLDASAHPWIAPAAFNAATLLFLVEKACYEVRYEAANRPGWLMVPIEGLRRILQRARAGAGDT

SEQ ID NO: 15356 - protein, 307 aa, Erwinia carotovora
MTMSHYSAAKESGPTALLLINKHARNGDSSARDVKQLLQQSQITLVEPDEKDTGSYSDIIRAYADRVDFVIVGGGDGTLNSAAPGLVDTGLPLGVLPLGTANDFARTVGIPRDIRQAIQIIVSGQRRAVDLGDVNGHLFFNVSSIGFSAALARGLSAKSKKRWGTLGYALAAFKLLKQSRPFRVEIEHDGIKERVKTVQVSVGNGRFYGGGMAVAQSAAPDDGRLDVYSLEVSHWWEIVALIPFIRRGTHGRWRKVRAFSAKQLTLSTSRPHDINADGELIGKTPAVFGIREKAIQVFAPPVHGDNG

SEQ ID NO: 15357 - protein, 294 aa, Mycoplasma pneumoniae
MSELITTPVETTAKAELVSLAKLGEMRTHVGMVKRYWNPKMGFFIEPERKHNNDHFVLELQRQSLQTAYNYVKEVAQNNGQILFVGTKNDYVKKLVNNIAKRVDVAFITQRWLGGTLTNFKTLSISINKLNKLVEKQAENAADLTKKENLMLSREIERLEKFFGGVKSLKRLPNLLIVDDPVYEKNAVAEANILRIPVVALCNTNTNPELVDFIIPANNHQPQSTCLLMNLLADAVAEAKAMPTMFAYKPDEEIQIEIPQKQEAPRQVVNRANSKQITSQRLNITRNPEVLTRE

SEQ ID NO: 15358 - protein, 384 aa, Haloferax mediterranei
MSEDFYDVLGVSRDASKDQIKNAYRKKAAKYHPDVSDEEDAEEKFKKVQKAKEVLTDDEKRQMYDQLGHERFQQAQKRGAGGGGGGRGQGNPFGGGGNPFGGMGGGGFEDIFNNLFNGGGGQRRSRPQQGRDVAQRITIDLEDAYHGVERDVTIRRREVCPECDGEGHPADADVNTCSECNGSGQQTTVQQTPFGRVQQTTTCRACGGEGKTYSEDCSECRGSGRVRRTRDVTITIPAGFRDGQRLRYRGEGEPGENGGPNGDLFVEVNVRDHEEFDRDGDDLQYTHPISFPQAVFGATVEVPTLDGEAELKVPAGTQSGSTFTVSGAGMPHLDGRGNGDLHVEIHVVTPEDLNSEQREALKQFAEAGGEEVKESLFQKLKNSL

SEQ ID NO: 15359 - protein, 327 aa, Novosphingobium aromaticivorans
MTKTFGRQSTTDDVLAGLDLTGKTILVTGVSAGLGVETTRALVSRGAKVVGTARDLAKARKALVHAGVDRASIELVELDLADLASVRRASDKLRLEGQPFDLVIANAGVMAPPFGLTADGFETQFGTNHLGHFAFVNRIAGLMRPGSRLVLLASSGHRFANVDLADPNFESSAYDPFVAYGRSKTANILFAVEFDRRYRSLGLRATAVHPGGIRTELDRHMGDGQLQSLVDQINADMAKEGKPPLEWKSPPQGAATTLWAGLVADADDVGGRYCEDCQVSPVVRDESIGFASPGVRPYALDAEMAKALWAKSEEWVSETFDLRSAAD

SEQ ID NO: 15360 - protein, 473 aa, Erwinia carotovora
MSSESSTKKKIVAVIIPLLLGLIIWFSPIPDGLTPQAWHMFAIFAATIAAILTQPLPSGAIMLLVLCITIFTGTLTEAKALAGFSSGTVWLIFCAYILSLGFVTSGLGKRIAYKMLSLFGGSSLGIAYSLGVSDLIMAPAMPSVTARSGGIIFPIARSINEVLGSTPGVSGKKIGDFLIMVCFQFTPITGAIFLTGMAANPLVGSLAKTSLGVDITWGGWFIAAVVPAMCCFCLMPLLVYKILNPELKKTPEAKEMGRRSLAELGNMKSAEKKVAFGFVLALLGWGTSLITGFSATSVGLALVAYLFVTQAVQWKDVLSDRAAWDTVIWFSAIISLAAGLSDLGFIKWMTVKLGNSIQGFGAMETFVILGILYIYVHYLFATASGHVAALYAPFAATAIAAGAPPMMVAICFGIFSNLMWGNTEYGGGPGPIYFAQGYFERHRFYKINFCIVTFNVALIFIVGLVWWKLIGYY

SEQ ID NO: 15361 - protein, 343 aa, Mycobacterium tuberculosis
MRIGVLTGGGDCPGLNAVIRAVVRTCHARYGSSVVGFQNGFRGLLENRRVQLHNDDRNDRLLAKGGTMLGTARVHPDKLRAGLPQIMQTLDDNGIDVLIPIGGEGTLTAASWLSEENVPVVGVPKTIDNDIDCTDVTFGHDTALTVATEAIDRLHSTAESHERVMLVEVMGRHAGWIALNAGLASGAHMTLIPEQPFDIEEVCRLVKGRFQRGDSHFICVVAEGAKPAPGTIMLREGGLDEFGHERFTGVAAQLAVEVEKRINKDVRVTVLGHIQRGGTPTAYDRVLATRFGVNAADAAHAGEYGQMVTLRGQDIGRVPLADAVRKLKLVPQSRYDDAAAFFG

SEQ ID NO: 15362 - protein, 558 aa, Legionella pneumophila
MSESFKELFEQSIAGAQFYPGAIITAKVIDIDDDFVTLNAGLKSEGIVAVEEFYDKNGELEVKVGDTVEVALDSVEDGHGETLLSREKAKRQEAWRKLSKCHENNETVTGLISGKVKGGFTVEIGSIRAFLPGSLVDVRPVRDPSYLEGKELEFKVIKMDLKRNNIVVSRRAVVEEESSADRQALLESLHDGQELHGIVKNLTDYGAFIDLGGIDGLLHITDISWKRVKHPSEVLSVGQDVKVKVLSFDSERNRVSLGMKQLGNDPWVDLVERYPIGKRLQGKVTNITDYGCFVEIEEGVEGLVHMSEMDWTNKNVHPSKVVSLGDVVDVMVLEIDEERRRISLGMKQCVGNPWQQFASTHNKGEKVKGKIRSITDFGIFIGLDGDIDGLVHLSDISWTVPGEEAVKQFKKGQELEAVILAIDPERERISLGLKQLEGDSFASFAETYTKGSIVKGTVTAVEPKTVTVALAEDVSGTIRVSELSDERVDDATTIVKVGDEVEAKITNIDRKNRTISLSVKAKDAQDEADAIKKYSRTEAASTTLGDLLKEKMASKEGE

SEQ ID NO: 15363 - protein, 97 aa, Cyanidium caldarium
MYKIQLVNQKEGVDVTINCPGDQYILDAAEEQGVDLPYSCRAGACSTCAGKLVKGSVDQSDQSFLDEEQINNGFILTCVAYPTSDCVIQTHQEEALY

SEQ ID NO: 15364 - protein, 907 aa, Pseudomonas syringae
MLLLTILPASLMAAMLGGYFTWMQLSELQSQLLQRGEMIAQDLAPLAANALGRKDKVLLSRIATQTLEQTDVRAVSFLDTDRTVLAHAGPTMISPSPIGSGSQLLSSTGTDATRYLLPVFGSQRHLTSPIIPAEADTLLGWVELEISHNGTLLRGYRSLFASLLLILTGLAFTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSRAPRVLCVDDNPANLLLVQTLLEDMGAEVVAVEGGYAAVNAVQQEAFDLVLMDVQMPGMDGRQATEAIRAWEAERNQSSLPIVALTAHAMANEKRSLLQSGMDDYLTKPISERQLAQVVLKWTGLALRNPAPERQNEALEVHVGPLVLDHEEGLRLAAGKADLAADMLAMLLASLDADREAIRVARANQDVHALIERIHRLHGATRYCGVPQLRSACQRAETLLKQNAPHTEEALNDLDKAIIRLEAEARVMA

SEQ ID NO: 15365 - protein, 95 aa, Dunaliella salina
AYKVTLKTPSGDQTIEVSPDAYILDAAEEAGLDLPYSCRAGACSSCAGKVEAGTIDQSDQSFLDDDQQGRGFVLTCVAYATSDCTISTHQEESLY

SEQ ID NO: 15366 - protein, 93 aa, Equisetum arvense
AYKVTLKTPDGDITFDVEPGERLIDIGSEKADLPLSCQAGACSTCLGKIVSGTVDQSEGSFLDDEQIEQGYVLTCIAIPESDVVIETHKEDEL

SEQ ID NO: 15367 - protein, 435 aa, Cryptococcus neoformans
MGSPSSSARLTLLPSNYLSSQNPSSEITLQSLIDVSDRMANEAKEALPYNFDECSYSKGYLRQSVWSCLDCGEKGVCYGCSISCHSEHRLIELWTKRSFRCDCPTVSMQAEQPSGSKRRKCVLNRPETQPQLPNEKNRYSKNFQGKFCRCGRDYDPETEEEAMLCCLGCEDWFHETCLNLRQLGDKTSNLTQPVAKDSQLPTLVTAPDDASSVLIAEEVEEEEEDEQVLIPSDTYDSLICGECVLSNPFLTSQAGKEGFMIIEPRESSWVVIGRNMRHEDEIKIGLGEKRGLEENEEASKRVKLDDGSEARGGDAFTDSEKRKGKGDVFLAHGVRNRLKSQLDMNTISSLPFPLEDEEIYEPPQDVEQEETIEEATSRVVSSLPRIQAIEALHGYQRLKEQLNDMLRSHVQSGKTVSKEDIEELFEKLKATRERR

SEQ ID NO: 15368 - protein, 197 aa, Triticum aestivum
RYVCYSYSYPGHRLGGEEYNPTLGLEHFDGYKFAPIRESQVSREMVTRYMNDMLHYAESDVVIVGCGSAGLSCAWELSKDPSLKIAIIEQSVSPGGGCWLGGQLFSAMVVRKPADKFLDELEIPYDEKDDYVVVKHAALFTSTILSKILMRPNVKLFNATAVEDLIVKNNKVAGVVTNWTLVTLNHDTQSCMDPNVI

SEQ ID NO: 15369 - protein, 204 aa, Glycine max
MLYNHTSSMSLPSPLYLNTTSFRLTRQSPFPFPRRRFNPPAFRSVSPLSSSPSASLFDLRGGKGMSGFHDVELKVRDYELDQYGVVNNAVYASYCQHGRHELLQNIGINCDAVARSGDALALSELSLKFLAPLRSGDKFVVRVRISGSSAARLYFDHFIYKLPNQEPILEAKAIAVWLDKNYRPIRIPAEMKSKFVKFIRIEDS

SEQ ID NO: 15370 - protein, 93 aa, Equisetum telmateia
AYKVTLKTPDGDITFDVEPGERLIDIASEKADLPLSCQAGACSTCLGKIVSGTVDQSEGSFLDDEQIEQGYVLTCIAIPESDVVIETHKEDEL

SEQ ID NO: 15371 - protein, 408 aa, Bdellovibrio bacteriovorus
MHVMLEISHSFHKIDESVLVKCQESLKLFLQRKEIGFPQVMERVSLWQQSYKVGTELAEKFKKIVIVGLGGSSLGTRVIAEVFCARNMFFVDNVDALEFETLIEELGDLKEVAWVFISKSGTTIESLCALELVDQIYTEEKLNLPKHSVVISETKDSSLMAWARKHSIPTCEIPLDVGGRFSVLSPVGMMPAAFLGLDLEKFRVGAMRALNDTAVVTQTMAQVAQSYQREEWITLLWIYNSRMKSFGAWYQQLWAESLGKPETRAGKPAPRVSTPMSAVGASDQHSILQQVMEGTKDKFVVFQRVEESEAGSLRIKKAQFKETQDLEGRTMGELLRAEGLATQEALNQSGVSTMTLKTKVLDEHSLGYMFMFWQLVVAGLGDYLEIDAFNQPGVELGKRLAKEKLKKA

SEQ ID NO: 15372 - protein, 410 aa, Solanum lycopersicum
MGCCKEEEPKWLWVNGPIIVGAGPSGLAVSACLKENGVPSLILERSDCIASLWQHKTYDRLKLHLPKQFCQLPLFDFPENFPKYPTKHQFISYLESYAKHFSITPKFKQSVKVAEFDGVCGFWKVQTQDFQYLSKWLIVATGENAEAVIPEIPGIDKFKGRLMHTSVYKSGTEFINQRVLVIGCGNSGMEVSLDLCRHNAIPHMVVRNSVHILPREMLGISTFSIAMALLKWMPLRIVDKLLLLVANFSLGSTDKLGLRRPKTGPLELKNATGKTPVLDVGALSQIKTGKIQIMPGVKEITKIGAKFLDGKEGEFDSIILATGYKSNVPSWFKGSDFFTEQGMPKTPFPNGWKGENGLYTVGFTRRGILGTANDAKNIARDISEQWREFKGFCKNFCTTKNLSDNQGICF

SEQ ID NO: 15373 - protein, 370 aa, Oryza sativa
MVVQQEQEVVFDAAVLSGQTEIPSQFIWPAEESPGSVAVEELEVALIDVGAGAERSSVVRQVGEACERHGFFLVVNHGIEAALLEEAHRCMDAFFTLPLGEKQRAQRRAGESCGYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTLQAFSDWLNHHRHLQPTIYS

SEQ ID NO: 15374 - protein, 129 aa, Prochlorococcus marinus
MRILHTMLRVGDLDKSIDFYVNRLGMNLLRKKDYPHGKFTLAFVGYGSEKENSVIELTYNWDKKSEDYELGDKYGHIAIGVKDIHLICQGLEKNGCKITTKPKTMKNSTTVLAFVEDPDGYKIELIERD

SEQ ID NO: 15375 - protein, 737 aa, Ostreococcus tauri
MTTARPGTRPVRRFKSSTFDLISARIVPAIALPSITVAVDDAAPMSRAVDRAGVRARGRGDRARGRRRREGSWITLTSDDSSTGPSGCRTPACARTPTSPSVPIRESRLVTYPSRPGPIPSARRPRPWTSKRERATRSPGAVDAGPHGARARCGATRRDARADWLAKNDGKEKKRDGKKPTRDARGRRRPQTSETTSGRSEKDDVTFDGFTNEELRPDFGFRRDLYELYDVPVNDEPLGAGSYGVVRAAVSKKTGEVFALKTLKKAPWIKAPASMQAVNYYHGKIRNEVEVMRTIGGSLSVCYLYEAFEDDENCHLLMELCSGGELLDRVVIGSSEEYREAKVANLVKSVLRTTVQCHRRGIIYRDIKPDNFLFQTEDQDSPLKATDFGLAGKLPPNGENLARRCGTPSYMAPEVIERNYNSPADVWSAGVVTYQLLSGRLPFTDKINPRPNAKEVFRAILEDPIDFETDPWPEVSEDAKDFVKKLLNKDPDARPTARAALLHPWLTKSEALWKAEALKGKDTALNGQVVARLQRFATQGLLKRSVLRLITSEMLSEDMEDAVSLKNADLATLKKLFEKLDTSGDNMVELVELEVGLREIGYDVTGKESKQLLGSLDTSGDGLIDVNEFTAALLDWEKIEKTSDYPKWVERAFKVLDKDGSGEIDADEVAELIFEDWEEDNDSVRTSIIRACIREADKDGNGQIDLEEFAGLLQSDPSDDLDQYDSRIASSFDFDQV

SEQ ID NO: 15376 - protein, 305 aa, Desulfovibrio vulgaris
MSHAFDLIILGGGVAGMTSAIYAARANLRVLILDENACGGLVNWTKVVENMPSYTSIGGMELAQRMQEQVNNLGVTVEEAVCIDSMDLTGPEKRVEADGEVYTAKAVIVATGRKPVPLEAAGECEQVHFCAICDGAPYIGKRVLVVGGGNSGFDESLALLDQGIAELTLVERMDRFFAAQKAQDLLAARPNATLMRSTEVVSVDYDETLRSVTLRDVATGEVFTREFDGIFVFMGQKPGTEVFRGQFDMDAQGYIVTDENMATSLSGVYAAGDVRQKKYRQLTTAMADGTMAALEAERFIHSAPA

SEQ ID NO: 15377 - protein, 548 aa, Candida glabrata
MSVYIHEVKGVDETGVAGTQEQPFKTAAFALFCSETEPKLFVYKEADGEYQEISASALKKARKGCEGLKKKAIKQKEQDAKKQQQDADNAAKQMAALNIKIEEDKSLPEAKKCKIGQSYELVGQRVKISGWIHRLRSNKKVMFIVLRDGYGYLQSVLTGDLAIAQQSLDLTIESTVTLYGTITKVPEGKSAPGGVELLVDYYEVVGLAPSGDEAFTNKIAEGADPSLLLDQRHLALRGETLSAVMKVRAALMKSIRRVYTEESLTEVTPPCMVQTQVEGGSTLFKLDYYGEQAYLTQSSQLYLETCLPSLGDVYCVQESFRAEKSHTRRHLSEYTHIEAELAFLTFEELLDHIERVLCKTVQYILEDPIAGPLVKQLNPDFQAPKMPFMRLEYKDAIEWLKEHDIKNEDGEEFKFGDDIAEAAERKMTDTIGVPILLTKFPAEIKSFYMPRCKDDNRVTESVDVLMPTVGEITGGSMRINTEEELLAGFKRENIDPKAYYWFIDQRKYGTCPHGGYGLGTERILAWLCNRFTVRDCSLYPRFSGRCKP

SEQ ID NO: 15378 - protein, 459 aa, Pyrococcus horikoshii
MKVMKILLVLPPTESAIKRVVGTTGPPLGLAYLASMVREEHDVKIIDGLAEDLTFSDIAKIIKKFDPDIVGITATTSAMYDAYTVAKIAKNINENVFVVMGGPHVTFTPELTMRECPCIDAVVRGEGELTFKELVDALSKGRELKGILGLSYKENGKVRNEPPRPLIQNVDEIPIPSYDLLPMDKYKADGVPFGVVMTSRGCPFNCVFCSSSLQFGKRWRGHSVERVIEELSILHYEYGIKEIEFLDDTFTLNKKRAIDISLRIKQEGLDISWTASSRVNTFNEKVAKAMKEGGCHTVYFGIESASPRILEFIGKGITPQQSIDAVKTAKKFGLHALGSFIIGFPDETREEVEATIKFAKKLDIDYAQFTIATPYPGTRLWEYAIANNLLLTMNWRKYTTIDPVMKLKHFTSEQISKLLRKAYISFYLRPKVLIKDIFEHHGFIIKRAIRGLLRVYYQA

SEQ ID NO: 15379 - protein, 416 aa, Vibrio parahaemolyticus
MDLTNMGKAAKGAAFELATASTAQKNQALAIIADELEANSAAILAANAKDIELGREAGLTDALLDRLLLNEERLTGIANDVRNVISLNDPVGSEIDSKVLENGMSLSRRRVPLGVVGVIYEARPNVTIDIAALCLKTGNASILRGGKETFFSNMELVKVIQSALAKANLPAASVQYIEKPDRELVSQLLKLDDYVDMIIPRGGAGLHKMCKENSTIPVIIGGFGISHIFVDESADLEKSLNVVENSKVQRPSACNSLDTLLVHEKVAAKFLPMIVERMSDKVTFVAEPKAKALMAQATQIRDAVEGDFDTEWLSYTLGVKVVADVKEAIDHMRVHNASHSDAIMTNSLINSELFINSVGSAAVYVNAATRFTDGAQFGLGAEVAVSTQKLHARGPMGLEELTSYKWVGKANYLARS

SEQ ID NO: 15380 - protein, 136 aa, Conocephalum supradecompositum
MARTKQTARKSTGGKAPRKQLASKAARKSAPSTGGVKKPHRYKPGTVALREIRRYQKSTELLIRKLPFQRLVREIAQEFKSDLRFQSSAIGALQESVESYLASLFEETNLCAIHAKRVTIQSKDIQLARRLRGERN

SEQ ID NO: 15381 - protein, 424 aa, Xanthobacter autotrophicus
MTLHVAPTHAADPAVFDAIRAELKRQQDQIELIASENIVSEAVLAAQGSVLTNKYAEGLPGKRYYGGCEHVDVVEEIAIARAKALFGAGFANVQPHSGAQANAAVLMALLQPGDTLLGMSLAAGGHLTHGAPPTLSGKWFKAIGYGVTRDNALIDYDEVERLAQEHRPKLIIAGGSSYPRIIDFARFRAIADAVGAHLMVDAAHYAGLIVAGAYPSPFPHAHVVTTTTHKTLRGPRGGLILTNDEALAKKLNSAVFPGLQGGPLMHVIAAKAVAFGEALTDDFRTYALKVVSNARALAGRLSERGAAIVSGGTDSHMVLVDLRPFGVTGKAAEAALERAGLTCNKNGIPFDPEKPFVTSGIRLGTPAGTTRGFGIAEFEEVGDLIADVLTGLAANGAEANGKAEVATRARVAELCARFPLYAGM

SEQ ID NO: 15382 - protein, 58 aa, Hordeum marinum
KGKLPKEARQKLLHWWELHSKSPYPSETEKMALGESTGLDQKQINNWFINQRKRHCKP

SEQ ID NO: 15383 - protein, 462 aa, Bifidobacterium breve
MATTTGAKRGIWPMIRRIAASDRISGLIMLGFALAGLVLANLPLTAHAFEAVAETHVFIPHTNLDLPIGHWAQDGLLTIFFLTVGLELKQELTTGSLANPKAAAVPMLCAVGGMITPPILFLATTALFSQFGPGEPGSLILATTGSSIPFAEMSHGWAVPTATDIAFSLAVLALFAKALPGSIRAFLMTLATVDDLLAIILIAVFFSSVNAWYWFIGIAVCAVVWAHLVRLKKVPWIAVGVVGILAWIMMFEAGIHPTLAGVLVGLLTPARVMHGEYSPRAERYADKLKPFSALLALPIFALFATGVHFESMSPLLLLSPLVIALIVALVVGKPLGIIVTAWLATHVGGLKMAKGLRVRDMIPAAVACGIGFTVSFLIASLAYTNQELSAEARFGVLVASLIAAAISGVLLSRQSKRFEQAAAVAAAEADAESDVNTHSDELAEHSITLADGTESVEIDFRR

SEQ ID NO: 15384 - protein, 874 aa, Solanum tuberosum
MLEVDEKDRVPAGGNRKTYARSISWSDRSPTKSSAKPQWNSKARACLPPLQPLSITRPTAEEWPRAGSDDLGVWPNPSTPGVRLGSFSTHEGSATKQAPREFEFKKDKLAFFNKECSKIVDHIYLGSDTVAKNRDILRENGITHVLNCVGFSCPEYFKDDLVYKTLWLQDSPTEDITSILYDVFDYFEDVREQGGRVFVHCFQGVSRSASLVIAYLMWKEGMSFEDAFQHVKAARGVTNPNMGFACQLLQCQKRVHAQPVSPTSVLRMYRMAPHSPYDPLHLVPKMLSEPGAEGLDSRGAFLVLIPSVIYVWIGKHCTSVMSDNARAAAFQVIRYEKAQGPVLIINEGKEPSDFWSALSQESFFSGGCGKEKTKVDARLLAENDLITDDISQCIGQKNEYDLDFEIFCKALAGGVVPPFPLSGTESETCLPARQNGWSRLRRKFSSGIMKEFITASKLYSHTGITSPVLDKMDTIKELSPALPSSPSSPQCGSPDSFSSYATSSPSWTKDPCRDVENPGLDAVPVLSPSPSFSSLDSLSCFLVSKPKSNTTSPSLSPSTSDYSSSFTFSPSSSNWSDLAYLSAQPSPTRFEHEDPNFVKNDFFKVSSSLLCKGSPFPAAEEAFPTSLALRRANSCLQYKETSPSLAERRGSHPPPMMMLRSNDDSAKISVKLVRTSSFSLPNFEDDTMKCVECDSLNDGDFVDNSKEELMLDVENSITDNQLQNGVQPVDDVSGSFNDNPIGIPIRVAETTDIGLYQWPSMHKLGLSSVVFDSRSVYIIVIPDLSLDENSSSSLYIWMGRDVQWKESSDQVINNDSMCEDNHVHWEKVGLNFLIQKGLATSSLVQIVKEGEEPEQLLKHLPCFSFDKALDVGVK

SEQ ID NO: 15385 - protein, 179 aa, Solanum tuberosum
MAQALEFYNGQIEALMRAMSVAKIIREDKNPCMIEEGLYLGSLGAANNKVALKSLNLTHILTIARDINPPYPNEFVYKVLSVHDRVDVNISHYFEECFDFIEEAKGQGGGVLVHCFAGKSRSATIVIAYLMKKHGMSHSEAFELAKSKRPVVSPNAGFMTQLENYDKTLKDLNTPNVML

SEQ ID NO: 15386 - protein, 467 aa, Haemophilus influenzae
MSKVASIVDVLQGKVAIGETVTVRGWVRTRRDSKAGLSFLAVYDGSCFDPIQAIINNDIKNYESEILRLTTGCSVIVTGKVVESPAEGQAVELQAEKVEVTGFVEDPDTYPMAAKRHSIEYLREVAHLRPRTNIIGAVARVRHCLSQAIHRFFHEQGFYWVATPLITASDTEGAGEMFRVSTLDLENLPRGENGKVDFSQDFFGKESFLTVSGQLNGETYACALSKIYTFGPTFRAENSNTTRHLAEFWMVEPEVAFATLADNAKLAEDMLKYVFRAVLAERKDDLQFFEKHVDKDVITRLENFVNSDFAQIDYTDAIDVLLKSGKKFEFPVSWGIDLSSEHERFLAEEYFKSPVVVKNYPKDIKAFYMRLNDDGKTVAAMDVLAPGIGEIIGGSQREERLEVLDKRMEEMGLNPDDYWWYRDLRKYGSVPHSGFGLGFERLIVYVTGVQNIRDVIPFPRAPRNANF

SEQ ID NO: 15387 - protein, 286 aa, Dechloromonas aromatica
MSEFSFDVTLEEFETKVLLPAQEVPVVVDFWAPWCEPCKVLKPMLEKLAEEYKGRFLLAKVNSDEFPELAQHFGVRSIPSVKVLFQGQLVDEFNGAIPESQIREFLDRIALPEGPEQINLREQAAALVVEGKLDEALAVLVQASQANPQDQAIQLDAVDVLLQLGRIDEAKQLLAGEYVNEADRANALRARLALAGGAADTAEIEARLAANPADNGARLELSRAYAAQSRFREAMEAALEVVIRDRAFDEGAGRKALLQLFEALGGSEQYDDLIREFRRKMSAALN

SEQ ID NO: 15388 - protein, 99 aa, Prochlorococcus marinus
MASYKVTLISEGEGLNSTIEVPDDQYILDAAEEQGIDLPYSCRAGACSTCAGKVTSGSVDQSDQSFLDDDQLEAGFVLTCVAYPTSDVTITTHAEEELY

SEQ ID NO: 15389 - protein, 261 aa, Populus trichocarpa
  misc_feature (138)..(138): Xaa can be any naturally occurring amino acid
MLQTLSTHLSSTSTSTTTPLLLLSKPFLSPSAKSQLSHSKPFNFPRTLKPISYYKPPMANILSKLGFGTRSPDPSTMDPTIPQGPDDDLPAPGQQFAQFGAGCFWGVELAFQRVPGVTKTEVGYTQGLLHNPTYEDVXTGTTNHNEVVRVQYDPKECSFDTLIDVLWARHDPTTLNRQGNDVGTQYRSGIYYYTPEQEKAAKESLERQQKLLNRKIVTEILPAKKFYRAEEYHQQYLAKGGRFGFMQSAEKGCNDPIRCYG

SEQ ID NO: 15390 - protein, 136 aa, Encephalartos altensteinii
MARTKQTARKSTGGKAPRKQLATKAARKSAPATGGVKKPHRFRPGTVALREIRRYQKSTELLIRKLPFQRLVREIAQDFKTDLRFQSSAVAALQEAAEAYLVGLFEDTNLCAIHAKRVTIMPKDIQLARRIRGERA

SEQ ID NO: 15391 - protein, 416 aa, Methanococcoides burtonii
MAEQNPFENARKQLQKCADILELDEGIHDILKNPMREMHVSLPIRMDDGSIKVFQGFRVQYNDAKGPTKGGIRFHPDETVDTVKALAAWMTWKCAVMDIPLGGGKGGVICNPKEMSQSELERLSRKYISSISMIVGPDKDVPAPDVYTNPQMMAWMMDEFSKFAGKNQFGVITGKPLSVGGSLGRGDATARGGLYAVREAAAEIGLELKDATVAIQGYGNAGYFAGTLCEELFGCKVVAVSDSRGGAVNMNGISAEAAQEHKKATGSVVGLAGTEPISNEDILELDVDILIPAALEHVITHENADNIKAKIVAELANGPTTPEADEMLFQKGVHLIPDFLCNGGGVTVSYFEMVQNFYMYRWSIERVHNRLDAKMTNAYHAVLEASKQYNVNMRTAAYVVAVNRVVEAMADRGWLY

SEQ ID NO: 15392 - protein, 87 aa, Zea mays
  misc_feature (37)..(37): Xaa can be any naturally occurring amino acid
  misc_feature (42)..(42): Xaa can be any naturally occurring amino acid
  misc_feature (46)..(46): Xaa can be any naturally occurring amino acid
  misc_feature (48)..(49): Xaa can be any naturally occurring amino acid
  misc_feature (51)..(51): Xaa can be any naturally occurring amino acid
MGRRPARCYRQIKNKPYPKSRYCRGVPDPKIRIYDVXMKRKXADEXPXXVXCLKVAAFFPPPPRSPLKPGGGPRYPLPTLPPLRPTF

SEQ ID NO: 15393 - protein, 365 aa, Anaplasma marginale
MFFQRWWRAISHIAVQWSRIYMRVGLWRFNCCSSFGVMMGNLPEFSIRDLVEAGVHLGHKAGRWNPAMAPYIYGVHKYKDIHVIDLRKTLVLLRDALSVLYDVVLKRGRVLFVGTKVQASNIVAEEATRCGQYYVNHRWLGGMLTNWETVSSSIRRLVEFERLINNNEGQFTKKELLMLDKQRGKLERSLGGIREMGGLPHALFVIDTNKEHIAIREANKLKIPVVAILDTNSDPGGVDYPIPGNDDSVRSIDFFCRAVSRTILEAIRSDLASSGVNIAAKGSDVAESYAGTAADAGHTPVSETLSAGGPTAGASPYIPEVGPSVVEVDTHKSAALPDSRPNDADVPAEDGVLPDPGVADGAALE

SEQ ID NO: 15394 - protein, 304 aa, Streptococcus mutans
MYDTIIIGSGPAGMTAALYAARSNLKVALIEQGAPGGQMNNTSDIENYPGYDLISGPELSMKMHEPLEKFGVENLYGIVTAVEDHGNFKKVLTDDNSYETKTVIIATGAKHRPLAVAGEETYNSRGVSYCAVCDGAFFRGQDLLVVGGGDSAVEEALFLTRFANKVTIVHRRDELRAQKVLQERAFANDKVDFIWDSVVKEIKGNDLKVTNVDIENVKTGQVNNYAFGGVFIYVGLDPVSSMVKELDITDEAGWIPTDDHMKTKVAGVFAIGDVRQKDLRQITTAVGDGAVAAQEAYQYIVNNY

SEQ ID NO: 15395 - protein, 177 aa, Triticum aestivum
MSTSASALLTPSTFSTVISQKNPNSISFHGLRPLRLGGSSSSSLPKLSTTAGRRSSSAVVRAELSPSVVISLSTGLSLFLGRFVFFNFQRENVAKQVPEQNGKTHFEAGDDRAKEYVSLLKSNDPVGFNIVDVLAWGSIGHIVAYYVLATSSNGYDPSFFGISPLVMYIGVLVSQAT

SEQ ID NO: 15396 - protein, 199 aa, Citrus sinensis
TRVNVLFKHIQDMLSGDTAVIAETGDSWFNCQKLRLPENCGYEFQMQYGSIGWSVGATLGYAQAAKDKRVIACIGDGSFQVTAQEISTMIRCGQRSIIFLINNGGYTIEVEIHDGPYNVIKNWDYTGLVNAIHNGEGKCWTAKVRSEDELTEAMKTATGEQKDSLCFIEVFVHKDDTSKELLEWGSRVSAANSRPPNPQ

SEQ ID NO: 15397 - protein, 98 aa, Phytolacca americana
AASYKVTFVTPSGTNTITCPADTYVLDAAEESGLDLPYSCRAGACSSCAGKVTAGAVNQEDGSFLEEEQMEAGWVLTCVAYPTSDVTIETHKEEDLTA

SEQ ID NO: 15398 - protein, 485 aa, Solibacter usitatus
MEQTADIALIGLAVMGQNLIMNMNDHGYTVVAYNRTTSKVDEFLNDAAKGSKVIGAHSIEEMVKLLKRPRKIMLMVKAGKPVDEFIETLLPYLEPGDLIIDGGNSHFPDTIRRTQYLESKGLLFVGTGVSGGEEGARFGPSMMPGGTPAAWPLVKDIFQAICAKTPEGEPCCDWVGRDGAGHFVKMTHNGIEYGDMQLICEAYQLMKEGLGMSNEEMHEVFAEWNKGELDSYLIEITRDILGYKDPATGEQTLDKILDTAGQKGTGKWTSVSSLDLGMPVTLIGEAVYARCLSAMKDDRVKASKILTGPKAKFPGDKKAFVEDIRQALLASKIVSYAQGFMLLAEAAKEYKWDLNYGSIAMMWREGCIIRSVFLGKIKAAFANNPTLANLLLDSYFRGLLDRCQGSWRHTVSEAVLNGVPVPAFTTALAFYDGYRSERLPANLLQAQRDYFGAHTFERVDQPRGKFFHTNWTGKGGNVSAGVYTV

SEQ ID NO: 15399 - protein, 98 aa, Phytolacca acinosa
AASYKVTFVTPSGTKTITCPADTYVLDAAEDTGLDLPYSCRAGACSSCAGKVTAGSVNQEDGSFLDEEQMEAGWVLTCVAYPTSDVTIETHKEEDLSA

SEQ ID NO: 15400 - protein, 559 aa, Unknown
  Azoarcus sp. EbN1
MEVANNSKHSVFIAVTEPFTPPHRLSAWSTLENHAARLRTMRIAELFEHDAARFATLSFGHRGLLLDLSKQSIDAPALAALVDLAGQARLPDGIEALFAGEHLNFTEDRAVLHMALRGACAAPLEDAATLAQSQQRMRAFTVALRSGTMTGATGKPIRLVVNLGIGGSDLGPRMAAQALVPTGLRATPEVRFVANIDRRELDEALADADPASTLFVVSSKSFATAETLANAQAARAWLQAGLGAGCDPALHFTAVSNATDAAAAFGIPAERVFPLPEWVGGRYSVWSTIGLPLMIAIGASEFDAFLAGARAMDEHFRTAPPGENLPVLMGLAGLWNTDFLGIESLALLPYAHGLRSFAAWLQQLEMESNGKRCLRDGSGSVIHTSPIVWGGVGTVGQHAFHQLFYQGTRRVALDFIVPVAAADDVSQRSLVENAFAQSAALMSGRDLDTALASLRAKGLAESEAAVLAPHLVCPGNQPSTTVLLPALDAFSLGQLMALYEHKVFVQGWIWGINSFDQYGVELGKEMARSLSAGSGENHDASTAGLMAAAEAMRRTPDRS

SEQ ID NO: 15401 - protein, 1036 aa, Vibrio vulnificus
MKRMLINATQKEELRVALVDGQRLYDLDIESPGHESKKANIYKGRITRVEPSLEAAFVDYGAERHGFLPLKEIAKEYFPDGYSYQGRPSIKEVLTEGQEVIVQIEKEERGSKGAALTTFISLAGSYLVLMPNNPRAGGISRRIEGDERTELKSALSTLELPQGMGLIVRTAGVGKSAEELEWDLNVLLKHWAAIKDASESNPAPFLIHQESNVIVRAIRDYLRRDIGEILIDSNTIYERAKEHIQLVRPDFVNRVKKYDGEVPLFSHYQIESQIESAFQREVRLPSGGSIVIDPTEALTSIDINSARATKGGDIEETALNTNLEAADEIARQLRLRDLGGLVVIDFIDMTPVRHQREVENRLREAVRLDRARVQIGRISRFGLLEMSRQRLSPSLAEASHHICPRCSGTGVVRDNESLALSVLRLIEEEALKDNTAQVLAVVPVPIASYLLNEKRRSVNHIERIQEVKITVVPNSDMETPHFEVIRVREGEEVDLLSYLLPKKLEAMKEAEGKESPETEYKPKKIEEPVLKGFASPAQSVPAPAPKAVVAKVANEKPQAEEKPGLFGRLIKALGSFLFGSAEEKVEAEKTERKDEREKGNRRQKRDRNDRRRNNRDNNRENNRDRDGKRRQRNRDENVVETQDEAIKPRSQQKRKQKPAQNKADNAVESKANAKVAEKGLQLAAEAQGASKQEGQKTPSKAEKVKERRQRRKLNKPVRVKDQLEQAEETLMDAAPVVEAETFNKQNTPASEKAEKVVADTVDAMDNSENEEKPRRNRRSPRHLRASGQRRRRGRDRRPNPFRLRKGGVASPEMAMGKVMPRYIPKPVAKKEEMVKEEVVTAVTAVPAMQGGVACPEMAMGKVIIRRDITSAQTPTETKPKRSKSRNNKPAKAAVVEVVTEEPTVENAVVAPIQETEVQKIEPQVESVSQPVEQVSVETTEVVAEIVETTEVVAEVESATETVANETEATVAVVESSIKVIKAQASAPMTKAPGPQELIEIQVVAAPFKAERYAQRGAGSQVATSQASAAMTKPEMV

SEQ ID NO: 15402 - protein, 394 aa, Triticum aestivum
  misc_feature (320)..(320): Xaa can be any naturally occurring amino acid
MEMSLADCWGPAPASPIGFEGYEKRLEITFSDAPVFADPCGRGLRALSRHQIDSFLDLARCTIVSQLSNKQFDSYVLSESSLFVYSHKVVIKTCGTTKLLLSIPRILELAAELSLPLLSAKYSRGAFIFPGAQPAPHRSFSEEVSVLNGFFGGLKSGGNAYVMGDAFRPKKMWHVYYATEEPEQPMVTLEMCMTGLDAGKAAVFFKNSADGGCSSAKEMTKVSGISAIIPEMEICDFDFDPSGYSMNGVCGPAASTIHVTPEEGFSYASYEAMNFNPGSLVYSDLIKRVLSCFRPSDFSVAVTIFGGHGFAKSWAGGAEXGSSYVLEDVVEQELPGGGLLMYQSFSAVAPGAVSPRSTLDDGWSSDGMEAAAQGEDTCIWGVEKKVAVKGVAAA

SEQ ID NO: 15403 - protein, 331 aa, Novosphingobium aromaticivorans
MTFEVGVVGAGAWGTALAQMLSSDGREVLLWARESEVVREINEDRRNGPFLPSACLNPTITATADLADMARIPVLLLVTPAQHLASVLGGIGRDGGDVVLCSKGIEAGTGRLMADVARDAAPDASIAVLSGPTFAHEVADGLPTAVTLACAGGEEQWLRLSTAIARPTFRPYYSDDVTGAEIGGAVKNVLAIACGVVEGLRLGQNARAALISRGFAEMQRFGLALGARPKTLSGLSGLGDLVLTCSSTSSRNFSLGKALGEGASATAVMADRATVAEGAFTAPVLADLARGRGISMPIVEAVVTLLEGAAPAREVVAGLLSRPLTAENPLV

SEQ ID NO: 15404 - protein, 410 aa, Solanum lycopersicum
MGCCKEEEPKWLWVNGPIIVGAGPSGLAVSACLKENGVPSLILERSDCIASLWQHKTYDRLKLHLPKQFCQLPLFDFPENFPKYPTKHQFISYLESYAKHFSITPKFKQSVKVAEFDGVCGFWKVQTQDFQYLSKWLIVATGENAEAVIPEIPGIDKFKGRVMHTSVYKSGTEFINQRVLVIGCGNSGMEVSLDLCRHNAIPHMVVRNSVHILPREMLGISTFSIAMALLKWMPLRIVDKLLLLVANLTLGSTDKLGLRRPKTGPLELKNATGKTPVLDVGALSQIKTGKIQIMPGVKEITKIGAKFLDGKEGEFDSIILATGYKSNVPSWFKGSDFFTEQGMPKTPFPNGWKGENGLYTVGFTRRGILGTANDAKNIARDISEQWREFKGFCKNFCTTKNLSDNQGICF

SEQ ID NO: 15405 - protein, 97 aa, Spinacia oleracea
ATYKVTLVTPSGSQVIECGDDEYILDAAEEKGMDLPYSCRAGACSSCAGKVTSGSVDQSDQSFLEDGQMEEGWVLTCIAYPTGDVTIETHKEEELTA

SEQ ID NO: 15406 - protein, 376 aa, Bacillus cereus
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKESDVSISVIEVPWDEASRFGIMNTNEEMEIVEFEEKPQFPRSNLASMGIYIFNWSILKEYLEMDARNPESSNDFGKDVLPLLLDEGKKLMAYPFEGYWKDVGTVKSLWEANMDLLRDETSLNLNDRNWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 15407 - protein, 386 aa, Enterobacter cloacae
RMSGIFRDVSLLHKPETRIADYQIVTDLNAECDRAILRVDVALEGSRYAECEVAFTLWRNGEACAQTTQQPGSAIVDERGSWAERLTVAIPVNAPALWSAETPECYRLTMSLRDAQGNVLETEACDVGFRRVEISNGLLKLNGKPLLIRGVNRHEHHPEKGQVMDEATMRRDIELMKQHNFNAVRCSHYPNHPLWYTLCDRYGLYVVDEANIETHGMVPMSRLADDPRWLPAMSERVTRMVQRDRNHPSIIIWSLGNESGHGANHDALYRWLKTADPTRPVQYEGGGASTAATDIVCPMYARVDQDQPFPAVPKWSIKKWIGMPDETRPLILCEYAHAMGNSFGGFASYWQAFRSHPRLQGGFVWDWVDQALTKKAEDGTAFWAYG

SEQ ID NO: 15408 - protein, 194 aa, Arabidopsis thaliana
MERDDCRRFQDSPAQTTERRVKYKPKKKRAKDDDDEKVVSKHPNFRGVRMRQWGKWVSEIREPKKKSRIWLGTFSTAEMAARAHDVAALAIKGGSAHLNFPELAYHLPRPASADPKDIQAAAAAAAAAVAIDMDVETSSPSPSPTVTETSSPAMIALSDDAFSDLPDLLLNVNHNIDGFWDSFPYEEPFLSQSY

SEQ ID NO: 15409 - protein, 411 aa, Unknown
  Rhodococcus sp. RHA1
MTQPFRSELSRYLRTATVGGSILLIAAAIALVWANSPVSDSYFALRDWQIGPQALHLNLTVGTWAQDGLLAVFFFVAGLELKRELVVGELADRKRALLPIIAACGGVVVPAIIAATIGAGTPGMDRGWAIPVATDIAFALGVLALTGSRIPTSARVFLLSLAVVDDLLAIVLIAVLFTSSIALLWLLGAIACLAVYAFAQHRRITTPLLYVPLALLTWYCMHDAGIHATLAGVALGLLTRVRRDPGERESPASRLEHRIQPLSAGVCVPVFALFASGVALSSELLGQLFTNPISQSVIAGLLVGKTVGIFGISWLAIRLGIAKKPRALGFRDMFALSVLGAIGFTVSLLVADLALAGIGDGSEAEIAKVAVLVTSLTASLIGSALLWRRGRAHAARKDDSDVQELPGGVDK

SEQ ID NO: 15410 - protein, 453 aa, Oryza sativa
MSPRLRLHHLLLSILSALPTCPLDHSTPTSAAAAAAATASHHHVVTTLPGYDGELPFRLETGYVAVDEEEHGAELFYYFVESESGDPRRDPLLLWLTGGARCSVLSGVFFEVGPVRLALEHHRPYDAGELPRLRYHPHGWTKAASVLFVDSPVGAGWSFSRHPDGYLVGDVSASLQLKHFLAKWISDHPEYLANPFYIGGDSYAGKIVPFLAQKISEDIEAGVRPIVDLKGYLVGNPVTGESIDFDSRVPYAHGVGIISDQLYETIMEHCQGEDYSNPKNAICRQALDRFNELLGESSGGHILYNYCIYDSDIDGSIQEKRKIPPFPPRECIGSVDEWLRCHNGDLPYSMDIKSNIKFHHNVTTKGYRALVYSGDHDAMIPFLGTQAWVRSLNFSVVDDWRAWHVDGQSAGFTITYMNNMTFATVKGGSHTVPEFEPERSLAMFKRWISNEPL

SEQ ID NO: 15411 - protein, 131 aa, Saccharomyces cerevisiae
MSSAAEKKPASKAPAEKKPAAKKTSTSVDGKKRSKVRKETYSSYIYKVLKQTHPDTGISQKSMSILNSFVNDIFERIATEASKLAAYNKKSTISAREIQTAVRLILPGELAKHAVSEGTRAVTKYSSSTQA

SEQ ID NO: 15412 - protein, 391 aa, Enterobacter cloacae
SGIFRDVTLLHKPDTQIADYHVVTDLNAELDRAVLKVDVALAGAGFADCEVVMTLWRTGEKCASVSRRPGSAIVDERGSWAERLTAAIPVDQPALWSAETPELYRLTIALLNPQGEVLEVEACDVGFRRVEISNGLLKLNGKPLLIRGVNRHEHHPENGQVMDEATMRRDIEIMKQHNFNAVRCSHYPNHPMWYRLCDRYGLYVVDEANIETHGMVPMSRLADDPRWLPAMSERVTRMVQRDRNHPSVIIWSLGNESGHGANHDALYRWLKTTDPTRPVQYEGGGANTAATDIVCPMYARVDRDQPFPAVPKWSIKKWIGMPDETRPLILCEYAHAMGNSFGGFAKYWEAFRSHPRLQGGFVWDWVDQALTKRDERGNAFWAYGGDFGDKP

SEQ ID NO: 15413 - protein, 96 aa, Raphanus sativus
ATYKVKFITPEGEQEVECDDDVYVLDAAEEAGIDLPYSCRAGSCSSCAGKVVSGSVDQSDQSFLDDDQIAEGFVLTCAAYPTSDVTIETHREEDMV

SEQ ID NO: 15414 - protein, 393 aa, Escherichia vulneris
RMSGIFRDVSLLHKPTTQIRDLRINTRFNDDFSRALLEAEVRIAGDEREDVRVTLQLWNGETLVGELTSPPGSEIVDERGAYHDRTTLRLNVEHPALWSAEAPNLYRAVVQLHTADGTLIEAEACDVGFRQVCIENGLLLLNGKPLLIRGTNRHEHHPVNGQVMDEATMVQDILLMKQNNFNAVRCSHYPNHPLWYTLCDRYGLYVVDEANIQTHGMVPMNRLSDDPTWLPAMSQRVTRMVQRDRNHPSIIIWSLGNESGHGANHDALYRWLKSEDPSRPVQYEGGGADTVATDIICPMYARVDQDQPFPAVPKWSIKKWLSMPGEQRPLILCEYAHAMGNSLGGYAKYWQAFRQYPRLQGGFVWDWVDQSLIKYDDNGNPWSAYGGDFGDTP

SEQ ID NO: 15415 - protein, 361 aa, Triticum aestivum
MVQPVFDAAVLSGRADIPSQFIWPEGESPTPDAAEELHVPLIDIGGMLSGDPAAAAEVTRLVGEACERHGFFQVVNHGIDAELLADAHRCVDNFFTMPLPEKQRALRHPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPLETLGTGPHCDPTSLTILHQDNVGGLQVHTEGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWIVQQQQPQPART

SEQ ID NO: 15416 - protein, 136 aa, Conocephalum supradecompositum
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIRSKDIQLARRLRGERN

SEQ ID NO: 15417 - protein, 398 aa, Oryza sativa
MGVLSAADPPPVSAIGFEGYEKRLEITFSEAPVFADPDGRGLRALSRAQIDSVLDLARCTIVSELSNKDFDSYVLSESSLFIYSDKIVIKTCGTTKLLLTIPRILELAEGLSMPLAAVKYSRGMFIFPSAQPAPHRSFSEEVAVLNRYFGHLKSGGNAYVIGDPAKPGQKWHIYYATQHPEQPMVTLEMCMTGLDKEKASVFFKTSADGHTSCAKEMTKLSGISDIIPEMEICDFDFEPCGYSMNAIHGSAFSTIHVTPEDGFSYASYEVVGFDASTLAYGDLVKRVLRCFGPSEFSVAVTIFGGHGHAGTWAKELNADAYKCNNMVEQELPCGGLLIYQSFDATEDVPVAVGSPKSVLHCFEAENMVNPAPVKEGKLGNLLPWGEDALEENDGVFDE

SEQ ID NO: 15418 - protein, 381 aa, Escherichia hermannii
MSGIFRSVSLLHKPDCHLADWQVTPQLDDCYRDAQLNVAVRFAAPPAQLSHLTVELTLWEGDEPIAQLRGKPGSAPVDERGNYPERGHYALSVREPKKWSAETPHCYRLVAALYLDDVLLEAEACDVGFRRVDIHNGLLTLNGKPLLIRGVNRHEHHPERGQVVTEQDMIQDILLMKQNNFNAVRCSHYPNVERWYELCTRYGLYVVDEANIETHGMTPMNRLSDDPAWFAAFSARVTRMVQCHRNHPAIIIWSLGNESGHGATHDALYRWVKTADPSRPVQYEGGGADTAATDIICPMYARVDQDQPFPAVPKWSIKKWLSLPGEHRPLILCEYAHAMGNSLGNFAAYWQAFREYPRLQGGFIWDWADQAIVKTFEDGTT

SEQ ID NO: 15419 - protein, 136 aa, Conocephalum supradecompositum
MARTKQTARKSTGGKVPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 15420 - protein, 385 aa, Escherichia vulneris
RMSGIFRSVWLLHKPQARLSDVQLTPQLDARYRDAQLQVKLSVEAASEALAALEVEVALWDGKTRLASQRQPLGTPIIDERGSYGERAIINLDVERPRLWSAEQPHCYRAVVSLWRGETLLEAEGWDIGFRQVEIRDGLLLLNGKPLLIRGVNRHEHHHQRGQVVNEEDMVQDILLMKQNNFNAVRCSHYPNAPRWYELCNRYGLYVVDEANIETHGMVPMNRLSDDPAWLAAYSARVTRMVQSNRNHPSIIIWSLGNESGCGDNHQAMYQWLKHNDPSRPVQYEGGGADSSATDIICPMYARVERDQPFPAVPKWSIKKWIGMPGEQRPLILCEYAHAMGNSLGNFADYWQAFRDYPRLQGGFIWDWADQAIEKTFPDGSVGWA

SEQ ID NO: 15421 - protein, 572 aa, Chlamydomonas reinhardtii
  misc_feature (228)..(228): Xaa can be any naturally occurring amino acid
MSTGVDYLGHGAVKATEGPPVNPSGRKYPYELDSEGKAKSIPVWRFTNPHMGAFHLSWFAFFISFLATFAPASLLPIIRDDLFLTKAQLGNAGVAAVCGAIAARVLMGVFVDIVGPRYGTAATMLMTAPAVFCMALVTDFASFAAVRFFIGLSLCMFVCCQFWCGTMFNVQIVGTANAIAGGWGNMGGGACHFIMPLIYQGIKDGGVPGYQAWRWAFFVPAVFYIATXLATLALGIDHPSGKDYRDLKKEGALKSKGAMWPVIKCGLGNYRSWILALTYGYSFGVELTVDNIIVEYMFDQFGLSLTVAGALGGMFGMMNLFSRASGGMISDLIAKPFGMRGRICTLWIIQTLGGIFCVILGRVHNSLTSTIVIMIIFSIFCQQACGLHFGITPFVSRRAYGVVSGLVGAGGNTGAAITQAIWFAGTAPWQLTLTKYQGLEYMGYQTIGLTLALFFIWFPMWGSMLTGPREGATEEDYYIKEWSAEEVADGLHHTSLRFAMESRSQRGTRTSTQTKVMSVGDGAGSNKAEVVVVAAAQQGAVPMASVEEGSSGRSSSSGGHQQQDARARVQVS

SEQ ID NO: 15422 - protein, 121 aa, Zea mays
  misc_feature (7)..(7): Xaa can be any naturally occurring amino acid
ACESATXQLRSTGDVKVREATLKRLGATHARAGVADAHFEVVKTALLDTIRDAVPDMWTPEMKAAWEEAYDQLAAVIKEEMKNAAAAEEQTKNAATAAEETTNAAAAEEETTNAAAAVDAS

SEQ ID NO: 15423 - protein, 58 aa, Oryza officinalis
KGKLPKDARQQLLNWWELHYKWPYPSESQKVALAESTGLDLKQINNWFINQRKRHWKP

SEQ ID NO: 15424 - protein, 564 aa, Oryza sativa
MEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRVGPFTVPPASLATFNVVAVLIWVPVYDAVLVPLARRATGNDRGLSHLQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVSVLNLLQFLHCSIRDRGQ

SEQ ID NO: 15425 - protein, 136 aa, Conocephalum supradecompositum
MARTKQTARKSTGGNAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 15426 - protein, 738 aa, Nicotiana tabacum
MDCNCFDPQWPADELLMKYQYISDFFIAVAYFSIPIELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRTLALEECALWMPTPPGLELQLSYTLRHQNPIGFTVPIQLPVINQVFGTNRAVKISPNSPVARLRPAGKYMPGEVVAVRVPLLHLSNFQINDWPELSTKRYALMVLMLPSGSARQWHVHELELVEVVADQVAVALSHAAILEESMRARDLLMEQNVALDLARREAEMAVRARNDFLAVMNHEMRTPMHAIIALSSLLQETELTPEQRLMVETILKSSNLLATLINDVLDLSRLEDGSLQLDVGTFNLHVLFRKVLNLIKPIASVKNCLSRLTCLQICPEFAIGDEKRLMQILLNVVGNAVKFSKEGSVSISAVAAKSESLSDPRAPEFFPVQSENHFYLRVQVKDTGSGINPQDIPKLFCKFAQNQALATKSSGGTGLGLAISKRFVNLMEGHIWIESEGLGKGSTAIFIVKLGIPGRSNEPKLPFMPRLPANHMQMTFQGLKVLIMDDNGFSRMVTKGLLVHLGCDVTTVSSGDECLRVLTQEHKVVFMDVSIPGIDCYEVAVQIHEKFGKHHNRPLIVALTGNTDRVTKENCMRVGMDGVILKPVSVDKMRSVLSELLEHGVILQS

SEQ ID NO: 15427 - protein, 136 aa, Conocephalum supradecompositum
MARTKQTARKSTGGKAPGKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 15428 - protein, 498 aa, Porphyromonas gingivalis
MKNKERKLKSWQGWLIFSSSMVVVFCLGLLAASVTERRAEIQSIYANKKDKIAPFEARNEMYRGNYPREYETWTYTADTSFRSEFNGSQAIDVLEQRPNMVIFWAGYAFSRDYTSPRGHMHAIQDMQRTLRTGNPGIDGAGDMQPATCWVCKSPDVPRMMQAIGVDEFYKNKWSSLGSDIVNPIGCADCHDPETMDLHISRPALIEAFQRRGLDITKASHQEMRSLVCAQCHVEYYFKGEGKYLTFPWDKGMTMEDAERYYDEAEYYDYIHTLSRAPILKAQHPDFEISQHGIHAQRGVSCADCHMPYISEGGVKFSDHHITSPLAHMDRTCQTCHRESEEELRKNVYERQRKANEVRNQLENELAKAHLEAQFAWDKGATEKEMTPILKYIRQSQWRWDYGVASHGASFHAPQEITRILSNGLERAMQARIEIARVLARHGYTDEVPLPDVSTKEKAQKYIGLDMDGLHKNKEKFLETVVPKWVKKAKGKGLLIAAK

SEQ ID NO: 15429 - protein, 941 aa, Mycobacterium tuberculosis
MSDHSTFADRHIGLDSQAVATMLAVIGVDSLDDLAVKAVPAGILDTLTDTGAAPGLDSLPPAASEAEALAELRALADANTVAVSMIGQGYYDTHTPPVLLRNIIENPAWYTAYTPYQPEISQGRLEALLNFQTLVTDLTGLEIANASMLDEGTAAAEAMTLMHRAARGPVKRVVVDADVFTQTAAVLATRAKPLGIEIVTADLRAGLPDGEFFGVIAQLPGASGRITDWSALVQQAHDRGALVAVGADLLALTLIAPPGEIGADVAFGTTQRFGVPMGFGGPHAGYLAVHAKHARQLPGRLVGVSVDSDGTPAYRLALQTREQHIRRDKATSNICTAQVLLAVLAAMYASYHGAGGLTAIARRVHAHAEAIAGALGDALVHDKYFDTVLARVPGRADEVLARAKANGINLWRVDADHVSVACDEATTDTHVAVVLDAFGVAAAAPAHTDIATRTSEFLTHPAFTQYRTETSMMRYLRALADKDIALDRSMIPLGSCTMKLNAAAEMESITWPEFGRQHPFAPASDTAGLRQLVADLQSWLVLITGYDAVSLQPNAGSQGEYAGLLAIHEYHASRGEPHRDICLIPSSAHGTNAASAALAGMRVVVVDCHDNGDVDLDDLRAKVGEHAERLSALMITYPSTHGVYEHDIAEICAAVHDAGGQVYVDGANLNALVGLARPGKFGGDVSHLNLHKTFCIPHGGGGPGVGPVAVRAHLAPFLPGHPFAPELPKGYPVSSAPYGSASILPITWAYIRMMGAEGLRAASLTAITSANYIARRLDEYYPVLYTGENGMVAHECILDLRGITKLTGITVDDVAKRLADYGFHAPTMSFPVAGTLMVEPTESESLAEVDAFCEAMIGIRAEIDKVGAGEWPVDDNPLRGAPHTAQCLLASDWDHPYTREQAAYPLGTAFRPKVWPAVRRIDGAYGDRNLVCSCPPVEAFA

SEQ ID NO: 15430 - protein, 736 aa, Solanum lycopersicum
MDCNCFDPLLPADELLMKYQYISDFFIAVAYFSIPIELVYFVQKSAVFPYRWVLVQFGAFIVLCGATHLINLWTSTPHTRTVAMVMTTAKFSTAAVSCATAVMLVHIIPDLLSVKTRELFLKNKAAELDREMGLIRTQEETGRYVRMLTHEIRSTLDRHTILKTTLVELGRALQLEECALWMPTRTGVELQLSYTLHHQNPVGFTVPIQLPVINQVFSANCAVKISPNSAVARLRPTRKYIPGEVVAVRVPLLHLSNFQTNDWPELSPKSYALMVLMLPSNSARQWHVHELELVDVVADQVAVALSHAAILEESMRARDLLIEQNVALDLARREAETAVRARNDFLGVMNHEMRTPMHAVVALSSLLQESELIPEQRLMVETILKSSNLLATLINDVLDLSRLEDGSLQLDVGTFNLHALFREVLNLIKPVAAVKKLFVTLSLSSDFPEVAIGDEKRLMQILLNVVGNAVKFSKEGSVSVSAVNAKSESLIDPRAPEFFPVQSENHFYLRVQVKDTGSGINPQDFPKLFCKFAQNQEPATKNSAGTGLGLAICKRFVNLMEGHIWIESEGVGKGSTAIFIVKLGIPGRLNESKLPFTAGLPANHMQMTFQGLKVLVMDDNGFSRMVTKSLLVHLGCDVTTIGSGDECLRILTREHKVLIMDASITGMNCYDVAVSVHEKFGKRLERPLIVALTGNTDQVTKENCLRVGMDGVILKPVSIDKMRSVLSGLLEHGTVL

SEQ ID NO: 15431 - protein, 301 aa, Triticum aestivum
MASAAYLDDIDAEVIDPPKIEMLDVTELVGDLIEHSPKPNVIVSSNVRELLECPVCLVAMYPPIHQCSNGHTICSGCKPRVHNRCPTCRSELGNIRCLALEKVAASLEVPCKFQNFGCVGIYPYYCKLKHESQCQYRPYTCPYAGSECTVTGDIPYLVNHLKDDHKVDMHSGSTFNHRYVKSNPHEVENATWMLTVFSCFGQYFCLHFEAFQLGMAPVYIAFLRFMGDDAEAKNYTYSLEVGGINRKMTWQGIPRSIRDSHRKVRDSYDGLIIQRNMALCFSGGDRKELKLRVTGRIWKEQ

SEQ ID NO: 15432 - protein, 199 aa, Burkholderia thailandensis
MFHSYWHPRRDRSPNLMNREEALHIFQHSEEIVSAGEVNGSIGRMAEEIRGQIGEEFPLVLSVMGGAAVFTGMLLPHLDFPLEFDYIHLTRYRNTTKGSPEMHWRVAPRESVKDRIVLVLDDILDEGETMAAIRDRILEMGAKRFLSAVLCEKTLAKAKPLHPDFCGFAVPDRYVFGCGMDAKGYWRNLPTIRALTADV

SEQ ID NO: 15433 - protein, 735 aa, Brassica oleracea
MEVCNCIEPQWPADELLMKYQYISDFFIAVAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQHPVEYTVPIQLPVINQVFGTSRAVKISPNSPVARLRPVSGKYLLGEVVAVRVPLLHLSNFQINDWPELSTKRYALMVLMLPSDSARQWHVHELELVEVVADQVAVALSHAAILEESMRARDLLMEQNVALDIARREAETAIRARNDFLAVMNHEMRTPMHAIIALSSLLQETELTPEQRLMVETVLKSSSLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDNRAPPDFFVVPTGSHFYLRVKVKDLGAGINPQDIPKLFTKFAQTQSLATRSSGGSGLGLAISKRFVNLMEGNIWIESEGVGKGCTAIFDVKLAISNESKQSGIPKVPANPQHVNFAGLKVLVMDENGVSRMVTKGLLVHLGCEVTTVSSNEECLRVVSHEHRVVFMDVCTPGVENYQIALRIHEKFTKRHQRPLLVALTGNTDKSTKEKCMSFGLDGVLLKPVSLDNMRNVLSDRLEHRVLYEAM

SEQ ID NO: 15434 - protein, 500 aa, Rhodopirellula baltica
MTLGSESRGIGDLPFTPRNAWERPSRRRAEWIVRCWSAHPTSRLTLAPQNALITPPHQRRSAAMAFILLTLLIDILAIGIIIPVLPELIKEFVGGDTSRASWYVGVIGATYSLMQFFFAPVLGALSDRFGRRPVILASLFGLGVDFIVTGLAPTVGWLFVGRIVAGVMGASFSTANAYIADVSTQETRARNFGLVGMMFGLGFIIGPALGGVLGGIHIRLPFFVAAGLSLVNWLYGFFVLPESLPPEKRGSISLAAMNPLGTIARLRNYPMIAGLAVAFMFSSLAQRGLENVWVLSMGYRFGWNEVTNGLTLALVGLMAAIVQGGMVRPTIKRLGERRTAVLGTCVSCLAFLGYGLASQGWMIPCIVVFGSLAGLAGPAIQSLVAGRVSPEEQGKVQGALTSLISLTNIPAPLLFTSGLLGYFTSDRAPFEFPGAPFVFGSLLLAIAVIVLARVFIKFPASGDPVGDPNAIVPADQPPTELDSGDENDAEPTQSPALGST

SEQ ID NO: 15435 - protein, 741 aa, Unknown
  Malus x domestica
MLACNCIEPQWPADELLMKYQYISDFFIALAYFSIPLELIYFVKKSAVFPYRWVLVQFGAFIVLCGATHLINLWTFSIHSRTVAMVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGYTVPIHLPVINQVFSSNRAVKISANSPVAKLRQLAGRHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTAEQRLMVETILRSSNLLATLINDVLDLSRLEDGSLQLEIATFNLHSVFREVHNMIKPVASIKRLSVTLNIAADLPMYAIGDEKRLMQTILNVVGNAVKFSKEGSISITAFVAKSESLRDFRAPDFFPVQSDNHFYLRVQVKDSGSGINPQDIPKLFTKFAQTQALATRNSGGSGLGLAICKRFVNLMEGHIWIESEGLGKGCTATFIVKLGFPERSNESKLPFAPKLQANHVQTNFPGLKVLVMDDNGVSRSVTKGLLAHLGCDVTAVSLIDELLHVISQEHKVVFMDVSMPGIDGYELAVRIHEKFTKRHERPVLVALTGSIDKITKENCMRVGVDGVILKPVSVDKMRSVLSELLEHRVLFEAM

SEQ ID NO: 15436 - protein, 359 aa, Magnetospirillum magnetotacticum
MIAAGLALGVANSPQSEVYFASLQASYLGLSILHWINDGLMAVFFLLVGLEIKREVLVGQLSTWPQRALPGVGALGGMAAPALVYLAFNGASPLAIRGWAIPTATDIAFALGVLALLGSRVPASLKVFLTALAIMDDLGAVLIIALFYTAQLSWLALGLAAVLLGGLVFLNRTGVRVLWPYLLLGAGLWVAMLQSGIHATIAGVVLAMTIPMGEGEGAPLLRLEHGLAKWVGYGVVPIFGFANAGVSFSGLDPSVIFGGVPVGISLGLFLGKQFGVFAAIWCAIRFKLAVCPDGASLSQLYGIAVLCGIGFTMSLFIGALAFAGHSDMTNAVKIGVLAGSGLSAILGSAILLRCTRVSS

SEQ ID NO: 15437 - protein, 740 aa, Cucumis melo
MENCYCIEPQWPADELLMKYQYISDFFIALAYFSIPLELIYFVKKSAVFPYRWVLVQFGAFIVLCGATHLINLWTFTMHSRTVAVVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPINLPVISQVFSSNRALKISPNSPVASLRPRAGRYVAGEVVAVRVPLLHLSNFQINDWPELSTKRYALMVLMLPSDSARQWRVHELELVEVVADQVAVALSHAAILEESMRARDLLMEQNVALDLARREAETAIRARNDFLAVMNHEMRTPMHAIIALSSLLQETELTPEQRLMVETILKSSNLLATLINDVLDLSRLEDGSLQLDIGTFNLHAVFKEVLNLIKPVTLVKKLSLTLHLGPDLPVFAVGDEKRLMQAILNVVGNAVKFSKEGSISISAIVAKSETFREIRVPDFHPVPSDSHFYLRVQVKDTGSGISPQDIPKLFTKFAQTTVGPRNSGGSGLGLAICKRFVNLMEGHIWLESEGLGKGCTATFIVKLGIADQSNESKLPYTSKIHENSIHTSFPGLKVLVMDDNGVSRSVTKGLLVHLGCEVTTAGSIEEFLRVVSQEHKVVFMDICTPGVDGYELAIRIREKFAKCHERPFMVVLTGNSDKVTKESCLRAGMDGLILKPVSIDKMRSVLSELIERRVLFETS

SEQ ID NO: 15438 - protein, 754 aa, Solanum lycopersicum
MGSLLRMNRLLSSIVESCNCIIDPQLPADDLLMKYQYISDFFIALAYFSIPVELIYFVKKSAVFPYRWVLVQFGAFIVLCGATHLINLWTFNMHTRNVAIVMTTPKALTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNHVVKISPNSPVARLRPAGKYMPGEVVAVRVPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLQLDIGTFNLHALFREVHSLIKPIASVKKLFVTLSLSSDLPEYVIGDEKRLMQILLNVVGNAVKFSKEGNVSISAFVAKSDSLRDPRAPEFFAVPSENHFYLRVQIKDTGIGITPQDIPNLFSKFTQSQALATTNSGGTGLGLAICKRFVNLMEGHIWIESEGLGKGSTAIFIIKLGIPGRANESKLPFVTKLPANHTQMSFQGLKVLVMDENGVSRMVTKGLLTHLGCDVTTVGSRDECLRVVTHEHKVVIMDVSMQGIDCYEVAVVIHERFGKRHGRPLIVALTGNTDRVTKENCMRVGMDGVILKPVSVYKMRSVLSELLEHGVVLES

SEQ ID NO: 15439 - protein, 554 aa, Suaeda corniculata
MLSQLSSFFASKMDMVSTSDHSSVVSMNLFVALLCGCIVIGHLLEKNRWMNESITALLIGLSTGIIILLISGGKSSHLLVFSEDLFFIYLLPPIIFNAGFQVKKKQFFRNFITIILFGAVGTLVSFIIISLGSIAIFQKMDIGSLELGDLLAIGAIFAATDSVCTLQVLNQDETPLLYSLVFGEGVVNDATSVVLFNAIQNFDLTHIDHRIAFQFGGNFLYLFFASTLLGAVTGLLSAYVIKKLYFGRHSTDREVALMMLMAYLSYMLAELFYLSGILTVFFCGIVMSHYTWHNVTESSRVTTKHAFATLSFVAEIFIFLYVGMDALDIEKWRFVSDSPGTSVAVSSILLGLLMVGRAAFVFPLSFLMNLSKKSNSEKVTFNQQIVIWWAGLMRGAVSVALAYNQFSRSGHTQLRGNAIMITSTITVVLFSTMVFGLLAKPLILFMLPQPKHFTSASTVSDLGSPKSFSLPLLEDRQDSEADLGNDDKEAYPRGTIARPTSLRMLLNAPTHTVHHYWRRFDDYFMRPVFGGPGFVPFVPGSPTEQSTANLTQRT

SEQ ID NO: 15440 - protein, 309 aa, Prochlorococcus marinus
MTATISRPTISNWETSDIPNLNGKTALITGANSGLGYYTAKALAEKNAHVILACRSLEKANKSIQKLRASNPEGIFSPLELDLSDLNNVVEIQPKIFDDFENLDLLINNAGIMHPPKTLSAQGYEIQFAVNHLAHMLLTLKLLPIIEKKEESRIVTVTSGAQFFGKVGWKNLKAENYYNKWESYSNSKLANVMFALELNENLKPKNILSLAAHPGIAKTNLFTAQKPKPSPIETFSMELFSPIFQSAEMGALPQLFAATSPEARGGDHYGPKFNFRGYPKLSPTSPVAINKKERKNLWEKSLQILSNFL

SEQ ID NO: 15441 - protein, 255 aa, Unknown
  uncultured bacterium 439
MKIATISLNIAWQDIEKNLERTEKFVRQAKADGCDVVVLPEVFNTGFIADVGKYAELPNCKTHHALQQFALNNLINIVAGASEKQPNEKAHNIALVFDSHGNEVAKYSKLHPFNYANEGKYFTSGNETIKFELDGVACSVFICYDLRFPEIFRQIAEEVEVIFVIANWPHTREMHWQNLLIARAIENQCFIVGVNRIGNDGVGLKYNGSSMVINPLGEVLLQTDKKTEYASCDIDTLMVSKTRKDFPFLEDIRFI

SEQ ID NO: 15442 - protein, 272 aa, Nephroselmis olivacea
MATLEQMLDVGVHFGHQARKWNPKMAPYIFGERKGIHILDILQTAILLDKARVYARRQAASNGSFLFVGTKNQAASIVRFAAERCQKNDRSQAHYVNHRWLGGMLTNWPTMQLCIKRLLELESNHERGGFQQFPKKEAAVARKQLARLEKHLGGVKNMTGLPTTVVIVGQPQEMNAVRECEKLGIPMITMLDSDCNPLLTDIGIPSNDDSIASIELVMREITKGIEEGQWIQKEGREEATIEIEWFVVEPTPVEKPLVIIEPPPVEKPVLSK

SEQ ID NO: 15443 - protein, 127 aa, Brassica napus
  misc_feature (69)..(69): Xaa can be any naturally occurring amino acid
  misc_feature (78)..(78): Xaa can be any naturally occurring amino acid
DEHCKRYMFMTEEDITSLPCFQNQTLLAIKAPTASCIEVPDPDEVMSFPQRQYRMVIRSRMGPIDVYLXRTKHGCSKXKGDSSMETDESAVDTSSLKIVTSDTDLKTDYWFESGEEVTLTDLWNNFC

SEQ ID NO: 15444 - protein, 365 aa, Nocardia farcinica
MSAPVQTARTRPARHRAFHDLRVADVERLCDDAVAVTLDVPAELAEEFAFRPGQSLTVRRVLDGVEHRRSYSICAPVGAPPRIGVRRVAGGAVSTWLVDQLRPGDRIEVQGPSGTFAADPDAGGRHLLIAAGSGITPMLSIAASVLAHPDSEVVLLYGNRRVRSVMFVDEIADLKDRYGDRIEVVHVLSREPRDVELFTGRLDAERLRAILSTVVPIGDIDHAWLCGPFGMVTDARAVLAEFGVAPERVHFELFFVEDAPPPQAEHREPGVEGPTSSVTVVLDGRSTTGLLPRDRSILDAAEQIRSDLPFACKGGVCGTCRAKITGGEADMRRNYALEDAEVADGFVLTCQTYPVSDSVVVDFDA

SEQ ID NO: 15445 - protein, 282 aa, Perilla frutescens
GSWRSLPKLAGLLRCGKSCRLPWTNYLRPDIKRGPFSTEEEKLVIQLHGILGNRWAAIASQLPGRTDNEIKNLWNTHLKKRLLLMGIDPHTHEPSLTSNGLLTRPPSSPSTRHMAQWESPRLDAEARLSKESLLSIHAPLPKSEADHFLRLSNSEVGETFRKIKNGEKAEPPSPSQSPGSSASTKCCSFSGTTTEIGLQSGLHETDCKSSKTCTEYVRTGTDSSSSNEMEDSSESTLQLLLDFPCKNDMSFLGNADCYSLYPGFTNGSLYDSSSQEKKGGFV

SEQ ID NO: 15446 - protein, 450 aa, Bacillus cereus
MSTHVTFDYSKALSFIGEHEITYLRDAVKVTHHAIHEKTGAGNDFLGWVDLPLQYDKEEFARIQKCAEKIKNDSDILLVVGIGGSYLGARAAIEMLNHSFYNTLSKEQRKTPQVLFVGQNISSTYMKDLMDVLEGKDFSINVISKSGTTTEPALAFRIFRKLLEEKYGKEEARKRIYATTDKARGALKTLADNEGYETFVIPDDVGGRFSVLTPVGLLPIAVSGLNIEEMMKGAAAGHDDFGTSELEENPAYQYAVVRNALYNKGKTIEMLVNYEPALQYFAEWWKQLFGESEGKDQKGIFPSSANFSTDLHSLGQYVQEGRRDLFETVLKVGKSTHELTIESEENDLDGLNYLAGETVDFVNTKAYEGTLLAHSDGGVPNLIVNIPELNEYTFGYLVYFFEKACAMSGYLLGVNPFDQPGVEAYKKNMFALLGKPGFEELKAELEERLK

SEQ ID NO: 15447 - protein, 99 aa, Fremyella diplosiphon
MATYQVRLINKKEDLDSTIEIDEDTTILEGAAENGIELPFSCHSGSCSSCVGKVVEGEVDQSDQIFLDDEQMSKGFALLCVTYPRSNCTIKTHQEPYLV

SEQ ID NO: 15448 - protein, 763 aa, Mycobacterium tuberculosis
MPPVPAPRALAPLPPAPPAPAEPKSKPPFPPAPPAPPCWMLVSAAPPCPPAPPAPPKPKSKAPFPPVPPAPPARELAPPLPPAPPEAPRESRPALPPCPPPPVVIPDPPEPAAPPVPPAPNSPPFPPFPPAPKFVPAPPVPPVPNSPPFPPFPPAALNPPAPPAPPLANSPPLPPAPPTPAGTPPAAPWPPVPAAPKSKPASPPRPPAPPMPATPMEFPPLPPVPPDPISKETPPAPPAPPIPPAPVPIPPVPPLPPVPNKIPPAPPAPPVAVAAVLVAPCPPLPPLPNNHPPAPPAAPVPGVPLAPLPNSHPPAPPSAPVPGVPLAPLPISGRPVSVWKGSFTTLSTFCCRVCSGEVLAGALNPSRPSRSPLTTTTPALPAPIPPLPPLPPLPINTAVPPIPPLPPVTALAPPLPPLAPLPISPGVPPAPPIPPGKPWTTPPLAPAPPEPKTVPVLPPGPSCPPSEKPNPPAPPEPPEPKSSPALPPAPPAPSMPSAVRVPPSPPIPPAPPAAPRASMPALPPAPPSPPATRLCPPLPPSPPAPNSPPAPPAPPTPPKLLSANPPCPPVPPAPNRPPAPPAPPAPPELPAPPDPPTPPVANSPPAPPAPPAPPSALPFVNPPAPPTPAAPKSRPALPAAPPAPPAPPVRATTPPPAPPAPPAPNSMALPPAPPDPPIPLLATPPAPPAPPLPMSPPAPPLPPAAPDPPAPPLTINQPPSPPLAPVPGAPLAPLPINGRPVFARKNSLIGSSSGDTAAASAAA

SEQ ID NO: 15449 - protein, 369 aa, Trichodesmium erythraeum
MNTIVIKIGTSSLTNSETGNLALSTISSLIETIINLRQQGYQVVLVSSGAVGVGCDILGLTKKPRNISMKQAIAAVGQGQIMRVYNDLFSSLQQTVAQILLTKSDLSRRSSYVNAYNTFQQLFRLGVVPIVNENDTTAVEELNFGDNDTLSALVASLVEADWLFILTDVDRLYSADPRKNPDALPITLVGEIEQLKELKVQVGESVSGRGTGGMVTKIEAAKIATSAGVRTVITDGKVPTNIQKILNGESIGTQFEPQPEQVNGRKHWIANVLVPAGQLYLDQGAVKAISEYGKSLLAAGIIQVEGEFNSSDAVKLCNEKGQEIARGLVNYSSIELQKILGCRSENISDILGYVGAETVVHRNNLLLTN

SEQ ID NO: 15450 - protein, 374 aa, Escherichia fergusonii
LAIRHVNTHFNDDFSRAALEAEVRINSDDVREQLVTVQLWQGETLIDEETAPPGSEIIDERGAYNDRVTLRLSVERPALWSAETPNLYRVVFLLQTADGTLIEAEACDVGFRQVKIENGLLLLNGKPLLIRGVNRHEHHPLHGQVMDRETMLQDILLMKQNNFNAVRCSHYPNHPLWYTLCDQYGLYVVDEANIETHGMVPMNRLSDDPQWLPAMSQRVTRMVQRDRNHPCIIIWSLGNESGHGANHDALYRWVKSTDPSRPVQYEGGGANTAATDIICPMYARVDEDQPFPAVPKWSIKKWLSLPGEQRPLILCEYAHAMGNSLGGFSKYWQAFRQYPRLQGGFVWDWVDQSLIKYDEEGHPWSAYGGDFGDT

SEQ ID NO: 15451 - protein, 262 aa, Rickettsiella grylli
MSATATLRQLFEAGVHFGHRTCFREPKMMPYIYGVRNGISIIDLEKTREYITEALHYIAKIAARPGSKILFVGTKRAARDLVKEQALRCGMPYVNHRWLGGLLTNYRTIRQSIKRLKELELQSKDGRFNQLTKKEALNLQRQMDKLERSLGGIKDMSGLPDVLFVIDRGYEHIAICEAQKLKIPVISIVDTNHSPEGIDYVIPGNDDASRAITLYTQMVSETILEARAEAKKRADLTRAEAENGENQVPERASTKSSEEKQE

SEQ ID NO: 15452 - protein, 126 aa, Myxococcus xanthus
MSVTAEKSVYEQLGGEPAMAAAVEVFYRKVLADDHISHFFEDVDMERQAAKQKAFLTMVTGGPVHYSGKDMRAGHAPLVKRGLNDSHFDAVAGHLKATLEELGVAAPLVARVMTIAESARADVLGR

SEQ ID NO: 15453 - protein, 103 aa, Saccharomyces cerevisiae
MSGRGKGGKGLGKGGAKRHRKILRDNIQGITKPAIRRLARRGGVKRISGLIYEEVRAVLKSFLESVIRDSVTYTEHAKRKTVTSLDVVYALKRQGRTLYGFGG

SEQ ID NO: 15454 - protein, 813 aa, Citrobacter freundii
LLHKPTTQIRDLRINTRFNDDFSRAVLAVEVRVAGNESEDLRVALQLWEGETLTAETNSPLGSEIIDERGAYHDRVTLCLNVEKPALWSAETPNLYRAVVQLRTADGALIEAEACDVGFRQVCIENGLLLLNGKPLLIRGTNRHEHHPINGQVMDEATMVQDIILMKQNNFNAVRCSHYPNHSLWYTLCDRYGLYVVDEANIETHGMVPMNRLTDDPAWLPAMSQRVTRMVQRDRNHPSIIIWSLGNESGHGVNHDALYRWIKSEDPSRPVQYEGGGANTAATDIICPMYARVDQDQPFPAVPKWSIKKWLSMPGEHRPLILCEYAHAMGNSFGGFAKYWQAFRQYPRLQGGFVWDWVDQSLTKYDENGKAWSAYGGDFGDTPNDRQFCMNGLVFADRTPHPALYEAKHEQQFFQFTLLPGTERQIEVTSEYLFRRSDNEVLHWSIAQDGNPLAAGEIVLDIAPQGRQVITLPDVPMPETAGQLWLTVRVEQPQATAWSDAGHISAWQQWKLQEKLSLTQLPSAHTAPQLNVSENVFTVENDNKRWQFDRQSGLLTQYWIGDSVQLLTPLTDQFTRAPLDNDIGVSESTRIDPNAWVERWKAAGHYQAEATLLHCAADTLSDAVLITTEHAWQYQGETLFISRKSYRIDGKGEMQITVDVDVASGTPHPARIGLSCQLVQIAERVNWLGLGPHENYPDRLGAACFDRWDLSLDEMYTPYVFPSENGLRCGTRELHYGAHQWRGDFLFNISRFSQQQLIATSHRHLLQPEAGTWLNIDGFHMGVGGDDSWSPSVSPEFLLSAGRYHFQFVWGQK

SEQ ID NO: 15455 - protein, 136 aa, Saccharomyces cerevisiae
MARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKDIKLARRLRGERS

SEQ ID NO: 15456 - protein, 194 aa, Xylella fastidiosa
MNMLNVLRFPVLALALALAFVSSGVLADAGSLLDLDYRPLAGKETVNLQRLYGGKVLLVVNTASKCGFTPQYEGLEALHQKLSPLGFAVLGFPSNDFKGQEPGDEQQIQKFCTLTYGVKFPMFQKVHVKGDEVTPLYQRLTQTTGVAPGWNFHKYLIARDGHVVAQFDSRTRPDDPILLEAIKRELAKPVQVAH

SEQ ID NO: 15457 - protein, 823 aa, Citrobacter freundii
RMSGIFRDVSLLHKPTTQIRDLRINTRFNDDFSRATLETQVRVADNESEDLRVTLQLWDGETLTHETTSPLGSEIIDERGAYHDRVTLRLNVENPALWSAETPNLYRAVVQLRTADGALIEAEACDVGFRQVRIENGLLLLNGKPLLIRGTNRHEHHPVNGQVMDEATMVQDILLMKQNNFNAVRCSHYPNHPLWYTLCDRYGLYVVDEANIETHGMVPMNRLTDDPAWLPAMSQRVTRMVQRDRNHPSIIIWSLGNESGHGANHDALYRWIKSEDPSRPVQYEGGGANTTATDIICPMYARVDQDQPFPAVPKWSIKKWLSMPGEQRPLILCEYAHAMGNSFGGFAKYWQAFRQFPRLQGGFVWDWVDQSLIKYDENGKAWSAYGGDFGDTPNDRQFCMNGLVFADRTPHPALYEAKHVQQFFQFTLLPGPKRQIEVTSEYLFRHSDNEVLHWSIAQDGNPLAAGEIVLDIAPQSRQVITLPDVPMPETAGQLWLTVRVEQPQATAWSDAGHISAWQQWKLEEKLSLAPRPTARTAPQLNVSENTFTVEINDKRWQFDRQSGLLTQYWIGDAAQLLTPLTDQFTRAPLDNDIGVSESTRIDPNAWVERWKAAGHYLVEATLLHCAADTLSHAVLIATEHAWQYQGETLFVSRKSYRIDGNGEMQITVDVDVASGTPHPARIGLSCQLAQVAERVNWLGLGPHENYPDRLSAACFDRWDLSLDEMYTPYVFPGENGLRCNTRELRYGAHQWRGDFLFNISRFSQKQLMETSHRHLLQPEAGTWVNIDGFHMGVGGDDSWSPSVSPEFLLSAGRYHYQLVWGQK

SEQ ID NO: 15458 - protein, 260 aa, Unknown
  Nostoc sp. PCC 7120
MNRTDNQGQKGLGKVYLVGAGPGDPGLMTVKGKGILECADVVIYDALVSPAILAMINPQAEQINAGKRMGRHSLLQDETTQLLIEQAQNHAVVVRLKGGDPFIFGRGGEEMADLIAAGVPVEVVPGITSGIAAPAYAGIPLTHRLYSSSVTFVTGHESAGKYRPKVNWQAIAHGSETIVIYMGIHNLPYIVEQLKMAGLSLATPIALVRWGTRPEQEELIGELGTIVELVEKTGFEAPAIAVIGSVVNMHSILSVAARVN

SEQ ID NO: 15459 - protein, 136 aa, Conocephalum supradecompositum
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEETNLCAIHAKRVTIQSKEIQLARRLRRERN

SEQ ID NO: 15460 - protein, 136 aa, Conocephalum supradecompositum
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSPFEDTNLCAIHAKRVTIQSKDIQLARRLRGERN

SEQ ID NO: 15461 - protein, 953 aa, Bacteroides fragilis
MKYLTFPFLLLLLPLIGSGCSSEEKETDSLILSSDSEIFFEQGIDFAATSGTRNLSFSSGRPWRISLTTDTDTRRAADWCTVSPSSGTAGDASVTISIQENADYDSRSVKLTLVAGGIEKSFTVSQKQKDALTLTASRFEVGKEGGTVQVEVKANITFEVEIPEVDRSWISQANTRGLVVTNLAFTVAPNEGVAGREGEIVIRSGSLSEKIRITQEGRCDDGLSFRPETPDADRQLTLYFKATKTSPLYGYAGDVYVHTGVVSEGTWMYVPAEWNTNVDKCKMVRVADNIWSITLAPSIRQWFGSNETPVRQLGVVIRSADGSKKGTDGDSFVSVTDHLYKPFEPAAVRYASMPGGLQEGINLIDASTVTLVLYDKDKKGGHKDFAHVVGDFNDWKLSNESNSQMNRDDAAGCWWITLTGLQPTREYAFQYYVGTRAGEILRLADAYSRKILDPDNDKYIPSSTYPDAKEYPKGAVGIASVFKIQRDSYEWKVKNFRIPDKNNLMIYELLLRDFTATGDLNGAMEKIGYLKSLGFNAVELMPVQEFDGNDSWGYNPCFHFALDKAYGTDHMYKAFIDKCHEVGMAVLFDVVYNHASGSHPFARLYWDTKNNRTAADNPWFNVKEPHPYGVFHDFNHDSPLVRAFVKRNLKFLLEEYRIDGFRFDMTKGFTQNSSTEATAGSYDASRIAILKDYNETVREVNPEAVVILEHFCDEKEESELAEEGMQLWRNLNNAYCQSAMGYPSNSDFTPLVTFGTTMPYGGWVGFMESHDEERTAFKQIAYGEGPLKSDINVRMKQLAANASFFFTAPGPKMVWQFGEMGYDVSIEEGGRTGRKPLHWEYLDNEARKGLCNTYAKLLKLRREHSELFNPGSTFSWLVKTANWTGGRFLTLAATNGKRLVVVGNFTAKPIEAITSFPVTGVWTNYLDGTKLHVTSIPTGLMIPAHECRVYINF

SEQ ID NO: 15462 - protein, 823 aa, Unknown
  Serratia sp. MF 426
RMSGIFRDVSLLHKPTTQIGDLHVNSRFNDDFSRAVLEVDVRMAGEARDDLSVTLQLWQGETLEGATTSSFGSEIIDERGTYSDRTTLRLNVEHPMLWSAETPNLYRAVVQLHTVSGTLIEAEACDVGLRQIDIENGLLRLNGKPLLIRGTNRHEHHPENGQVMDKETMVQDILLMKQNNFNAVRCSHYPNHPLWYSLCDRYGLYVVDEANIETHGMVPMNRLSDDPTWLPAMSQRVTRMVQRDRNHPSIIIWSLGNESGHGANHDALYRWLKSEDPSRPVQYEGGGADTAATDIICPMYARVDQDQPFPVVPKWSIKKWLSMPGEQRPLILCEYAHAMGNSLGDYANYWQAFRQYPRLQGGFVWDWVDQSLLKYDEQGKPWAAYGGDFGDTPNDRQFCMNGLLFADRTPHPALYEAKHAQQFFQFRLLPGAERKIEVTSEYLFRHSDNEILHWSIAQDGNALATGAVTLDIASQGRQTITLPEVPMPDTAGQLWLTVRVEQPQATAWSQAGHISAWQQWALEEKLSVQSPSCASEAPQLTASETLFSVVLGDKRWEFCRQQGGLAQYWIGEQAQLLTPLIDQFTRAPLDNDIGVSEVTRIDPNAWVERWKAAGHYRAEAVLLQCDAEALSSAVLITTAHAWQYQGETLFISRKTFRINGQGEMQITVDVDVASGTPYPARIGLSCQLAQVAERVNWLGLGPHENYPDRLTAACFDRWERPLDEMYTPYVFPSENGLRCGTRELKYGVHRWRGNFQFNISRYSQQQLAETSHRHLLQPEAGTWLNIDGFHMGVGGDDSWSPSVSPKYLLSAGHYHYQFIWDQK

SEQ ID NO: 15463 - protein, 245 aa, Pseudomonas aeruginosa
MSGKVWLVGAGPGDPELLTLKAVRALQDADVVMVDDLVNPSILEHCPSARLVRVGKRGGCRSTPQDFIQRLMLRHARQGRSVVRLKGGDPCIFGRAGEEAEWLARHGIDSEIVNGITAGLAGATACGIPLTYRGISRGVTLVTAHTQDDSPLAWEALARSGTTLVVYMGVARLAEIQAGLLAGGMAEDTPLAMIENATLGNQRECRSNLGELLRDAGRFALKSPAILVIGEVTRDIVSQPISLSA

SEQ ID NO: 15464 - protein, 152 aa, Brassica napus
  misc_feature (112)..(112): Xaa can be any naturally occurring amino acid
  misc_feature (138)..(139): Xaa can be any naturally occurring amino acid
  misc_feature (143)..(143): Xaa can be any naturally occurring amino acid
  misc_feature (146)..(146): Xaa can be any naturally occurring amino acid
  misc_feature (149)..(149): Xaa can be any naturally occurring amino acid
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREYGXTPGYYDGRYWKMGKLSLVRDAPTPAXXVKEXPEXKTXYPN

SEQ ID NO: 15465 - protein, 908 aa, Pseudomonas aeruginosa
MSTDSPLRTTASTCCYCGVGCGVLIEHDGERILGVQGDPRHPANFGRLCSKGASLHLTGDLQARALYPQLRLGKQLARARSDWESALEHAAGRFAETIREHGPDSVAFYISGQLLTEDYYAFNKLARALVGTNNIDSNSRLCMSSAVVGYKRSLGADAPPCSYEDLDCADCVLIAGSNMAFAHPVLFRRLEAAKAARPEMRIVVIDPRRTDTCELADLHLALLPGTDVALFHGILHILLWEDWIDRSFIAEHTEGFADLKELVRDYTPAAVADICGIDRADLQRCAEWIGRSPRFLSLWCMGLNQSSAGSAKNSALINLHLATGKIGRAGCGPFSLTGQPNAMGGRETGSLANLLPGHREAADPGHRAEVAHYWGVEQLPTSPGLSAIELFDAVHDGRIKALWIACTNPAQSLPDQRKIHEALARCPFVVVQEAFAGTETCQYADLLLPAASWGEKEGSVTNSERRISHVRRAVPPPGEARQDWNIVCDFARRLEGHLRPAKPGLFAFADSRSLFDEYKLLTAGRDLDLSGLSYALLDRLGPQQWPFPTGAEQGTARLYADGRFPTASGRAQLVAEPYRAAQEKRDARYPLTLNTGRLRDQWHGMSRTGTCARLFGHEEEALVHLHPEELRRRQLLDGQLVRLKSRRGALVLPVSADDSVRPGQAFLPMHWGDRFLKGLGCNVLTLPAFDPLSKQPELKHAGVQVESVELPWRLFALVETDIQARFEALRALCEVFDHASFSLAGRERPALLVSAAHHEAPGADLLERIDRQLELLDGPILAYDDPRRAIGKRVRLEDGRIVAVRLAGETLARDWLKELWLTGRADSELRRWLLAPLGAAPGRPSQGAGGKTLCSCQNVSQQTVLGGIARGLDLDGLKREFGCGTGCGSCVPEIKRLLAAPRPMAANA

SEQ ID NO: 15466 - protein, 197 aa, Pinus koraiensis
MSKRYWNIDLEEMMEARVHLGHKTRKWNPKMAPYIFTERKDTHIINLAKTARSLSEACDLVFDIAGRGKQFLIVGTKYQATDLVASAATEARCHYVNRKWLGGMLTNWSTTETRLQKFKDLKKEQDTGRFNQLPKKEAAMLKRQLDQLQKYLGGIRYMRSLPDIAIITNQREESIALGECRTLGIPTICEGRALRSL

SEQ ID NO: 15467 - protein, 150 aa, Magnetospirillum magnetotacticum
MKIASSDGKAIKAAYNWIRSIVAEPEAGTIYDGTIVKIMEFGAFVNFFGAKDGLVHISELAAQRVAKVGDVVKEGQKVKVKFLGADERGKIRLSMKVVDQETGEDITERLKAERAERGEPEREERSDRGDRGDRGPRRDRGERRRESSGE

SEQ ID NO: 15468 - protein, 976 aa, Arabidopsis thaliana
MALFRDIVLLGFLFCLSLVATVTSEEGATLLEIKKSFKDVNNVLYDWTTSPSSDYCVWRGVSCENVTFNVVALNLSDLNLDGEISPAIGDLKSLLSIDLRGNRLSGQIPDEIGDCSSLQNLDLSFNELSGDIPFSISKLKQLEQLILKNNQLIGPIPSTLSQIPNLKILDLAQNKLSGEIPRLIYWNEVLQYLGLRGNNLVGNISPDLCQLTGLWYFDVRNNSLTGSIPETIGNCTAFQVLDLSYNQLTGEIPFDIGFLQVATLSLQGNQLSGKIPSVIGLMQALAVLDLSGNLLSGSIPPILGNLTFTEKLYLHSNKLTGSIPPELGNMSKLHYLELNDNHLTGHIPPELGKLTDLFDLNVANNDLEGPIPDHLSSCTNLNSLNVHGNKFSGTIPRAFQKLESMTYLNLSSNNIKGPIPVELSRIGNLDTLDLSNNKINGIIPSSLGDLEHLLKMNLSRNHITGVVPGDFGNLRSIMEIDLSNNDISGPIPEELNQLQNIILLRLENNNLTGNVGSLANCLSLTVLNVSHNNLVGDIPKNNNFSRFSPDSFIGNPGLCGSWLNSPCHDSRRTVRVSISRAAILGIAIGGLVILLMVLIAACRPHNPPPFLDGSLDKPVTYSTPKLVILHMNMALHVYEDIMRMTENLSEKYIIGHGASSTVYKCVLKNCKPVAIKRLYSHNPQSMKQFETELEMLSSIKHRNLVSLQAYSLSHLGSLLFYDYLENGSLWDLLHGPTKKKTLDWDTRLKIAYGAAQGLAYLHHDCSPRIIHRDVKSSNILLDKDLEARLTDFGIAKSLCVSKSHTSTYVMGTIGYIDPEYARTSRLTEKSDVYSYGIVLLELLTRRKAVDDESNLHHLIMSKTGNNEVMEMADPDITSTCKDLGVVKKVFQLALLCTKRQPNDRPTMHQVTRVLGSFMLSEQPPAATDTSATLAGSCYVDEYANLKTPHSVNCSSMSASDAQLFLRFGQVISQNSE

SEQ ID NO: 15469 - protein, 438 aa, Bacteroides fragilis
MKVKPDLSFWKLWNISFGFFGVQIAYALQSANISRIFATLGADPHSLSYFWILPPLAGIIVQPIIGAASDKTWTRFGRRIPYLFAGSLLAVWVMCLLPNAGSFGMAVGTAMIFGLVALMFLDTSINMAMQPFKMLVGDMVNEKQKGLAYSIQSFLCNAGSLMGYLFPFIFTFIGISNTADKGTVPDSVIYSFYIGAAILILCVIYTTVKVKEMPPKEFEEFHGITADEKKEKADFISLLKHAPKVFWTVGLVQFFCWAAFMYMWTYTNGAIAATVWGTTDVQSAGYQEAGNWVGVLFAVQAIGSVIWAVILPLFKARKQAYALSLVLGGIGFISTLFFHNEYLLFISYLLIGCAWAAMLAMPFTILTNSVSGKNMGAYLGLFNGTICVPQIAAALVGGGLLHLVGGHQVNMLVLAGVLLIAGAICVYFIKETMAHHEA

SEQ ID NO: 15470 - protein, 816 aa, Pseudomonas aeruginosa
MKKIKLVMVGNGMAGVRTLEELLKLNSDFYDITVFGAEPHPNYNRILLSPVLAGEQTFEEIVLNDLNWYAENGIKLLLDRKVVQIDRLRRRVVAADGSEAEYDRLLLATGSLPFILPIPGNRLQGVIGYRDIADTQAMIDCARTHSHAVVIGGGLLGLEAANGLKQRGMDVTVVHLSDWLLERQLDRTAGKLLQGALEARGIRFRLNTQTQELMDNGSGRVCAVQFNDGDVIPADLVVMAAGIRPNTELAESAGIPCNRGILVNDTLQTYDPRIYAVGECANHRGIAYGLVAPLFEQAKVCANHLAHLGYARYQGSVTSTKLKVTGIDLFSAGDFIGGEGSETITLSDPIGGVYKKLVIKDDVLVGACLYGDTADGGWYFRQIRENHNVAQIRDHLMFGENALGDVGHQGQNSAASMPDTAEVCGCNGVCKGTIVKAIQEHGLFSVDEVKKHTKAASSCGSCAGLVEQILISTVGGAADVKPKSEKAICGCSDLNHGQIRKAIREHRLTSLDAAMRFMDWKTPNGCATCRPALNYYLISTWPGEAKDDPQSRLINERAHANIQKDGTYSVVPRMWGGVTNAAELRRIADVADKYQVPMVKVTGGQRIDLLGVKKDDLPAIWKDLDMPSGHAYGKSIRTVKTCVGSEFCRFGTQNSTQLGIDLEHDLFNMWSPHKVKLAVSGCPRNCAEAGIKDVGIIGVDSGWEMYIGGNGGIKTEVAEFFVKLKTAEEVREYNGAFLQLYREEAFYLERTVHYLQRVGMEHIRKAVVEDAENRKALNDRLQFALSFEQDPWKQRIEQPQLKKEFERISLKQLENV

SEQ ID NO: 15471 - protein, 456 aa, Colwellia psychrerythraea
MKNILFIIALALISILTVYAVAPKSTEYSTTNSTINSTNTQSDIEKMMPKSSNSTKEMPATTHLDSIVLGAGCFWGAEKRYQAIPGVVDAISGYADGKNVSASYREITQRKNKYNEDNHAEVVKVIFNSAKVSLETILQSYYEGHDPTQLNRQGNDIGTQYRSTILTSNEQQNDIAQKVTAQYQTLLNDAGYGNIATKISSLSKFFEAEQYHQDYLAKNPNGYCPDHSTGVKFDADASKPGLASQKIDNTPLLTGKHIIVIESENYCPYCEKFKKNVANDYKGSIAINFRLASQLKGLTIKTETWATPTIIFIEDGEEVFGKQGYMSPDYFYKALGAFKLGKSEAFNVAFDEGTDSRFCKEYEIFKNTPDGVFIDKLSGAPLFDTDDRFNSASGWLSFTKAVDGSVIEKPDNRYGMVRTEIRSKTSGIHLGHVFPDGPNGQPRFCINATVLEFKAR

SEQ ID NO: 15472 - protein, 380 aa, Geobacillus stearothermophilus
MAKRDYYEILGVSKNATKEEIKKAYRKLSKKYHPDVNKEPDAAEKFKEIKEAYEVLSDDQKRAHYDQFGQADPNQGFGGFRSDDFDLGGFSGFGGFEDIFNTFFGGGRRRNPNAPRAGADLQYTMTLTFEEAAFGKETDIEIPSEETCNTCHGTGAKPGTKPETCPHCHGAGQISTEQSTPFGRIVNRRTCPYCGGTGQYIKEKCTTCGGTGRVKRRKKIHVKIPAGIDDGQQLRVAGQGERGLTVGRREIYILSFMWSRMSFLNVTAMIFIAKCRLRLRKLRLGMKSKSRPFTGKLKLKIPAGTQTGTRLRLKGKGVPNVRGYGYGDQHVIVRVVTPTKLTEKQKQLLREFDQLGGSSMHHEPHDRFFDKVKKAFKPES

SEQ ID NO: 15473 - protein, 98 aa, Chlorogloeopsis sp.
ATYKVTLINDAEGLNQTIEVDDDTYILDAAEEAGLDLPYSCRAGACSTCAGKIKSGTVDQSDQSFLDDDQIEAGYVLTCVAYPTSDCTIETHKEEELY

SEQ ID NO: 15474 - protein, 315 aa, Mycoplasma pneumoniae
MLKVKSDFLTKDQVIYDVAIVGAGPAGIAAGIYGKRANLNLAIIEGSTPGGKVVKTNIVENYPGYKSITGPDLGLEMYNHLIDLEPTFFYANLIKLDKAADTFILYLDDKTVVFAKTVIYATGMLERKLGVAKEDHFYGKGISYCAICDGSLYKDQVVGVVGGGNSAIQEALYLASMAKTVHLIHRREGFRADETALNKLRNLPNVVFHLNYTVKELLGNNTLNGIVLQNTLDHSTKQIDLNCVFPYIGFESITKPVEHLNLKLDPQGFLITNEQMETSLKGLFAAGDCRSKHFRQIGTAINDGIIAVLTIRDVL

SEQ ID NO: 15475 - protein, 568 aa, Aspergillus parasiticus
MATQHKTQSSPVNAAWWKKASVYQIYPASFKDSNGDGIGDIPGIISELDYLKALGIDLVWLSPILQSPQVDMGYDVSDYYQIHPPYGTVEDVDALIQGLHQRGMRYVMDLVVNHTSDQHEWFKQSRSSSDNEYRDWYIWKKPKYDANGVRQPPNNWSAYFGGSAWQYDETTDEYYLHLFAPEQPDLNWENPKVRSAVHQIMRYWLDKGVSGFRMDVINMISKDQSFPDAPITDPKAQWQHGADVLLLRTTSSRIPARAGEGSEGIRCLFLGFDRGELAMAFQFEIMDIDHGPGGKFSPHKYRMSDLKHIVSKWQDFMYENEGWNALYLENHDQGRTISRFTSAGPEYRATAGKMLATFLGLQGGTPFVYQGQEIGLGNVPETWGIEQFRDIETLNYWNEIEREMAAYPNDTELHKVTLEQFRVKSRDNGRTPMQWTSGKFAGFTAAHNGPWIDVHDDYEDWNAASQVGNPNSVFQHWAKVLSLRKAHKRLFVYGSYKLIDEANNDLFTYLRVYGGQSALVLANFTGKEVSWVVPAETISILKNGAVLLESYQRHPSSATGWYNRCNAI

SEQ ID NO: 15476 - protein, 634 aa, Zea mays
MDGCDCIEPLWPTDDLLVKYQYISDFFIALAYFSIPLELIYFVKKSSFFPYRWVLIQFGAFIVLCGATHLINLWTFTTHTKTVAMVMTIAKVSTAVVSCATALMLVHIIPDLLSVKTRELFLKNKAEELDREMGLIRTQEETGRHVRMLTHEIRSTLDRHMILKTTLVELGRTLGLEECALWMPSRSGSSLQLSHTLHHQITVGSSVPINLPVINQVFSSNRAIIIPHTSPLARIRPLTGRYVPPEVAAVRVPLLHLSNFQINDWPELSAKSFAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMGFIKPIASIKRLSVSVMLAPDLPLCAIGDEKRLMQTILNISGNAVKFTKEGHITLVASIVKADSLREFRTPEFHPTASDDHFYLKVQVKDTGCGIGPQDLPHVFTKFAHPQSGGNRGFNGSGLGLAICKRFVSLMGGHIWIDSEGTGRGCTATFVVKLGVCDNTNTYQQQLIPLVWPSSADSDLRAPKPLPDGRGSTPLKSRYQRSV

SEQ ID NO: 15477 - protein, 600 aa, Gentiana lutea
MANSLASSTATSSSNTLAQKSQSLYPTSSIDFNGSVNLISIKKPTKNNGIKCAFQTPLITMPKQQLPPLTAPQPPSPPSKWNFLQRAASIMLEKVESAILTKETQQKLPKTVDPNVQISGNFAPVPEMPIQYNLPVTGVIPDCIKGVYLRNGANPFHKPVSGHHFFDGDGMVHAVNINGNENTASYACRFTETERLIQERELGRSVFPKAIGELHGHSGIARLMLFYSRCLCGLVDQSKGIGVANAGLVYFNNRLLAMSEDDLPYHVRIKPSGDLETIGRYNFDGQLKGTMIAHPKVDPDTGSLFALSYDVISKPYLKYFNVTGDGTKSGDVEIPLEEPTMMHDFAITENHVIIPDQQVVFKLQEMLKGGSPLMYDKNKKSRFGVLSKNAKHAEDIIWVESPETFCFHLWNAWEELENDEIVVIGSCMTPPDSVFNECDENLKSVLSEIRLNLKTGKSRKRAIVQSEEVNLEAGMVNKSRLGRKTQFGYLAIAEPWPKVSGFAKVDLLSGDIQKYMYGDGRYGGEPFFVSSSDSNSEDQDEDDGYVIVFVHDEKTWKSELQIVKAKSLKLQASIRLPSRVPYGFHGTFINSKDLESQLSF

SEQ ID NO: 15478 - protein, 604 aa, Gentiana lutea
MDCAYTANTSSSWLKPKLSSQRRDLASSSSNLSFNNHGKLNRAQKNINCSLQTPSLLNFPTQTPPSTLTSAANYQTLTPTPTPTPSAPKLNLLQRAASMAMDAVESALNARELKHPLPKTADPKVQIAGNFAPVPEQPVRHRLPVTGKIPDSIQGAYVRNGANPLFEPAAGHHFFDGDGMIHAVQFENGSASYSCRFTETQRLVQERAVGRPLFPKAIGELHGHSGIARLGLFYARGLFGLLDHTQGLGVANAGLVYFNNRLLAMSEDDLPYHVRITPSGDLKTEGRFNFDGQLKSTMIAHPKLDPVSGELFALSYDVIQKPYLKYFRFSQNGEKSEDVDIPVSEPTMMHDFAITENFVVIPDQQVVFKMSEMIRGGSPVVHDKNKVSRFGVLDKYAKDASGIKWIEVPDCFCFHLWNSWEEPETDEIVVIGSCMTPPDSIFNESEEEGLESVLSEIRLNMKTGESTRRAILSSKDQVNLEAGMVNRNILGRKTRYAYLAIAEPWPKVSGFAKVDLFSGEVKKFFYGDEKYGGEPLFLPNDSNSEVEDDGHILAFVHNEKTSKSELRIVNAMTLEEEATVKLPSRVPYGFHGTFMSAKDLENQA

SEQ ID NO: 15479 - protein, 147 aa, Oryza sativa
  misc_feature (83)..(83): Xaa can be any naturally occurring amino acid
  misc_feature (117)..(117): Xaa can be any naturally occurring amino acid
SITLPTHTHSSTGLIFGSYSCGPAGKFNNGAATCWGFLGGASAAADWVEGEKGLSSFSWLRKVEEKGTGWFGLVQCKENFLRXKKGFAIVSPLSGDQPLYKADRNIVVVAKGEIYNXKKIRKQFASKHTFSTGSDCEVIIPLYEEYG

SEQ ID NO: 15480 - protein, 374 aa, Wolinella succinogenes
MEEFDYYEILEIERSASGEEIKKAYRKMAMKYHPDRNEGSSEAEEMFKRVNEAYQVLSDEGKRQLYDRYGKQGLESQGYSGFSGRGFEDVFDDLGSIFDSVFGGGFSSSSRKRSGPKYNLDLAMELDLSFKEAIFGCKKEIKIRYKDACPDCKGTGAKEGKIETCPDCGGRGQVFIRQGFMTFAQTCPKCGGSGERIKEKCPKCNGKGHENKEENLEVSIPEGVDTDNRIRVSRKGHVGKNGERGDLYLVVRVEEDEHFMRHGNDIYLHVPLFFSTVPLGTTLKIPSLRGELELKIPPNTKDKEQFVFKNEGVKDVHSAKKGNLIAQVKIVYPAKINDEQRELLEKLSRSFGVEGTPHEKGFEGVFEKIKGWFS

SEQ ID NO: 15481 - protein, 97 aa, Arctium lappa
ATYKVTLITPEGKQEFEVPDDVYILDHAAEEVGDLPYSCRAGSCSSCAGKVTAGSVDQSDGSYLDDDQMEAGWVLTCVAYPTSDVTIETHKEEELTA

SEQ ID NO: 15482 - protein, 260 aa, Glycine max
MAAATSGAVLNGLGSSFLSGGNRSQTLLASAIGGKVGAAVTVNPRRLIVVAAAAPKKSWLPGVRGGGNLVDPEWLDGSLPGDYGFDPLGLGKDPAFLKWYREAELIHGRWAMAAVLGIFVGQAWSGVPWFEAGADPNAIAPFSFGTLLGTQLILMGWVESKRWVDFFNPDSQSVEWATPWSRTAENFANATGEQGYPGGKFFDPLSFAGTIKDGVYIPDTEKLERLKLAEIKHARIAMLAMLIFYFEAGQGKTPLGALGL

SEQ ID NO: 15483 - protein, 272 aa, Trichodesmium erythraeum
MPVVSLAQLLESGVHFGHQTRRWNPRMSQYIFTERNGVHIIDLVQTAQLMDEAYNYIRTASEQGKKFLFVGTKRQAAGIIAQEATRCGGYYINQRWLGGMLTNWTTIKTRVERLKDLERREESKALDLLPKKEASVLRREMAKLQKYLGGIKNMRRLPDGVIMVDQRREYNAVQECQKLNIPIVSLLDTNCDPTQVDIPIPANDDAIRSIKLIVGKLADAIYEGRHGQLEADYEDYYEDYEEYEDDYEGAEGDLDLDSANEEESLEDNNEEE

SEQ ID NO: 15484 - protein, 821 aa, Unknown
  Salmonella sp. CDC 156-87
RMSGIFRDVSLLHKPTTQITDFHLHTHLNDDFTQAVLEAEVRLAGGVNDDLQLVLHLWQGETLAGEAHATPGSEIIDERGGYDDRATLRLNINRPALWSAETPNLYRAVIQLRTADGELIEAEACDVGFRQVRIDKGLLLLNGKPLLIRGTNRHEHHPERGQVMDYDTMVQDILLMKQNNFNAVRCSHYPNHPQWYALCDRYGLYVVDEANIETHGMTPMNRLSDDPDWLPAMSQRVTRMVQRDRNHPSIIIWSLGNESGYGANHDALYRWLKAEDPSRPVQYEGGGADTAATDIICPMYARVDQDQPFPAVPKWSIKKWLSLPGEQRPLILCEYAHAMGNSFGGFAKYWQAFRQYPRLQGGFVWDWVDQSLIKYDADGKPWSAYGGDFGDTPNDRQFCMNGLVFADRTPHPALYEAKHVQQFFQFRLLPGEERRIEVQSEYLFRHSDNEILRWMLAQEGNQLASGEVVLDIAPQGRQIILLPAFPQPETAGQLWLTVRVEQPLATSWSEAGHISAWQQWPLEEKLCVSKPTRASVAPALTVRDGEFCVTQGNLRWQFCRQQGWLTQFWRDDEAQLLTPLIDQFTRAPLDNDIGVSEATRIDPNAWVERWKAAGHYCAEPALLLCDADELADAVLITTAHAWQYQGATLFISRKTYRIDDHGEMQIDIGVEVASGMPYPARIGLSCQLAQVNERVEWLGLGPHENYPDRLSSACFDRWNLPLDAMYTPYVFPTENGLRCGTRQLRYGAHQWSGDFQFNISRYSQRQLMETSHRHLLQAESGVWLNIDGYHMGVGGDDSWSPSVSPEFQLSARHYHYQIAWK

SEQ ID NO: 15485 - protein, 145 aa, Bacillus cereus
MSMPLYYKKIREQLGHELIFIPSVAAIIKNEQGKILFQYPGGEYWSLPAGAIEPGETPEEAVVREVWEETGLKVRVKKQKGIFGGKEFRHTYSNGDQVEYIVVVFECEVISGKLKAIDGESLKLKYFSLSEKPSLALPYPNNIFL

SEQ ID NO: 15486 - protein, 824 aa, Unknown
  Serratia sp. MF 416
RMSGIFRDVSLLHKPATHLSDITITTPLSDSFRRGELVVEVRAHQPQQHRVQVQLWRKDALIAEKMQDFGSEIIDERGAYDERTALRLSVDQPALWSAETPALYRAVVKLLSPTGELVEAEAYDVGFRQVEISNGLLKLNGQPLLIRGTNRHEHHPEHGQVMDEATMRQDILLMKQHNFNAVRCSHYPNHPLWYKLCDRYGLYVVDEANIETHGMQPMNRLSNDPLWLPAMSERVTRMVQRDRNHACIIIWSLGNESGHGGNHDALYRWIKSEDPTRPVQYEGGGANTAATDIICPMYARVEQDQPFPAVPKWSISKWIGLPDEQRPLILCEYAHAMGNSFGGFDRYWQAFRKHPRLQGGFVWDWVDQGLTRLADDGQSYWAYGGDFGDTPNDRQFCLNGLVFPDRSPHPALFEAQRAQQFYQFQMLEQQPLTIEVNSEYLFRTSDNERLYWNVALDGKAIAQGEVELSLAAQGTQKIVLGDIPELNESGELWLNVEVRQIKATAWSEEHHRCAWDQWRLSRPLTLPTDHSDVQAQSPRLNEHNDAFSIEWGTQRWQFNRQTGLLEQWWQGEKAALLTPLRDNFTRAPLDNDIGVSDAAHIDPNAWVERWKRAGMYALETRLLQCEVDAISQGVQICTAHAYTYQNNILFISRKTFLINRLGKLHIDVNVDVAHGIPAPARIGLSCQLAEVAERATWLGLGPHENYPDRQLSAQLGRWTLPLSELHTPYIFPTENGLRCNTRQLNFGHWQWQGDFHFGLSQYGQQQLADTSHNHLLRAEQGVWVNIDGFHMGVGGDDSWSPSVSPDFILDAEHYNYKLVWQYGG

SEQ ID NO: 15487 - protein, 488 aa, Oryza sativa
  misc_feature (205)..(205): Xaa can be any naturally occurring amino acid
  misc_feature (349)..(349): Xaa can be any naturally occurring amino acid
MGRRSGGRKLPFFASNASTSSSTKRTRSARRLPSLTRPRASSSPSPASPSPPPPSASHPAPPSPPLAVSPAGAGKVGKKKAGARLWMRLDRWGVSETLHLDKGSIIRRAGLPPRDLRILGPVFSDSSSILAREKAMVINLEFIRAIVTADEILLLDPLTIDVIPFVEQLTHHLPLKNLVCGNGQPGGDDHGEKHDDSPGDQVPRXLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLXDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWGSNHPEAAVCLLCREIADESLNFMDNTE

SEQ ID NO: 15488 - protein, 352 aa, Arabidopsis thaliana
  misc_feature (163)..(163): Xaa can be any naturally occurring amino acid
  misc_feature (175)..(175): Xaa can be any naturally occurring amino acid
  misc_feature (225)..(225): Xaa can be any naturally occurring amino acid
  misc_feature (267)..(267): Xaa can be any naturally occurring amino acid
MAAIASTLSLSSTKPQRLFDSSFHGSAISAAPISIGLKPRSFSVRATTAGYDLNAFTFDPIKESIVSREMTRRYMTDMITYAETDVVVVGAGSAGLSAAYEISKNPDVQVAIIEQSVSPGGGAWLGGQLFSAMIVRKPAHLFLDEIGVAYDEQDTYVVVKHAXLFTSTIMSKLLXARPKCEALQRLLQLKDLIVKGNRVGGVGTNWALVAQNHDTQSCMDPNVMXAKIVVSSCGHDGPFGATGVKRLKSIGMIDHVPGMKALDMNTXAEDAIVRLTREVVPGMIVTGMEVAEIDGAPRMGPTFGAMMISGQKAGQLALKALGLPNAIDGTLVGNLSPELVLAAADSAETVDA

SEQ ID NO: 15489 - protein, 378 aa, Streptococcus pyogenes
MNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYSLDISFTQAALGDTVEIPTVHGDVELAIPAGTQTGKTFRLKGKGAPKLRGGGQGDQHVTVNIVTPTKLNDAQREALQAFAEASGEKMLHPKKKGFFDKVKDALEDI

SEQ ID NO: 15490 - protein, 436 aa, Coccidioides immitis
MSMLKENGDHLLIDEHSVLPSTAQQPLKGCPSDAAPRGGSISTEETWQDGRADSICPERDGELHCKRPGDVASAFDKRILLSETPSGLGEVESSLGVRWAPLSISPRRRFQTLVVLYHTVSIAIFLTAFFFSCAIPLFWPLLLPYLIYISLFSKVATDGSLRRRSRFLRSLRIWTYFAGYFPAKLHRSELLPPTRKYIFGYHPHGIISHGAFAAFATEALGFSELFPGITNTLLTLDSNFRLPFYRDYALAMGLGSVSRESCENLLSRGGADGEGMGRAITIVVGGARESLDAQPHMIRLVLKRRKGFIKLAIRTGADLVPVLAFGENELYKQVASDQHPLIHKFQLLVKRTMGFTIPLFHARGVFNYDVGLMPYRRPLNIVVGRPIQVMQERNKDNIEDAYVDELHARYVAGLQKLWEEWKDTFATERASELEIN

SEQ ID NO: 15491 - protein, 354 aa, Brassica napus
MAERVSLALNTTTTTMASSLRTQVSASRLLRFSSSGSKLSFPSSSLSFTRSLVSSPLLSQKRCQAALVNRSFSSAATTHCTAATDPEQLKSAREDIKELLNTKFCHPILVRLGWHDAGTYNKNISEWPQRGGANGSLRYEIELKHAANAGLVNALNLIKHIKDMYSGISYADLFQLASATAIEEAGGPKIPMKYGRVDTSGPHECPEEGRLPDAGPPSPANHLREVFYRMGLDDKDIVALSGAHTLGRSRPERSGWGKPETKYTKEGPGAPGGQSWTPEWLKFDNSYFTEIKEKRDEDLLVLPTDAAIFEDPSFKVYAEKYAADQDAFFKDYAESHAKLSNLGAKFNPPEGIII

SEQ ID NO: 15492 - protein, 822 aa, Caulobacter crescentus
MTQATPKLRLVVIGNGMAGCRAVEEVLKRDPDRYAVTIFGAEPRVNYNRIMLSPVLAGEKAFEDIVINDEAWYRDNGITLHAGRAVTAIDLAARKVFAEGGLEIGYDKLILATGSDPFRLPLPGGDLKGVVTFRDLDDVNAMLAASAEPDARAVVIGGGLLGLEAAYGLARRGMAATVVHLMDVLMERQLDESAGYLLREALADRGVETVLGAHSEEIVGADGQVTGLKLKDGRVLPCDLLVMAVGIRPNTTLAKAAGLTVNRGVAVDDAMRTSDPDVFAVGECVEHRGQCYGLVAPIWEMCRALAQALTDGEGAYQGSVLSTRLKVSGVDVFSAGKFAGGEGCEDIVFRDAARGVYKRVVIEDGKVAGAVLFGDAADGGWYFDLMKAGADVAGIRETLIFGQAITEGLSGLDPSAAVAAMPDTQEICGCNGVCKGAITSAITAQGLTTLDDVRAVTKASASCGSCTPLVEQVLKLTLGDGFQAQTGPKPICKCSPKTHGDVRRAIVDQGLKSMPAVMQALEWSTPDGCASCRPALNYYLLCAWPGEYRDDKQSRYINERVHANIQKDGTYSVVPRMWGGMTSPAELRAIADVAEKFAIPAVKVTGGQRIDLLGVKKDDLPAVWADLNAAGMVSGHAYAKGLRTVKTCVGSDWCRFGTQDSTGLGMRLEKFLWGSWAPAKVKLAVSGCPRNCAEATCKDFGVVCVDSGYEIHIGGAAGLHIQGTQVLTRVATEDEAVWVIAAAMQLYREEGWYLERVYKWMDRVGLESIRAQVTDPDQRRALYDRFVYSQRFARIDPWAERVAGRHNEEFTPMSRRMEFVPA

SEQ ID NO: 15493 - protein, 209 aa, Pasteurella multocida
MGKKKRSASSSRWLNEHFKDPFVQKAHKQKLRSRAYFKLDEIQQTDRLFKPGMTVVDLGAAPGGWSQYVVSQIGGAGRIIACDILEMDPIVGVDFLQGDFRDEKVLAALLARVGEGKVDVVMSDMAPNFSGMPSVDIPRAMYLVELALDMCKQVLATKGSFVVKVFQGEGFDEYLREIRSLFSVVKVRKPEASRGRSREVYIVATGYKG

SEQ ID NO: 15494 - protein, 102 aa, Kluyveromyces lactis
GSRRASVGSMARPAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 15495 - protein, 623 aa, Streptomyces collinus
MSGIAGWVDFERDLTPEAPTVRAMAAALAHRGPDGFGEWIEGHAALAHRRLSLIGSEHAGQPAIVESEAGSPVAVLTLDGSVTNAVELRRELAAKGHRFTGDGDAEVALHAYLEWGAAFPERLEGLFALAVWDVRRQELLLVRDRLGVKPLCYFLTPSGVVFGSEPKALLAHPAVRPVVDADGLRELFAHSRKPGTGVFRGTREVLPGHTMTVRAPGTGHRRYWSLPARPHTDSLETTVATVRRLLSEAVATHLRADVPVGAMLSGGIDSSALTALAAHRRRAEGAGLRSFSVNFSGYAENFEPHPTMRATPDAPYAALAAEHIGTEHTEILLDTAALADPGTHAAALRSQDAPSPLGDMDVSLLLFFEALRGAGITAVLSGETADEVFNGYFWAYDPGHSNSTTFPWVSFERGHDAAAGGLGCSLVDRTLRKELDFMDYADQHYRDALTEVPQVAGESPAERRAREVTYLALTRWAPTHLDRADRMSMAHGVQLRPPFCDRALVEYVYNVPAELKRVNGQEKSLLRAAVADLLPERVLNRPKSAYPTVQEAAYGEFVRHRFEDVAADRTAPVAPLLDAEATRVALGAAAAPSGAFAWVERASMEMVLQLNTWLSEYGVELRV

SEQ ID NO: 15496 - protein, 324 aa, Ehrlichia canis
MKITILGAGSFGTAIAIALSSISTSINLWGRNHTDMQSITINRKNLKYLPTYELPDNIIPSSSIDEVLSDHNTCIILAVPTQQLRTLCLYVQQHIFEQTPLLICSKGIENISLKFPSEIVKEILPNNPTYILSGPSFAKEIAANLPCTIVLAGENEVLGTSLINKMSNKTFKIVYSKDTLGVQIGAALKNIIAIACGIITGKNLGNNAVASVIAKGMEEIKTLYTAKNETINLSTLIGPSCLGDLILTCTTTHSRNMSFGVAIGQGEDINKMLNKKSEIIEGVSTVKPLISLAEKLNIELPICTSIYNLLYKNVSLDKTISEIL

SEQ ID NO: 15497 - protein, 189 aa, Triticum aestivum
  misc_feature (51)..(51): Xaa can be any naturally occurring amino acid
  misc_feature (87)..(87): Xaa can be any naturally occurring amino acid
  misc_feature (187)..(187): Xaa can be any naturally occurring amino acid
QVAMAARRSGAVVAALMALLVGLAGADFAADRAECADKLMGLATCLTYVQXRATARSPTPDCCSGFRQGAGRQAMNACAFLVKDRDXPTLGIKFNVTRAMNLPSACNIPATFSDCPKILNMSPDSKEAEIFKQYGIEHEGKNATAGGSAAVTGTFGGKSADAAAGAGRHTAVVFAVVVSALLASVLXLA

SEQ ID NO: 15498 - protein, 269 aa, Plantago major
SLFVYPYKIIIKTCGTTKLLRSIPPILKLADGLSLSVQTVTYTRGSFIFPGAQSYPHRNFSEELSVLDSYFANLGSTNAYVMGSSDKKQKWHVYSACAKSVEVVNPVYTVEMCMTDLDREKASVFYKNESSSAARMTNESGICKILPDSHICDFEFDPCGYSMNAIEEAAISTIHITPEDGFSYASFEASGYNFNSVNLGLLMERVLACFEPKEFSVSVHSEFGAKFLNDAHCFNLKGYSMDEKSYEDLGMGGLNYIPEVLTCNIMWLS

SEQ ID NO: 15499 - protein, 549 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISSQAKQLLLHTLGNGDFTVFHRMSANISETTAMITDICTPQAEIDRCIRTTYVTQRPVYLGLPANLVDLNVPAKLLQTPIDMSLKPNDAESEKEVIDTILVLVKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEVMLPVFDCSTKLG

SEQ ID NO: 15500 - protein, 586 aa, Geobacter metallireducens
MSEDKDMKNRNAMTIKRFVDVEEDGEHGGSGEFAELFQESIKQHRVGEVVTGKVVHISNEFVLVDIGYKSEGCIAIDEFLDEDGNLTVKVGDEVKALFERKENQKGYAVLSRRKAERLAVWDVIDEAGGEGGIIEGKITGKVKGGLTVDIGVQAFLPASQVDLRPGGNLDKYIGTTDRFKVLKLNKKRGNIVLSRRVLMEEERESSRKETLATLAEGQVREGVVKNITDYGAFVDIGGVDGLLHVTDMSWGRLGHPSEILKPGDKLNVKVLKYDQEKGKISLGLKQVTPDPWVSVEQKYNQGDRVKGKVVSLTDYGAFIALEDGVEGLVHVSEMSWTRRLRHPSEILTVGDEVETVVLGVDMGNRRISLGLKQVQVNPWTQLEEKYPVGTKLEGQIKSITDFGVFIGIEEGIDGLVHVSDISWTKRIKHPGEVFTKGQTVQAVVLNIDPENERLSLGIKQLLLDPWSEIPVKYRPGTRVHGKVTSVTDFGVFLEIEEGIEGLIHVSELSREKVASPKEFTNVGDELDAVVLSVDESEKKIALSIKSLQMAAEKAEIESYMQAQGEATSNLGELLKVGFRKNGDGND

SEQ ID NO: 15501 - protein, 464 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQILLGNEKGLTPLINIQGYVLGNPVTDKNIETNYRVPFAHGMGLISDELFESLERSCGGKFFNVDPSNARCSNNLQAYDHCMSEIYSEHILLRNCKVDYVLADTPNIRTDRRRVMKEFSVNDSSSLPPPSCFTYRYFLSAFWANDENVRRALGVKKVGKWNRCNSQNIPYTFEIFNAVPYHVNNSLKGFRSLIYSGDHDSMVPFSSTQAWIRALNYSIVDDWRPWMMSSNQVAGYTRTYANKMTFATIKGGGHTAEYTPDQCSLMFRRWIDGEPL

SEQ ID NO: 15502 - protein, 112 aa, Colwellia psychrerythraea
MKIISAIIKPFKLDDVREAISEVGVEGITVSEVKGFGRQKGHTELYRGAEYQVDFLPKVKIEIAVNEELVERLVEAITKSAYTGKIGDGKIFVYNLEQAIRIRTGEQDSEAL

SEQ ID NO: 15503 - protein, 295 aa, Pseudomonas putida
MQGRKAMLVLHGKQAMNEEVRSAVRELRDSGWVLDVRVTWEAGDAQRLVAEALAAGYSHIVAGGGDGTLRDVAEAMGLAATSASLALLPLGTANDFAKAAGVPQVPASALALLNVAPQPIDLGQAGDQLFLNMATGGFGSQVTANTSEDLKKVLGAAAYLFTGLSRFSELQAASVELQGPDFHWQGDLLALGIGNGRQAGGGQVLCPEAIINDGLLDIAILPAPQEVVGALRDLLAGDGLFIRARLPWVEIKSAQGLDINLDGEPLQAANLRFQARPAALRLHLPAGSPLLSRPG

SEQ ID NO: 15504 - protein, 416 aa, Vibrio parahaemolyticus
MLKRDMNIADYDAELFAAIQEETLRQEEHIELIASENYTSPRVMEAQGSQLTNKYAEGYPGKRYYGGCEYVDKAEQLAIDRACKLFGCEYANVQPHSGSQANSAVYMALLNPGDTVLGMSLAHGGHLTHGSPVNFSGKHYNVIPYGIDEAGQINYDEMEQLALEHKPKMIIGGFSAYSQIVDWKRMREIADKVDAYLFVDMAHVAGLIAAGEYPTPVPHAHVVTTTTHKTLAGPRGGLILSNAGEDMYKKLNSAVFPGGQGGPLMHVIAGKAVAFKEAMEPEFKAYQARVVKNAKAMVGQFQERGYKIVSNGTENHLFLVDLIDKDITGKDADAALGAANITVNKNSVPNDPRSPFVTSGIRVGTPAITRRGFTEEDAKDLANWMCDVLDNIGNEEVIEATKQKVLEICKRLPVYA

SEQ ID NO: 15505 - protein, 308 aa, Streptococcus mutans
MAKIYNNITELIGNTPIVKLNNVVPEDAADVYVKLEAFNPGSSVKDRIALSMIEDAEKRGLIKPGDTIVEPTSGNTGIGLSWVGAAKGYNVIITMPETMSVERRKIIQAYGAKLVLTPGSAGTKGAIDKAHEIAKEVGGWVPLQFDNPANPKIHELTTGPEILEAFGSHGLDAVVAGIGTGGTITGISRALKKDNPDIKIYGLEADESAVLSGDKPGPHKIQGISTGFIPAALDTHSYDEVIRVKSDDALATGRYFGGKEGFLLGISASAAVWAALEVAKKLGKGKKVLAIAPDNGERYLSTALYEFN

SEQ ID NO: 15506 - protein, 524 aa, Mycobacterium tuberculosis
MSIADTAAKPSTPSPANQPPVRTRAVIIGTGFSGLGMAIALQKQGVDFVILEKADDVGGTWRDNTYPGCACDIPSHLYSFSFEPKADWKHLFSYWDEILGYLKGVTDKYGLRRYIEFNSLVDRGYWDDDECRWHVFTADGREYVAQFLISGAGALHIPSFPEIAGRDEFAGPAFHSAQWDHSIDLTGKRVAIVGTGASAIQIVPEIVGQVAELQLYQRTPPWVVPRTNEELPVSLRRALRTVPGLRALLRLGIYWAQEALAYGMTKRPNTLKIIEAYAKYNIRRSVKDRELRRKLTPRYRIGCKRILNSSTYYPAVADPKTELITDRIDRITHDGIVTADGTGREVFREADVIVYATGFHVTDSYTYVQIKGRHGEDLVDRWNREGIGAHRGITVANMPNLFFLLGPNTGLGHNSVVFMIESQIHYVADAIAKCDRMGVQALAPTREAQDRFNQELQRRLAGSVWNSGGCRSWYLDEHGKNTVLWCGYTWQYWLTTRSVNPAEYRFFGIGNGLSSDRATVAAAN

SEQ ID NO: 15507 - protein, 197 aa, Thermobifida fusca
MSRIGRVERATNETKVFVEVNLDGTGAADISTGVGFYDHMLHQIAKHGLFDLTVRTEGDLHIDAHHTMEDTALALGAAFREALGDRSGIRRFADAKVPLDEALAEVTVDISGRPYLVHSEPEGMAPMIGRDYDTTMTRHIFESFVAQARITLHVHVPYGRIPHHIVECQFKAVARALRSACERDPRVTGVPSTKGTL

SEQ ID NO: 15508 - protein, 417 aa, Oryza sativa
MEGGGAKDGSAAAAQTRGSGDDGSHKPLPPCCLKAKAAAAESEAKCHATVVSGWFTEPRSHSGKTSKVQYFNNPMWPGEAHSLKVENILYQGKSPYQEILVFESSTYGNVLVLDGIVQLTEKDECAYQEMVTHLPLCSIPSPKSVLVVGGGDGGVLREIARHASVENIDICEIDQLVIDVCKDFFPQLSVGFKDPRVQLHVGDAVDFLRNAPEGKYDAIIVDSSDPIGEILLLLNHHMFQFCAPFVFVPHEDPSHIIGPAQELVEKPFFQTIARALKPGGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAKPKKMKIMPNSAIPTAS

SEQ ID NO: 15509 - protein, 98 aa, Bryopsis maxima
ASYKVTLKLDDGSEAVIDCDEDSFILDVAEEEGIDIPFSCRSGSCSTCAGKIEGGTVDQSEQTFLDDDQMEEGYVLTCVAYPTSDCTILTHQEEEMIG

SEQ ID NO: 15510 - protein, 1843 aa, Cryptococcus neoformans
MHWRGKKKGMVNRCTSLKTDEQKSNRFSSHIIQPTAPTAITRMPPPENPPIDPFPPLRPTFSPVESRSASYAAVVRRNTNTNANTNINTNTDPSALTNTDTNTTGASSVERDTEERYSGESLSGRERVHPWRENIHPWRDRIMESSGNGNQRDMDGGMGNASGRVDGNTSINANISATSSSSAHSDALADTNSQTNNPSAPFTLREMLRNVQASSPAPATSSPAWASAPGSSQAPASRSTSRIGINGLPHVLSFLPSPPRLFDSDGDSLHSLTDDEDDSNRVYEDGGDGRELWDEVEWMREVLDGDHASGSGAGVGAGGAGARNERSFPLRRPGLGSAQADGPTGQGADLQRGGFNRRRDYLDFLDHMVNLPNNSSIPSVRTLTQNVLDSLNSNRWSQALHTHSHSHVQDLINDNLNTDPNRNTTTNTNVGSIAEGQAHGVSRPLEYALNISRSSSRAESRAAGLSPTNLGPIQAGVEPPVLVSSTSASSSRLSRGRRARSAGPDLDVDGRREGAEGGLSEDSPARKRSRTSASSDATSLMTTLPVPRGVGIFYWEAEVLAKGEEGFISVGWIAGLPTPVIIPEQKDSTNANVNASGSGSGSGSRTLNANTIPNTGGAGGHAGVPMRNMRRLVGWSKGSWGWHGDDGRLFAGQGMGERFSETWGEGDIVGLGLDQTTSTLFFTKNGKLVGSKTFPSLPSCCPPPPPSFSPSPFASHRHPVITKSTDTLLYPAVGLRSQGESVAVNLCGPFKYDIEAHVREVKERMSKEVGRVEVKRVSSVVDLVDDQDIAGTNAEQAEGFEEKCEGGKESEMKESIDTSRIGTPIHRISSATTPTSTTAPGPTSSNSQKLPPSAPLDPLRQTTTAFVLDYLNHHGHTKAEGTMRRAIGERNWIGASTSSSSSSSSVSNTHISNLITSDNIPMAKPNPTLQDFPTISSALLYLSNLIRKPFEERVPWPLWRELALLDEDSAQSREDMKGKGKRKGKGKERARGNDIRNVKYEADKTDGMEREELELEGSLLVYDFLHAAMFSAADHDSIEVDGEEGEREEQGADADARTIAIGRKIQKRLQRPSTSLPTSTSPAVLKPQLQADDWVIYAKEAFGAIVNPQGYSTSERWAHWRERLATRLEVFLRQRRGLPQISRLETAIIQTNAVIHALAQKRPNSGAAFVDVKEALGLNEAKGKPFRFKKDRQPSSVKMDIDKMFKLPALPSGGNKRKMGDLPNPETLKKYKPSEPQAASEMMPPPPPGGLNGKGKGRAVTVEDDDVEAEYSRDVGEDVYDGEDDEEGRFFGGGLNREQEQILDIFDAAGEGEQGPALDLPALRRQIGKFQRIVLKNAEQRGKYSDDPSKFIDSESDLDTSLKAFLPLTQNPPLFYPELVKSGIIPIFANLLSHENTDIAMDVVEVIQELTDEDVGGEVDDLDHEEETGSETRMAMGQLIDELLNNSLLDLLVSNLSRLDESEDTDSQGVFHILGVFENLLSFMPPLADQIVEETALLQWLLQRIKKKEYDSNKQYASEIIAILLQDSRANVLKLGQLDGMDVMLQVLSQYLKTDPGDSEEVEFMENVFDSVCSSLAQPEMKKAFFDAEGVELMVLMMKEKRLAKTRAIKVLDYALQTESGSPACERFVQALGLKTFFSAFMSSASSKAGGKKSKSKLGAAAATSAIEDEEHMLGILASLFTNLASDSPERIRVIAKFVEGGYEKVERLLEVREAAEGRLGSVIKEIEYEREVMQANEEEITDVEETEWYLRKMDAGLASLQNADYVLAWVCMEDDGAMTHARLLLSRKNMNFKTIAAVLTEFKNNVGDNDEPNEEDGQREADDAVNTQKMILEHLIAFLEGL

SEQ ID NO: 15511 - protein, 98 aa, Bumilleriopsis filiformis
ETYSVTLVNEEKNINAVIKCPDDQFILDAAEEQGIELPYSCRAGACSTCAGKVLSGTIDQSEQSFLDDDQMGAGFLLTCVAYPTSDCKVQTHAEDDLY

SEQ ID NO: 15512 - protein, 368 aa, Zea mays
RKEIYYEPEEVKAAIVTCGGLCPGLNDVIRQIVFTLETYGVKNIVGIPFGYRGFFEKGLKEMPLSRDVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMHASLSSGQIDVCLIPEVSFTLDGEHGVLRHLEHLLNTKGFCVVCVAEGAGQDLLQKSNATDASGNVILSDFGVHMQARGKKHFKDIGVPADLKYIDPTYMVRACRANASDAILCTVLGQNAVHGAFAGFSGITSGVCNTHYVYLPITEVITTPKHVNPNSRMWHRCLTSTGQPDFH

SEQ ID NO: 15513 - protein, 556 aa, Vibrio vulnificus
MTESFAQLFEEFLNETEFQQGTIVKGTVVAIENGYVLVDAGLKSESAIPAEQFKNAAGELEVEVGSEVDVALDAVEDGFGETQLSREKAKRHEAWIVLEKAYEEAATVVGIINGKVKGGFTVELNGIRAFLPGSLVDVRPIRDTAHLENKELEFKVIKLDQKRNNVVVSRRAVIESESTVERDELLETLQEGSEVKGIVKNLTDYGAFVDLGGVDGLLHITDMAWKRVKHPSEIVNVGDEILVKVLKFDRDRTRVSLGLKQLGEDPWVAIAKRYPEGHKLSGRVTNLTDYGCFVEIEEGVEGLVHVSEMDWTNKNIHPSKVVNVGDEVEVMVLEIDEERRRISLGLKQCKANPWQSFAEAQAKGDKVTGKIKSITDFGIFIGLDGGIDGLVHLSDISWNVAGEEAVREFKKGDEISAVVLAVDAERERISLGIKQMENDPFNAYVADNKKGALVNGTVTAVDAKGATIELEDGVEGYIRASEVSRDRVEDATLILSVGDKVEAKFTGVDRKNRVINLSIKAKDEAEEQEAMASINKADEAAFGNAMADAFKAAKGE

SEQ ID NO: 15514 - protein, 430 aa, Rhodopseudomonas palustris
MTASLKAIDGSAELTTLMTDLGRQARAAARTLALAPPEQKNRALEAMERAIRAGADKILAANAEDVADAKAAGTTSAFLDRLTLTPARVEAMAEGIAVVRGIADPVGTVTESWQRPNGMTIERVRVPLGVVAVIFESRPNVAADAGVLCLKSGNAVILRGGSESFRSCRAIHDRLVQGLREAGLPDAAITLVPTRDRAAVGLLLAGLDGSVDVIVPRGGKSLVARVESEARVPVFAHLEGVNHVYVDRSADLEMAKSIVLNAKMRRTGVCGAAETLLIDRAAATTHLAPLVTMLIDSGCEVRGDQTVQQVDPRVKPASDEDWDTEYLDAVIAAKLVDGVDGAIVHIHNHGSHHTDAIVAEDAQAAAKFLGEVDSAIVLHNASTQFADGGEFGFGAEIGIATGKFHARGPVGAEQLTTFKYRIHGSGQTRP

SEQ ID NO: 15515 - protein, 279 aa, Ustilago maydis
MPLSNLIGRAQASKQASKQASTYSALTSLCSVPPSKAHLQSLPKLCGISLGTVFGLLAIIYLPLMSRFFSLFTRSSQPLIQHLGPPTTPTAQAAQEALKGSNAAMSAQETATVANGCFWGTEDIYRKAYGNGKGLLDAKVGFIGGQESSKNPSYEEVCTGRTGHAEAAQIVYDPSKVSYAEIIEFFYRTHDPTQLNQQGNDRGTQYRSAIFAHDQTQLDIAKKVTEEVQKKHFDPKGKKIVTQLEIRKKEDFFPADDYHQKYLINHPDGYHCSTHRYWW

SEQ ID NO: 15516 - protein, 157 aa, Hyphomonas neptunium
MSPEFLHTMIRVGDIDAAKRFFCDGLGLAEVTRYDNEAGRFTLVFLAAPADIERGGGVPEGASPTSLNIPMIELTHNWDEKDYEGGRNFGHLAYQVEDIYAATQRFADLGVPISRPPRDGRMTFIRSPDGISVELLQKGKPQAPQEPWASAPNIGAW

SEQ ID NO: 15517 - protein, 408 aa, Shewanella oneidensis
MDLNRRVFIKGAVATSVLSALPVKWVFADKLPAGVSALDISALTWTKAEDLPSYFKVLNTNPLNAYPPEHKLAPAVTPADVSFIRWNGIVPDFKTLDAKTWTFNVDGESVITPKIYTIDELKHRFKHYTLQLLIECGGNSRAGFFPSTKGNQWNNSAVFCSEWTGVLVSDVLKDCGVKADAVYTGHHGADVHLSGKGEAISRGVPIKAALEELGLIAWSMNGEDIPYLHGYPLRIVFGGRPGSVSQKAATGISVRNKVHDGHKMEAPAYQVPKYPIAPGETVDENDYRIIEEMIVKSLITQPQSGTELAQGQKLTVAGHAWAGVREVVKVEVSYDYGTRWFVAELQKPKNATAWQQWSIELQLPTQGYYEIWAKATDSEGDSQPVVQPQWNPKGYMFNGCHRIAVRVV

SEQ ID NO: 15518 - protein, 252 aa, Trichodesmium erythraeum
MNQLKFVGKVYLVGAGPGDPGLITLKGKVLLKQADVVIYDALVSASILEMINPNAEKFNAGKRRDRHSLEQTQTTQLLIEKAKTHAVVVRLKGGDPFVFGRGGEEMEDLMQVGIAVEVIPGVTSGIAAPAYAGIPLTHRNYSSSVTFVTGHEAAGKYRPEVNWEAVAQGAETIVIYMGVHNLQNIIKKLIAAGRDPETPIALIQWGTYPKQKELIGTLNNIVGQIESTGFEAPAITVIGNVVNLHQILGNRE

SEQ ID NO: 15519 - protein, 892 aa, Caulobacter crescentus
MADGSAALTATRTACPYCGVGCGVIGATAAGARAVAISGDEAHPANHGRLCSKGTALGATVSLAGRLLEPTIQGRSASWDEATALVARRFRETIARHGPDSVAFYVSGQLLTEDYYVANKLMKGFIGSGNIDTNSRLCMASAVVAHKQAFGADLVPGCYEDLDLANLVVFSGHNAAWTHPVLFRRMEAAKARGQKHVVIDPRRTDTAEGADLHLALAPQSDVRLWNGLLADLIRRGAVDMDFLRDHVDGYAAVITSLAEDDQSPAAVAADCGLALADLQTFFDLFAAHPRTVSLFSMGANQSAQGVAKGLAIINAHLATGRIGKPGACPFSITGQPNAMGGRETGGMANTLAGHMDFSPEERDRVARFWGAPNTARAPGLKAIDMFEAVRDGRIKALWVMATNPAVSLPASGAVREALERCPFVVVSDCVETDTTAFADVKLPALAWGEKDGTVTNSERRISRQRTLFPPPGQARADWRIIAEVARAMGFDGFGWPHAASVFREWARLTAYENKGRLLNLEGLTRLDPQAYDALEPVQWPVDTEGRGRARLFEDGRFQTANGRARLVPVRPRGPAEATSDKFPMALNTGRIRDQWHTMTRTGLAPDLCRHAPEPYVEVHPDDARAVGLTEGALARVMTTRAEAVAVAKLSDRQRRGSLFMPMHWTDAFAPAGRANALVAPMTDPSSGQPEFKHTPARIGAYRETWRGFFLAREPALIVDPGLVWRRIPRDACHQHEFAGRGDRAQRATLRKRLVRALTGEIVAYEDAATGALREAWIRDDRLVAVLYMTEAGRLPPRDWLADLFAAPLTPETRATLLHGFPPGAPVDKGPMVCACLKVGGKAIEAAIIGGASTADAVGAATGAGTNCGSCRPEISRMIRAFTDAKQETADVL

SEQ ID NO: 15520 - protein, 311 aa, Clostridium thermocellum
MAKIAKNLTELIGNTPLLELSNYNRANNLEAVLIAKLEYFNPASSVKDRIGYAMIKDAEEKGIINKDTVIIEPTSGNTGIALAFVAAARGYRVILTMPETMSIERRNLLKALGAELVLTPGADGMGGAIRKAEELAREIPNSFIPQQFSNPANPEIHRRTTAEEIWRDTDGQVDIFVAGVGTGGTISGVGEVLKQRKPDVKIVAVEPFDSPVLSGGTKGPHKIQGIGAGFVPDNFNRAVVDEIFKVKNEEAFETSRKLARTEGLLVGISSGAAAFAATQIAKRPENKGKNIVVLLPDTGERYLSTALFQDA

SEQ ID NO: 15521 - protein, 261 aa, Caulobacter crescentus
MSSSVQPGRVLLVGAGPGPVDLMTVRAMRAVQEAGALLYDALCSEEAVALAPPGCIRIQTGKRAGKPSMKQDEINRIMLRLARRGLRVVRLKGGDPSIFGRVGEEAAFLNAYGITTEVVPGVTAACAAAAQFGFPLTHRGQARRVVFTTARVENGAMSHDWRSGADAQATIAVYMGAEAAPDLAKALVTAGRATSTPVAMVERAGAADASLTMTSLGALTSGPITTHGGPVLIVVGEVAAAAQTQASNASDCFREHASRTA

SEQ ID NO: 15522 - protein, 319 aa, Candida glabrata
MPHNRVTIIGSGPAAHTAAIYLARAEMKPTLYEGMLANGIAAGGQLTTTTEIENFPGFPEGLTGTELMDRMRAQSTKFGTNIITETISKVDLSAKPFKLWTEFNEDGEPITTDAIVMATGASAKRLDLPGEDKYWQQGISACAVCDGAVPIFRNKPLAVVGGGDSACEEAEFLTKYGSKVFMIVRKDHLRASTIMQRRVEKNEKIEVLFNSVSLEAKGDGKFLNALRIKNVKTNEESDLPVNGLFYAIGHNPATDIVKGQVETDESGYIKTVPGSSLTSIPGFFAAGDVQDSRYRQAITSAGSGCMAALDAERYLTELE

SEQ ID NO: 15523 - protein, 336 aa, Gossypium hirsutum
MESDTIECVSSIDEIVEDHEIPHHNLLHHPHPRHAPHHQFSSSKPHHNGTNNVNSISNIVGPTAIAPAASVHELLECPVCTNSMYPPIHQCHNGHTLCSTCKIRVHDRCPTCRQELGDIRCLALEKVAESLELPCKYYKLGCPETFPYYSKLKHEGICIYRPYNCPYAGSECSVVGDIPFLVAHLRDDHKVDMHTGCTFNHRYVKSNPREVENATWMLTVFHCFGQYFCLHFEAFQLGMAPVYMAFIRFVGDETEARNYSYSLEFGANGRKLIRKSAPRSIRDSHRKVRDSHDGLIIQRNMALFFSGGDRKELKLRVTGRIWKEQQNPDANMCIPN

SEQ ID NO: 15524 - protein, 931 aa, Unknown
  marine gamma proteobacterium HTCC2080
MNKPIEIAIEDLDLGTPAALSESTVTVHIDGKAVDVPAGTSIMRAASLAGTQIPKLCATDSLDAHGSCRLCLVEVEGRKGTPASCTTPCQEGMSVKTQTPRLDKLRKGVMELYISDHPLDCLTCSANGDCELQDMAGVVGLRSVRYEEGSNHLDAGKDNSNPYFSFDASKCIVCSRCVRACSEVQGTFALTIAARGFESKVSPSEENAFLDSECVSCGACVQACPTATLQEKQVIDLGVPTRKVKTTCAYCGVGCSFVAELRGDELVRMVPDKQGGANAGHSCVKGRFAWGYATHSDRITRPMVRETTDSEWREVEWPEAIAFAADRFKAIQQKHGIDALGGITSSRCTNEEVYVVQKMVRASLQTNNVDTCARVCHSPTGYGLKQTFGTSAGTQDFASVQQADVIMVIGANPTDAHPVFGSRMKRRLREGAKLIVIDPRSIDLVKSPHIKATSHLQLQPGTNVAVVNALAHVIATEGWIDEAFVQERCDVASFNAWRRFISLPENSPENLAEISGVAAETIREAAATYAKAGNSAIYYGLGVTEHSQGSTMVMAMANLAMATGNIGRDGVGINPLRGQNNVQGACDMGSFPHEFSGYRHVSDETAREQFTALWGVDLREEPGMRIPNMLDAAISGNFRGMYIQGEDIAQSDPNSQHVAAALSAMDCVVVQDLFLNETSKFAHVFLPGTSFLEKDGTFTNAERRINRVRPVVPPASGLAEWEVTCALSEAMGYTMDYANASEIMDEIAALTPTFAGVSFDLLDERGSIQWPCNEQAPEGTPIMHAQRFVRGEGQFVTTPYVPTDERSTRKFPLLLTTGRILSQYNVGAQTRRTDNTVWHAEDILEIHEADAELRGVADGDWIEVASRAGSTRMRAHISDDIPAGVVYTTFHHPVSGTNVITTDNSDWATNCPEYKVTAVEIRPSSAIAVGM

SEQ ID NO: 15525 - protein, 832 aa, Colwellia psychrerythraea
MTINRREFIKANAIAAAAAVAGVSVPAVASNLITSSDITKLKWDKAACRFCGTGCSVNVGVMDGKVVATHGDIKSPVNKGLSCVKGYFLSKIMYGKDRLTTPLLRMTNGKYDKEGEFTPISWDQAFNVMAEKANDALKKDGPEALGMFGSGQWTVQEGYAAVKLMKAGFRTNNIDPNARHCMASAVGGFMRTFGIDEPMGCYDDLEAADAFVLWGSNMAEMHPILWTRLTDRRLSAPHVKVAVLSTFEHRSFDLADNGMIFTPQTDLAILNYIANYIIQTGRVNKDFVSKHTNFRLGETDIGYGLRPEHPLEQKAKNNGKTKGSSTPIDFDEYAKFVSTYTVESVSKLSGVPEHKLKELAEMYADPKIKVTSFWTMGFNQHTRGVWANNLVYNIHLLTGKISTPGNSPFSLTGQPSACGTAREVGTFSHRLPADMVVKNPKHRAIAEKIWDLPEGTIPAKPGYHAVLQNRMLKDGKLNFYWVQCNNNMQAAANINEEAYPGYRNPKNFIVVSDPYPTVTAQAADLILPTAMWVEKEGMYGNAERRTQSWYQMVEAPEGAKSDMWQLVEFSKRFKVEDVWPEELIAKKPEVRGKTLFDVLYKDASVGKFPLSEIPEDRLNDESRDFGFYIQKGLFEEYASFGRGHAHDLAPYDRYHKERGLRWPVVNGKETKWRFKEGSDPYCKPGSDWDFYGKPDGRAVIFALPYEPAAESPDEEYDLWLSTGRVLEHWHSGSMTQRVPELYKAMPDALVYMHPDDAKKRNMRRGDLVKLISRRGEVQTRVETRGRNKPPVGLVYMPWFDASRLVNKVTLDATDPLSKETDYKKCAIKIVKV

SEQ ID NO: 15526 - protein, 88 aa, Methanosarcina mazei
MKPMLLDFSATWCGPCRMQKPILEELEKKYGDKVEFKVVDVDENQELASKYGIHAVPTLIIQKDGTEVKRFMGVTQGSVLAAELDKLL

SEQ ID NO: 15527 - protein, 563 aa, Saccharomyces cerevisiae
MSEITLGKYLFERLSQVNCNTVFGLPGDFNLSLLNKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIRNAPAEIDRCIRTTYTTQRPVYLGLPANLVDLNVPAKLLETPIDLSLKPNDAEAEAEVVRTVVEFIKDAKNPVILADACCSRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVAKDYKPVAVPARVPITKSTPANTPMKQEWMWNQLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 15528 - protein, 451 aa, Unknown
  Nocardioides sp. JS614
MVDQATLEVPAQLRSDRGLPLVGRLFDYTRDPIGFFRHQWETYGPVSPFDSALDHAVVLLGPDACEQVLRNKDKAFANEPAWGKIVGPFFKRGLMLLDFDEHHAHRRIMQEAFTRDRLETYATRMHPAIAEGTASWDTERRFRSYPALKQLTLGIAADIFMGGAGDTSRAEMDRVNRAFIACVQAAAGIVRADVPFTRWGRAYRGRKVLEEFLRHYLPAKRATRTEDIFSVLCHIETEDGQRFSDEDVVNHMIFLMMAAHDTSTITTSTILQLLGQHPLWQERCRAEALALGPEPTLAELEGLQALDWVMKEALRLHAPVPILVRRTVKDTVVQGHLIPADTDVMVGVQFSHVMEDYWTDPMVFDPERFSPERREDRSHRYAWEPFGGGVHKCIGLYFAGIEVKAILHRLLRNHRWSVDPGYAAPYDNHSLPFAKDGQPIDLVRTDPRGES

SEQ ID NO: 15529 - protein, 133 aa, Marchantia polymorpha
MARTKQTARKSTGGKAPRKQLASKAARKSAPSTGGVKKPHRYKPGTVALREIGRYQKSTELLIRKLPFQRLIAQDFKSDLRFQSSAIGALQESVESYLVSFLEDTNLCAIHAKRVTIQSKDIQLARRLRGERN

SEQ ID NO: 15530 - protein, 407 aa, Alkaliphilus metalliredigenes
MKKNFEIGKDTYWVGYVDDRKVPFHRLILEKGTTYNSYFLDTEKPTLIDTVDIEFGRVFVENLSRFTDISKLEYVVINHVEPDHAGGLPALLSKAKNAKIVTTALGAEELKNMFKLHNREYIIIHDGMKLDIGGKTLQFFETPFLHTEETMVTYCMEDKILYPCDQFSTHIANHELFDDLAKEDITEDFNVYYQLIMHPHRPYVQDMLKKISQLDIQMIAPSHGYVLRENVAQYIHAYDEMSKPKKDKKAAILFSTMTGNTTKVAKIIAEGLEKKHIETRIINVDKADVESVLEVVRESDMIFFGSSTRYADMVGKLEIILKEMKNMDLSSKLGVAFGSYGWSGEAVEVINDYLKENGMKVIDSSYIIKVTGMDDVQVPLRVKFNPNEDEQRKLYRSIEIIGDLLVG

SEQ ID NO: 15531 - protein, 455 aa, Mycoplasma pneumoniae
MSATAISDLFEKPAQFKNKKIKLTGWLKNKRTSANIIFLEVNDGSTLLNLQAVVKQDQPELFALAESISLASAVSVSGTVALTPKSKQPLELVVKQINVLSTARADYPLQKKEHSLEFFRNNAYLRVRARTYFAIMKVRSLLSQAIFDYFFKNDFVLVHSPILTSNDCEGAGETFELKQGKEFFNKTTYLTVSGQFGAECYAQAFKKVFTFGPTFRAEKSHTSRHLSEFWMIEPEVAFANLKDLIKLIESTVKTVIKQVMQKAKQELDFLEKQFDVKLMERLKQITSTKNFHVLEYTKALEILKTAQASGQANFEVQDFNFGLDLKTEHERFLCEQHFHNQPVFVINYPKDFKAFYMKQNADGRTVGAVDLLFPQIGEICGGSEREGNLEKLVERCQAMQIDTQTLNWYLDMRKWGYFASAGFGLGFDRLLAYICGLENIRDAIPFPRAHGSINY

SEQ ID NO: 15532 - protein, 741 aa, Unknown
  Pelargonium x hortorum
MESCNCIEPQWPADELLMKYQYISDFFIAIAYFSIPLELIYFVKKSAVFPYRWVLVQFGAFIVLCGATHLINLWTFNMHSKTVEIVMTTAKIMTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRQQNPVGFTVPIHLPVINQVFSSNHAIKISPNSPIARLRPIAGKYMPGEVVGVRVPLLHLSNFQINDWPELSTKRYALMVLMLPSDSARQWHVHELELVEVVADQVAVALSHAAILEESMRARDLLMEQNVALDMARREAETAIRARNDFLAVMNHEMRTPMHAIIALSSLLQETELTPEQRLMVETVLKSSNLLATLINDVLDLSRLEDGSLQLDIGTFNLHALLREVHNLIKPIASVKKLCISLNVATDLPEYAVGDEKRLVQIILNVVGNAVKFSKEGNISITAFVAKSESLRDPRAPDFFPICGENQFYLRVQVKDSGLGINPQDIPRLFTKFAQTQPVATKNSGGSGLGLAICKRFVNLMEGHIWIDSEGPGKGCTATFVVKLGIPERSSEPKLLLMPKVPANHGQTNFSGLKVLLLDDNGVSRAVTRGLLAHLGCDVTTVSSSDELLRVVSQDYKVVFMDVCMPEVDGFEIAVRIHEKFMTRHERPLIVALTGNIDQVTKDNCTRVGMEGVVLKPVSIDKMRNVLSNLLEHRVLFEAI

SEQ ID NO: 15533 - protein, 197 aa, Unknown
  Oceanospirillum sp. MED92
MAERVAKVSRNTLETQIKVSVNIDGTGQFKADTGVPFLEHMMEQISRHGLIDLDIHCVGDTHIDDHHTVEDIGITLGQAFKEAVGDRKGIMRYGHAYCPLDEALSRVVIDFSGRPGLHMDVEFTRANIGKLDTQLFWEFFQGFVNHAGVTLHIDNIKGFNAHHQAETIFKAFGRALRFALEIDARAADVMPSTKGCL

SEQ ID NO: 15534 - protein, 159 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFIT

SEQ ID NO: 15535 - protein, 391 aa, Oryza sativa
MAAQRLAALHAAAPSAFSSTSSASHGRPAARSSTTALLPVALPRASATLRAAPSRLLPQEAKAAGSGRSVMCMASASASAAVASGAAELKAAREDIRELLKTTHCHPILVRLGWHDSGTYDKNIKEWPQRGGANGSLRFDVELKHGANAGNITFSRFRFLVAWLVNALKLVQPIKDKYPNISYADLFQLASATAIEEAGGPKIPMTYGRIDVTGPEQCPPEGKLPDAGPSAPADHLRKVFYRMGLDDKEIVVLSGAHTLGRSRPERSGWGKPETKYTKNGPGAPGGQSWTAEWLKFDNSYFKEIKEKRDQDLLVLPTDAALFEDPTFKVYAEKYAEDQEAFFKDYAGAHAKLSNLGAKFNPPELYQPDAPPTTGAADLQTAAHTPQGPGHE

SEQ ID NO: 15536 - protein, 740 aa, Unknown
  Pelargonium x hortorum
MEACNCFEPQWPADDLLMKYQYISDFFIAVAYFSIPLELIYFVKKSAVFPYKWVLVQFGAFIVLCGATHLINLWTFNLHTRTVEIVMTTAKLMTAAVSCVTALMLVHIIPDLLSVKTRELFLKNKAAELDREMGLIRTQEETGRHVRMLTHEIRSTLDRHTILKTTLVELGRTLGLEECALWMPTRTGLELQLSHTLRQQNPVGYTVPIHLPVLNQVFSSNRAIKISPNSPIARLRPLAGKYVPGEVVAVRVPLLHLSNFQINDWPELSTKRYAMMVLMLPSDSARQWHVHELELVEVVADQVAVALSHAAILEESMRARDLLMEQNVALDMARREAETAIRARNDFLAVMNHEMRTPMHAIIALSSLLQETDLTSEQRLMVETILKSSNLLATLINDVLDLSRLEDGSLQLDIATFNLHAVFRQVFNLIKPIASVKKLFITLNVSPDLPEYVIGDEKRLVQIMLNVVGNAVKFSKEGIISVTAFVAKSESVRDPRAPDFFPVSSDNQFYMRVQVKDSGSGINPQDMPKLFTKFAQSQPVATKNSGGSGLGLAISKRFVNLMDGHIWIDSEGPSKGCTVTFVVKLGIPEGSNEPKLPLMPKVSANNSQTDFPGLKVLLMDENGISRMVTKGLLMHLGCDVTSVSSSEECLRMVSQDHKVVFMDVRVPGLDGHELAVRIHEKFMKRHERPLIVALTSNADKVTKENCLRVGMEGVILKPVSVDKMRNVLSKLLEHRILFEA

SEQ ID NO: 15537 - protein, 382 aa, Ehrlichia canis
MSKSDYYELLGVSKNATSEEIKKAYRKMALKYHPDTNPGNKEAEEKFKELSEAYDVLIDQDKRAAYDKYGHNAFDGAAGRGGFDFNSGFSGDFSDIFNDLFGGGFGSRGGRGSSRRSEGAAGSDLRFDVEITLEDSFNGKKVPISYVTYVKCSSCSGSGSEGSAKSVQCNTCHGAGSVRTQQGFFTIERTCHVCNGEGEIIQNKCKKCSGSGRVRDEVNLLVTIPKGIESGNKIRLNGKGEAGYRGARSGDLYVYSNIQKHKFFTRSGPDLYCTVPIKMTLAALGGHIEMPSIDGTWTKVKVPEGSQSGDKLRLKEKGMPVINSSKRGDMYIQITVETPVKLTKKQKELLQKFDDEPNVDCNPQSTGFFQKVKSFWKDIRSN

SEQ ID NO: 15538 - protein, 509 aa, Amphibacillus xylanus
MLDKDIKQQLEQYLALLENDIVIKVSVGDDKVSKDTLELVNEIADMSSMISVEETTLERTPSFSINRKGEPDSGVVFAGIPLGHEFTSLVLALLQVSGRAPKVEASVIDAIKKVEGKHDFVTYVSLTCQNCPDVVQALNLMSVVNPNITHTMVEGSAFKDEVDRLNILAVPSVYLNGEFMASGRMTIEDILGHLGSGIDASELNEKDPFDVLVIGGGPAGASSAIYAARKGIRVGIIADRFGGQVMDTLGIENFIGTKYTEGPKLISEIEQHVNEYNIDVMKGLRAHNIEKKDLFEVQLDNGAVLKSKTIILATGARWRDIGVPGEKEYKNKGVAYCTHCDAPLFEGKHVAVVGGGNSGIESALDLAGIVKHVTVFEFMSELKADAVLQERLRSLPNVDVILNAQTTEITGDETVKGISYIDRTTNEEKHVELQGAFIQIGLAPNTEWLGDTVERNQIGEIVIDKKGQTSVPGIFAAGDCTDTPYKQIIVSMGAGATAALGAFDYLLRN

SEQ ID NO: 15539 - protein, 466 aa, Oryza sativa
MAGEGSGGGGGAGAFEDEAEPTVTIGEYIEGIEAEELEADLVLGGDEGKECTYGGGYLKRQAVFSCLTCVPAGVAGVCTACSLACHDGHELGLVSLFIWVRRMSATRVILGVALAVAKLSIAIFCIKYLYDWVMRTQLMLGWFFLLKVVELWTKRKFRCDCGNSKFGSHVCKLCPEKDPENPANSYNHNFKGSYCTCGRPYPDPEAEKQVEMIQCCICEDWFHEDHIGLNSIEEIPRDEEGEPLYEDFICPKCSTKCYFLKLYPDTIWASNKQSSAPQAETTNSTVMNGNSSLGDIEKSENGALINHLNCEKTSDNENCPKDSVAPEKASLDDSSDGKCKLGMNICSNTPSADSEKKMPFFMSKSWREVICRCETCTDFYAQQGVAYLIDKEDSIEEYEKVAKQKREKKLEQQEGVEANFLNSLDHVQKIEILSGINDMKNELQSFLSISQINGDTSHVSVSGFEF

SEQ ID NO: 15540 - protein, 206 aa, Zea mays
  misc_feature (90)..(90): Xaa can be any naturally occurring amino acid
MGIATAIGEQWVIFRGKDERPGCVQNTCAHRACPLHLGSVNEGRIQCPYHGWEYSTDGKCEKMPSTNMLNVHIQSLPCFEQEGTVWIWPXRDDPPKATIPSLLPRSGFTCSLLMQGVHGLGGGWRLGSSMAASSSCSTTRHSSSPRASAPLQVLHIIGREDRVQIDDARRLHRRAVTPAAVRINEGIFLYRARVLPHDLVKGTTEP

SEQ ID NO: 15541 - protein, 302 aa, Escherichia coli
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIE

SEQ ID NO: 15542 - protein, 305 aa, Escherichia coli
MIKKIGVLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMK

SEQ ID NO: 15543 - protein, 492 aa, Mycobacterium tuberculosis
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFDQLEIKTILHRLLRRYRLELSRPDYQPRWDYSAMPIPMDGMPIVLRPR

SEQ ID NO: 15544 - protein, 282 aa, Nicotiana sylvestris
MASPQENSTTLDLIRQHLLDDNVFLEHYCSETETTTLIYSQSSSSSESLDQSFSFEPTLNYATTAQSSNLEVSTFFNNSKTEFDSFEFGTIPNVSAARSSSLKQTSFKERKPSLNIAIPVKQEVVQKVELAPTEKKHYRGVRQRPWGKFAAEIRDPNRKGTRVWLGTFDTAIEAAKAYDRAAYKLRGSKAIVNFPLEVANFKQEFNNEIRPLVNSSRKRVRETVNEEQLVINKEMKIEEERVPTAPLTPSSWSAIWDSGDGKGIFEVPPLSPFGAYSQLVMI

SEQ ID NO: 15545 - protein, 268 aa, Zea mays
  misc_feature (252)..(252): Xaa can be any naturally occurring amino acid
  misc_feature (259)..(259): Xaa can be any naturally occurring amino acid
MAIPLVLVLLPLGLLFLLSGLVVNTVQAVLFLTIRPFSKRLYRQINVFLAELLWLQLIWLVDWWAGIKVQVYADPATWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAISQGLTAPRNVLIPRTKGFVSAVSIMRDFVPAIYDTTVIIPEDSPKPTMLRILQGQSSVVHVRXKRHSMSXMPNSDEDVS

SEQ ID NO: 15546 - protein, 102 aa, Triticum aestivum
  misc_feature (28)..(28): Xaa can be any naturally occurring amino acid
  misc_feature (55)..(55): Xaa can be any naturally occurring amino acid
  misc_feature (77)..(77): Xaa can be any naturally occurring amino acid
  misc_feature (88)..(88): Xaa can be any naturally occurring amino acid
HLKESHRETTIIKTLTQADAECQILPDXTLFVAHDRHPTGWNHRPGYTPTDYPSXQNRLYRFCMEQSSACNCPSISXHLVWTHTILQXLSDPNVLHTFLDDT

SEQ ID NO: 15547 - protein, 206 aa, Unknown
  Candidatus Blochmannia floridanus
MFIKVNTKYFIDQYALQAQNQKLRSRSWFKLQSIDRLDKLLKQGMTVIDLGSTPGGWSSYVIKQISNLGTIVSCDILPMKKIAGVKFLQGDCSNINFLNEIDLKIKHKRAQVVLSDMSPNTTGISTVDVCKSIYLGKIALNMCCRFLAPGGSFLVKIFQGDGFDQYLYNLKCLFHKVKVRKPSSSRSHSREVYIVSKDFKYKRINI

SEQ ID NO: 15548 - protein, 494 aa, Nocardia farcinica
MSRHHEVIVVGAGVSGVCAAVELRRAGVSDVLVLEKAETYGGTWRANTYPGCACDVPSGLYSYSFAPNAEWSRLFGTQPEILDYVGRVAREHGLDAITRFGVEMLDARWDATDRRWRVRTNAGEFSATFLVAAAGPWNEPKIPGVPGLDEFPGEVFHSARWNHDYDLRGKRVAVIGSGASAVQFVPQIQPRVAALHLFQRTAHWVLPKLDHPVPELEKQLMRRVPFVHTALRGLEYAVMDGVVGTAFHRPKPLMHGLQAIGRAYLRLAVPDPELRHKLTPGYLLGCKRILFSNNYLQSLTRPNVAVHATAVDRIDGSTVVGADGSAAEVDAVILGTGFHILDMPLADLVHGADGRSLAQHWGGSPEAYRGTVVSGFPNLCIMLGPSLGTGHSSAFTIAEAQVAFLVRAVTTARREGWSSFEVRPRAQADYVDRVQAALGGTAYNADSCRSYYIDANGRNSFSWPWSTGRLVRTVSRFDPADFTVTVADDIEVPA

SEQ ID NO: 15549 - protein, 181 aa, Lactuca sativa
MASISSSAVATVNRSTPAQASLAAPFTGLKSNVAFPVTKKANNDFSSLPSNGGRVQCMKVWPPIGLKKYETLSYLPPLSDEALSKEIDYLIRNKWVPCLEFELEHGFVYREHHHSPGYYDGRYWTMWKLPMFGCTDSAQVMKEVGECKKEYPNAFIRVIGFDSVRQVQCISFIVSKPPGVL

SEQ ID NO: 15550 - protein, 175 aa, Glycine max
  misc_feature (112)..(112): Xaa can be any naturally occurring amino acid
  misc_feature (122)..(122): Xaa can be any naturally occurring amino acid
  misc_feature (125)..(126): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLKFELKHSFVYQEHNXSPKYYDRHYXTIXXLAMFRYTNTSQVWKELQETKTTYANNFMHIIKFYNIRQIHYINFIGYEP

SEQ ID NO: 15551 - protein, 97 aa, Colocasia esculenta
ATYKVKLVTPSGQQEFQCPDDVYILDQAEEVGIDLPYSCRAGSCSSCAGKVKVGDVDQSDGSFLDDEQIGEGWVLTCVAYPVSDGTIETHKEEELTA

SEQ ID NO: 15552 - protein, 149 aa, Triticum aestivum
MLRSFPQARPLLRRMGFDKRDAYFFKQIGKGMLCTYALFGAAWLWNETSPLGWWTLKPLPKEEKEMAHLYERREFPYPGDEEAVEEFIKSEGALGTTIGPKGFADTNVDSDKMQKQLQSKKFDQEAQNLWFRMRNEVAHELQEKGFGVE

SEQ ID NO: 15553 - protein, 262 aa, Sulfolobus solfataricus
MIGKVVFIGSGPGDPELITIKAKKYIETADVIVYAGSLVNPEILKWSRKDAEVYNSSSLTLNEIVEIMVKKASEGKLVARLKSGDSSIYGALFEEMWALEAAGIPFEVIPGITAAIAAASVIPIELTVPKLSQTVIITRASLRVPMQGSIKDFAKMVKIGATMVIYTGIHIIDRVVNDLKEGGLTDDTPVIVVYRATWPEQKIIKGTLADIVSKVREAKIYRDSVIIVGLSADPQQIKNMVRSSVYDPKHNHSYRPWKVEED

SEQ ID NO: 15554 - protein, 627 aa, Cytophaga hutchinsonii
MENRIYIVMGVSGCGKTTIGTLLAETLGINFYDGDAFHPISNIEKMAAGIPLTDEDRYNWLLDINKQAKESLSEGHSVVFACSALKESYRKLLAQQIEDTIVWIYLKGDLDTIHLRVKNRTGHFMSPALLQSQFNILEEPSSAMHIDTALDTDTIIHTIVKKLTKSAFGLVGLGVMGKSLARNFAANGVALSLYNRFVKGSEEQVAEKCIAEYPELQSAKGFEDLKTFAASLEQPRKIFLMIKAGEETDTFIEELVPYLNAGDVLIDGGNSYYGDTKRRIEFLARKGIYFIGTGVSGGEQGALKGPSIMPSGDPDAYALVEKYLTLIAAKDKQGESCCTYIGKDGSGHFVKMIHNGIEYAEMQLIAEVYAYLRYAIKIEPTEIAALFTEWNSGELNSYLLGITAALLIKKEGDAWLIDLILDKAGNKGTGNWATIAASELGQPATLITSALFARYVSTIKEHILVNTQPASVYHFNTAALSEIKDAYMLARIVNHQQGFMLIHEASQKYGWDLNFAEIARIWTNGCIIRSAFMEELIPALKKDSNIFTHPAILKQLKDLKPALKAFAVNALQYDLSVPSHLAALDYLNVLSGNYATANIIQAQRDFFGAHTYQKIGDSSGKYYHTEW

SEQ ID NO: 15555 - protein, 137 aa, Marchantia polymorpha
MARTKQTARKSTGGKAPRKQLASKAARKTAPVTTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 15556 - protein, 136 aa, Marchantia polymorpha
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNFCAIHAKRVTIQSKDIQLARRLRGERN

SEQ ID NO: 15557 - protein, 419 aa, Methanosarcina mazei
MSYKVTVMSYIEKIDPELFEAIKNEADRQEHKLNLIASENYASRAVMEAQGSIMTNKYAEGYSGKRYYGGCDFVDVAENLAIARAKELFGAKYVNVQPHSGSGANMAVYFSVLQPGDTILSMDLSHGGHLSHGSPVSFSGKLYNIVPYGVSKETEALDYDELLKLAKECKPRMIVCGASAYPRVIDFKRFREIADEVGAYLLADIAHIAGLVVAGVHPSPVPYADFVTTTTHKTLRGPRGGMIISKTEELAIGVNKAVFPGIQGGPLMHIIAAKAVAFKEAMSEEFRQDQDQTVKNAKVLCSCLKQKGFDIVSGGTDNHLMLVNLNNMNITGKDAEAALSKAGIIANKNTVPFETRSPFVTSGVRLGTPSCTTRGMKEKEMELVADYIEAAIKNSENDALLSEINIKVRDLCLKFPVYE

SEQ ID NO: 15558 - protein, 205 aa, Brassica napus
MEVKLWNDKREREMYENFAELYAIIKATEKLEKAYIRDLISPSEYETECQKLIVHFKTLSATLRDLVPNIERFAETYKMDCSAAVYRLVTSGVPATVEHRAAAMASTSSSASVVAECVQNFITSMDSLKLNMVAVDQVYPLLSDLSASLCKLSILPPDFEGKVKMKEWLVRLSKMGASDELTEQQARQLHFDLESSYNSFMAALP

SEQ ID NO: 15559 - protein, 136 aa, Marchantia polymorpha
MARTKQTARKSTGGKAPRKQLASKAARKSAPSTGGVKKPHRYKPGTVALREIRRYQKSTGLLIRKLPFQRLVREIAQDFKSDLRFQSSAIGALQESVESYLVSLFEDTNLCAIHAKRVTIQSKDIQLARRLRGERN

SEQ ID NO: 15560 - protein, 850 aa, Bacillus cereus
MTKRLINKSVLLLTIIVMLSSVYSFQNVKAVSNSKTTEVIIHYKEQSGNTKDWNLWIWGENSNGKSYEFTGEDEFGKYAKINIDGDYNRLGFIIRTSEWEKDGGDRWIENIKDGRAEVWILSGDEKVYNSKPSSDLSIQKATIDSFHEITVTTNVPFHIKEKKIEMEGIKIKSISPYDINSGDITNKVKIITDQKIDLKQTYKVKIENLADTNTEIGKVIRTEEFDKLFYYGGNDLGNIYTPQHTKFRVWAPTASEAKLVTYKKWNDKIGTEINMQQGEKGTWKAELKGNQKGLYYTYKVKIGDKWTEAVDPYARAASVNGDKGAVVDLEETNPKRWNTNKKPKLKNPEDAIIYELHVRDLSIQPESGIKQKGKYLGVTEKGTKGPEGVKTGLDHMKDLGVTHVQLLPIFDYASVNEEKVNEPQYNWGYDPKNFNVPEGSYSTNPYEPTVRITELKQMIQTLHDNNLRVVMDVVYNHMYNAAESNFHKLVPGYYYRYNEDGTFANGTGVGNDTASERKMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFVNGKENMEDRIKKGITAGIDYDTNSSTYLDPEQVLTYVEAHDNHTLWDKLELTNPGDSEEARKQMHKLSSSILLTSQGIPFLHAGQEFMRTKYGDHNSYKSPDSINQMDWLRRAAFNNEVDYMKGLIELRKKYPAFRMTSAEQIKTHVSFIDAPKNTVAYTIEGNKNEYFTVAHNANRESVEISLPSKGPWKVLVDGKQAGSKPLYVVHDNKIKVPALSSLVLKTEKPIK

SEQ ID NO: 15561 - protein, 136 aa, Marchantia polymorpha
MARTKQTARKSTGGQGPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 15562 - protein, 311 aa, Geobacter metallireducens
MTARKYSDEELKQRLTPLQYRVTRKSGTEPPFDNTYWNEHREGLYVDIVSGEPLFSSRDKFDSGTGWPSFTRPVAPNSVKEETDIGFGTVRTEVRSKEADSHLGHLFTDGPRDKGGLRYCVNSAALRFIPVDDLEKEGYGSYLPLFGRKAPAAAVKQVATLAGGCFWGMQDLLRKQPGVIATEVGYTGGSVPNATYENHEGHAEAVRIEFDPTKTSYEALLRFFFRMHDPTTLNRQGNDIGSSYRSAIFYHDAEQKRIAEKVKAEVDASGKWKRPVVTEIVPAGPWWRAEEYHQDYLVKNPGGYTCHWVRE

SEQ ID NO: 15563 - protein, 498 aa, Hevea brasiliensis
MAIPQAESHRARARPPVVRRVRLRQLLRVTSIAGGIQFGWALQLSLLTPYVQELGIPHAWASVIWLCGPLSGLVVQPLVGHMSDRCTSRFGRRRPFIFTGASLICFSVLIIGHSADIGWLLGDRGNTRPRAIGVFVFGFWILDVANNMTQGPCRALLADLTGKDHRRTRVANAYFSLFMAVGNILGFATGAFSKWFKVFPFTVTSACNVDCANLKSAFYLDIVFMVITAYLSITAAQESPLCLSDRSTPIAEDVSGQSSHAQEAFLWELFGTFRYFPWPVWTILLVTALNWIGWFPFLLFDTDWMGREIYGGKPNEGQNYNIGVRTGAFALMLNSVFLGVTSLFMERLCRKWGAGFIWGISNILMALCFLAMLITSYVANHIGYLGHDLPPHGIVIAAIVIFAVLGVPLAITYSVPYALISSRIEPLGLGQGLSMGVLNLAIVIPQVIVSLGSGPWDQLFGGGNSPAFAIGGLAAFAGGLVAILGIPRSGAQKPMALP

SEQ ID NO: 15564 - protein, 498 aa, Hevea brasiliensis
MVASIAAGIQFGWALQLSLLTPYVQLLGIPHTWAAFIWLCGPISGMLVQPIVGYHSDRCTSRFGRRRPFIAGGALAVAVAVFLIGYAADLGQLSGDPVAKSPKPRAIAVFVVGFWILDVANNMLQGPCRALLADLSGANQKKTRIANALYSFFMAVGNVLGFAAGSYTHLYKIFPFTKTKACDVYCANLKSCFFISIVLLLTLTVLALIYVREKPWSPERGNTAAGDEEEEDEGASESSPMPFFSEIFASLKNLQKPMWILLLVTCLNWVAWFPFLLFDTDWMGREVYGGDSNGNPDQVRLYDRGVRAGALGLMLNSVVLGFTSLGVEVLARAVGGVKRLWGIVNFILSFCLFMTILITKMAESHRRFATVGGGATVPLPPPGDVKAGALALFAVMGVPQAITYSIPFALASIFCNTAGAGQGLSLGVLNLSIVIPQMVVSVASGPWDALFGGGNLPAFVVGGVAAAASGIFAFTLLPSPQPDAPSAKTSRAVTAAFH

SEQ ID NO: 15565 - protein, 465 aa, Porphyromonas gingivalis
MEITDLAAEGNALCRIDDMVMFVPFAAPGDRCTVQVVKKKRNFMQGRIVSIESPSPIRKGPFCTHFTVCGGCKWQHIPYEIQLRAKEQQVTDALVRLGKVEVEEMQPILGSEQTEYYRNKLEFTFSNKRWLLPEEVQEVDGDFSPEVRYGLGFHIPGMFDKVLDIRECHLGAKVSDEIRLFIREYCMQDPERYPFFDLRNQEGLMRTLMIRTTSTGELMVVVVFFRDDVAAREALLAAVAERFPQITSLLYVINTKCNDTIGDQEVLLYHGREYIEEEMEGLKFKIGAKSFYQTNSRQAYQLYRIAREFAGLTGDELVYDLYTGTGTIANFVAGQAHRVIGIEYVPEAIEDARTNSLLNGIENTLFYAGDMKDILTNDFIEQHGRPDVVITDPPRAGMHESVIDAILFAAPRRIVYVSCNPATQARDLALLMADGRYRAVKSRPVDMFPHTHHVENVVLLVRNTE

SEQ ID NO: 15566 - protein, 498 aa, Hevea brasiliensis
MAIPQAESHRARARPPVVRRVPLRQLLRVTSVAGGIQFGWALQLSLLTPYVQELGIPHKWASIIWLCGPLSGLVVQPLVGHMSDRCNSRFGRRRPFIFAGAGLICFAVLIIGHSADIGWLLGDRGNTRPRAIGVFVFGFWILDVANNMTQGPCRALLADLTGKDHRRTRVANAYFSLFMAVGNILGYATGAFSNWFKVFPFTVTSACNADCANLKSAFYLDIVFMVITTYLSITAAQESPLGLSDRSTPIAADVSGQSSHAQEAFLWELFGTFRYFPWPVWTILLVTALNWIGWFPFLLFDTDWMGREIYGGKPNEGQNYNIGVRTGAFALMLNSVFLGITSVLMEKLCRKWGAGFIWGISNILMALCFLAMLITSYVANHIGYLGHDLPPNGIVITAVVIFAVLGVPLAITYSVPYALISSRIEPLGLGQGLSMGVLNLAIVTPQVIVSLGSGPWDQLFGGGNSPAFAVGALAAFAGGVVAILGIPRSGAPKPRAPP

SEQ ID NO: 15567 - protein, 452 aa, Porphyromonas gingivalis
MKQTFRFIKPIERITHLKPNATMMLFLASVLAVIMANSSLSTIYHEILEYPINLTIGGHEVFSHHGETMTLLQFVNDVLMVIFFLAVGLEIKQEILVGELSSFKKAMLPIVGAIGGMIVPVLFFLLVVHEGPGARGAAIPMSTDIAFALAALAVLGSRVPASLKVFLTALAVADDIGGIIVIALFYSSHINIGMLAIAFGILFIMYLMGRMHVSNLGLYFVCTFFVWLFFLQSGIHTTIAGVLAAFMIPARPGLHAKNLRAEMRSLFEAMPNDKIRQSGSSLILSHNQINVINSMRKIARKAISPMQLMEEYLSPIVGYFVLPLFAFANAGITLGGVTADALWGVPMAVFLGLFVGKPLGIYFFTYGFVKMRLCPWPEGMSRLNLMAVSLFGGIGFTVSLFIATLSYAGAEHLLFLNEAKLGIFVASIFAALVGIVTLRYELNLESAKAQKS

SEQ ID NO: 15568 - protein, 354 aa, Suillus bovinus
MAYQYHNDLLAPYLALSQGDKVQAEYVWIDGDGGLRSKTMTMTKKTTDIGQLRIWDFDGSSTNQAPGGDSDVYLRPAAIFKDPFRGGDNILVLAETFNNDGTPNRTNHRHHTKKVMDLAKDSVPWFGLEQEYTLFDADGTPFGWPKGGFPGPQGPYYCGAGTGKVFARDLIEAHYRACLYAGVNISGINAEVMPSQWEFQVGPCEGISMGDHLWMARYLLVRIAEQWGIKVSFHPKPLAGDWNGAGCHTNYSTKVMREPGGMKYIDEAIEKLSKRHAEHIAVYGEDNDLRLTGRHETGHIGDFSSGVANRGASIRVPRHVAAQGYGYLEDRRPASNIDPYRVTGIIVETTVLDK

SEQ ID NO: 15569 - protein, 417 aa, Haemophilus influenzae
MLEQMGKQAKDAAFILAQLTTAEKNRALSIIAEQLEQQAPLILAENAKDIELAKQNGLSDAFIDRLLLTQERLQGIANDVRHVISLADPVGKIIDGGTLDSGLKIERVRTPLGVIGTIYEARPNVTIDVASLCLKTGNAVILRGGKETQFSNKILIEVVQNALEQAGLPKFAVQAITDPNRELVMQLLKLDRYVDMIIPRGGSGLHELCKQHSTIPVIVGGVGVCHTFVEKSADQNKAIFVIDNAKTQRPSTCNTLETLLVQHSIAEEFLPKLVSHLATKNVKYHAKSTALNILKQAGANVCEVTEKELRKEWGSLDLNVVVVEDIHAAIEHIRQYGTQHSESILTSSQNLARQFINQVDAAAVYVNASTRFTDGGEFGLGAEVAVSTQKLHARGPMGLEALTSYKWVCEGEYTVRK

SEQ ID NO: 15570 - protein, 551 aa, Chenopodium glaucum
MWSQLSSLLSGKMDALATSDHASVVSMNMFVALLCGCIVIGHLLEENRWMNESITALLIGLATGVVILLISGGKSSHLLVFSEDLFFIYLLPPIIFNAGFQVKKKQFFRNFITIILFGAVGTLVSFTIISFGALSIFKKLDIGSLDLADYLAIGAIFAATDSVCTLQVLNQDETPLLYSLVFGEGVVNDATSVVLFNAIQSFDLTTIDHRIALQFMGNFLYLFIASTILGAFTGLLSAYIIKKLYFGRHSTDREVALMMLMAYLSYMLAELFYLSGILTVLFCGIVMSHYTWHNVTESSRVTTKHAFATLSFVAEVFLFLYVGMDALDIEKWRFVSDSPGTSVAVSSILLGLIMVGRAAFVFPLSWLMNFAKKSHSEKVSLNQQVVIWWAGLMRGAVSMALAYNQFTRSGHTQLRGNAIMITSTTTVVLFSTMVFGLLAKPLIMFLLPQPKHFTSCSTVSDLGSPKAYLPLLEGHQDYEVDVGNHDDGTEPTIARPSSLRMLLNAPTHTVHHYWRKFDDSFMRPVFGGRGFVPFVPGSPTEQSTHNLADRT

SEQ ID NO: 15571 - protein, 483 aa, Medicago truncatula
MWVLCLGALVTICIITRWVYRWRNPSCNGKLPPGSMGLPLLGESLQFFSPNTSCDIPPFIRKRMKRYGPIFKTNLVGRPVVVSTDPDLNYFIFQQEGKIFQSWYPDTFTEIFGQQNVGSLHGFMYKYLKNMMLNLFGPESLKKMISEVEQAACRTLQQASCQDSVELKEATETMIFDLTAKKLISYDPTESSENLRENFVAFIQGLISFPLNIPGTAYNKCLQGRKKAMKMLKNMLQERREMPRKQQMDFFDYVIEELRKEGTLLTEAIALDLMFVLLFASFETTSQALTYAIKLLSDNPLVFKQLQEEHEAILERRENPNSGVTWQEYKSMTFTFQLITETARLANIVPGIFRKALREINFKGYTIPAGWAIMVCPPAVHLNPAKYQDPLVFNPSRWEGMEPSGATKHFLAFGGGMRFCVGTEFAKVQMAVFLHCLVTKYRWRPIKGGNIVRTPGLQFPNGFHVQITEKDQKKHESECTTTY

SEQ ID NO: 15572 - protein, 677 aa, Prochlorococcus marinus
MTHINKGKPFPLGSSLTSQGVNFSLVATNAEYVEILLFEKEGSISPKSILKLDQNHNTGPYWHAEVKNLNEGCIYAFRVKQKNNAINNNYEKKVLLDPCSRGITGWESYKRENALKTQENTNSCLKSVVCDRKLFNFKDFPRPKHSWEETIIYELHIKSFTESNDKTESCFKKFLKKIPYLKELGITSIELLPIFCFDPTDAPSGLENFWGYSPINWFTPHFEYVSNESAEKNREEFRKLVEECHKSGIEVILDVVYNHTSEGDYKGPAICWKGIDENLYYFIGKDKNYQDVSGCGNTIAANRGLVRKLIIESLKCWASEFGVDGFRFDLGIALSRGENLSPLDNPPIFEDIECEPELVDIKFISEPWDCGGLYKLGDFPSKNTFTWNGHFRDDLRRFWKGDKDTAWNMSDKIKGTPSIYKEDTIFPKSINFITSHDGFTLKDLVTFNRKHNFANREQNRDGDNHNNSWNHGTEGPTTNLLINDLRKRQQKNLILSLLISKGVPMILMGDEIGRSQGGNNNSWCQNNLLGWMNWEHGQQDLELLEYFKYVIKIRKKLIHIFNPSFFPNNQTNENIPTYHWHGTKLDSPDWSSWSHTVAFSINEGNTNPLVWIGLNAYSKSIDFPLPKCKYNWLKVVDTSMSEIFEPLTINQKSVSIKSRSSLLIISEEVFLEKNNIF

SEQ ID NO: 15573 - protein, 91 aa, Glycine max
  misc_feature (45)..(45): Xaa can be any naturally occurring amino acid
  misc_feature (51)..(51): Xaa can be any naturally occurring amino acid
  misc_feature (80)..(80): Xaa can be any naturally occurring amino acid
MSRKIESLGVERVISGEGSHGMFGGYLYFSKAPSKEEFLPEAMRXIKALLXYDCLRATRSTFDRGLEARVPFLNKECYEXAMNIDPQCAMI

SEQ ID NO: 15574 - protein, 697 aa, Unknown
  Candidatus Blochmannia floridanus
MLNSIVHKFQYGQHTVVLNTGAIARQANAAVMVSIGDTTVLVTVVSSNQEKIDQGFFPLVVHYQERTYAAGKFPGGFFRREGRPSESEILTSRLIDRPIRPLFPKGFLNDIQIIATVVSVNPQIHPDIVAMIGVSAALSLSDIPFFGPIGAARVGYIKDQYILNPTTIELSNSKLDLVVAGTDSNILMVESAACVLSEQEMLNAIVFGHEQQQTVIQNINQLVKKAGKVKYDWKLKDMDILLSEYLSNLYRSRVNVSCLVGVNKKDRQEQLNNIKHDIIDITLREYNENIDVNEVMSFLNNLEIKLLRSSILRDNVRFDGRSPDMIREIDISAGILPRTHGSALFTRGDTQALVTATLGTERDAQNLDELTGDRVDRFLLHYNFPPYCTGEIGIVGAPRRREIGHGRLAKRGMLAVMPNSNEFPYTVRVVSEVTESNGSSSMASICGASLALMDAGVPIKESVAGVAMGLIKENSNFIILSDIISDEDHIGDMDFKVSGTRTGITALQMDIKIKGITYDIIEVSFKKARCALLRILDIMDQVIKIPRKDISEFAPRIYSIKINPDKIKDVIGKGGSVIRALTEKTSTIIDIEDDGVIKVISLNAEKAKQAVDRIQEITANIAIGSIYTGRVTHIVDFGAFVTLFAGKEGLVHISQITEKRVNRVSDYLKLGQEVLVKVLEIDRQGRMRLSMRGINHI

SEQ ID NO: 15575 - protein, 943 aa, Wolinella succinogenes
  misc_feature (188)..(188): Xaa can be any naturally occurring amino acid
MSENIVQTLSPLKVGRRSFLKMAALAGAMGASSAVASEGVVRSATTQELKEAHPGAKKIKTICTACSVGCGIVAEVKNDVWVRQEVAQDHPISLGGHCSKGAGMIDVLRSPKRVKYPMKKENGKWKRISWDQAMDEISAKMLQLRTDFGPDAVQFFGSAKVSTEQAYYIRKFAAFWGTNNVDHQARVXHSSTVAGVANTFGYGAMTNHLADIQKSKAIIIFGANPAVNHPVGFQHFLKAKEINGSKLIVVEPRFTRTAAKADMFAQIRPGTDIPFMYGMINLILKNGWEDKKFVAERTFGFEEIAKEAAKYTPEVVEDITGVPAQQLIDITRVYAQTKPGTLIWAMGLTQHTIGTSNTRLAPILQLILGNMGKPGGGTNILRGHDNVQGASDMGCLAENLPGYFPNAEPSFKHWANVWQVDFEWLKARFAPDMMFKNGFSLSRWWQGVLEEETIHNGPAGKLRAMVCMGNGLISVAQTEKVKQALDKLELFVMIDIFPHDAIAYTDRKDGVYLLPAASQYETSGTVTATNRSGQWRYQVVNPIYESKADQDILFAFAKKFGFYNEYVRALGDGKGNFVWPEDATREIAKGVKTIGLSGWLPERLKAHTDNWHMFDELTLEGKGPMKGEYYGLPWPCWSDKHPGTPNLYDNSLPVMKGGMGFRNNFGLKQELNGVEYDMLASEGSVPPGGTQKGGYPAITAANIEALAGITLTEEEKAKVAGKAWHTDLSMILVNKALEAGLCPYGNARARMFVKEWADQIPRHREPLHSPRTDMVAKYPSFKDKPNHFRVDTKYESIQMQKDWAKEFPLNLITGRLVTHNGQGIESRISPALSEIYPEMFIEIHPDRALKLGIKDGDMVWVHSPEGTKGYMKAKYSYSIKEDCVFAPFHWAGIHQGKDLSKNYPEGLVPYSVGESINTVTNYGYDIVTQIPETKGGLCRIEKA

SEQ ID NO: 15576 - protein, 95 aa, Glycine max
  misc_feature (29)..(29): Xaa can be any naturally occurring amino acid
ILWLQTPLANCKKIFKGSVKYAWATVSTXANGGVGFMLCFTEGPPVNFQHPINKLNPKKNGGAKGPFKFFNPKNHGGAFCLPFFVGKVVLSHTHL

SEQ ID NO: 15577 - protein, 356 aa, Citrus sinensis
MAAMASTAFAPSVSSTTNKLFDSSFHGAPMSPSLLRLQPIKSSRPNNLSISASASPPYDLNTFKFDPIKESIVSREMTRRYMTDMITYADTDVVVVGAGSAGLSCAYELSKNPNIQIAIIEQSVSPGGGAWLGGQLFSAMVVRKPAHIFLDELGIDYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIEEVPGMKALDMNSAEDAIVRLTREVVPGMIVTGMEVAEIDGAPRMGPTFGAMMISGQKAAHLALKSLGQPNALDGTYVGGVHPELILAAADSAETADA

SEQ ID NO: 15578 - protein, 195 aa, Brassica napus
SKLFADSKGYLVDDDGFDYMKLAFLREIKSQQRSLRDYSKTYARAKYFDEVKPWNERCDVAFPCASQNEVDQADAINLVNAGCRLLVEGSNMPCTAEAVDVFRKANVLIAPAIAAGAGGVAAGEIEVLRESNSMQWSAEDFESRLQEALKQTYEKALKAANDFGYQKESPEALLHGATIAAFLNIAQAMTDQGCV

SEQ ID NO: 15579 - protein, 164 aa, Medicago sativa
VRGDVSLFIFRSLFAFAVSLPVSFQVKIMAEAKPGLRKPTFTKVDQLRPGTSGHTLTVKVVNTKMVMQKGRPDGPQPRQMRIAESLVGDETGMIIFTARNDQVDLLKDGSTIILRNAKIDMFKGSMRLAVDKWGRVEVTDPADFTVKEDNNLSLIEYELVNVVE

SEQ ID NO: 15580 - protein, 332 aa, Unknown
  Rhodococcus sp. RHA1
MTIRTITALPAPSSPARFTESARTPLRAGLVQHRWRPDANALRTALTDAIGEAAALGAAVVFLPELTLSKYPADTRATGTPGRDAEDLTTGPTYSFAAAAAARHGVCVHASLYERADGPDGLGFNTAILVAPSGELLSRTRKLHIPVSAGYYEDTYFRGGPADDAYPVHRPAELDGAAIGLPTCWDEWFPEVARMYSLGGAEILVYPTAIGSEPSVPSFDTQPIWQHVIVGNGITSGTFMVVPNRCGNEGGIDFYGSSFISDPYGRVLVSAPRDEEAVLVADLDLDQRKDWLDLFPFLTTRRPDTYTRLTDPVDHAHPYGLPTTVSAAEARS

SEQ ID NO: 15581 - protein, 191 aa, Medicago sativa
FPFEKRSDSIPLSISQLPSVLKLFSIPEDSPQAKSMRETLEQCQAEPVAGESKTCANSIESMLEFVDKIIGSDSKHNVLTTSHPSPSAIPLQKYTILKVSHDISAPKWVSCHPLPYPYAIYYCHYIATGTRVFKVSLVGDVNGDKIEAVGMCHLDTSDWNPDHMIFRTLRIKPGKNVPVCHLLSINHLLWV

SEQ ID NO: 15582 - protein, 703 aa, Ostreococcus tauri
GMRASSCARAVALATPTPRRARCARGRRVARSALETGKPETRDRDAKRAKEALKREEADDEALRVRDVVDGVGAVVFKHENRRTFEVEYGAKKGSSENAYVIEGGEASMLVDTPDGTHARNYAAAIGTFGASARDAAYHAMLHVAPRRLDALAAAIANRGPEAAPVEVLCTNPGAQLIQQALKAESPLANERLIEAWKNDKGKLRARLRVVRNGESIDLGGRTVRFTLAPTPRWPDLMFVRDEKTQALFTSKFFSAHTGQAPGLTDEGGFEAFGEDWRFYFDCLLAPMSRQVDPLLARLPLKEEQLAKASAPVMKDKRNMFERMLSVKKREEPVGAEIDLYEGLASAIFPSHGPMVLSSVTELYREYKEWAAKAEASAESASVAIIYASAYGNTGAMAQAIARGVAKTGIRAEMFNCELASPSDVREVLKRSAGFALGAPTLGGTLPTPVQTALGEIVKDGDLEKPCGAFGSFGWSGEAVGMIADRLKDAGFKSAFEPLRCKFKPTSETLQLCEESGTDLAQAVRQKARRKQVLDRKLSPTSFAAGNDVDAAVGRIVGSLCAVTTKKDETQSAMLASWVSQASFNPPAITVAVAKDRAVESFLMTGGKFNLNVLKDGDEKQVVKALLKPFAPGENRFGDLDVDISENNGCAVVKRALACVECSVVRRMEAGDHWVVLAEVETGTLLDADGLTCIHHRKTGVSY

SEQ ID NO: 15583 - protein, 160 aa, Arabidopsis thaliana
PGRPTRPDFQFQILRSRSAAGPAADGRTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 15584 - protein, 589 aa, Prochlorococcus marinus
MTDPVAVIDQSQPELQLSLQCEIIAPNTTTIRSLDWKRSRFDIEFGLRNGTTYNSFIIEGEKKALIDTSHEKFRDSWLKLFKEQVNPQELDFLVVSHTEPDHSGLISYLLDFNPEIQIIGSKVAIQFLESQVHRPFKSQAIKTGCELDLGINPSNGIHHKLEFLSAPNLHWPDTIFSFDHATAILFTCDAFGLHYCSSDMFDIDPELILPDFRYYYDCLMGPNARSVLQALKRIKNLPKITTIAVGHGPLLRHNIDLWLSSYLSWSEKRNKGEGYAAVCYVSQYGFCDRLSQAIALGINKADAQVQLIDLRASDSQEISALIGEANAIIVPTWPHNTDAELQSAIGTLLAALKQKQWVAVYDAYGGNDEPIDVVANQLRSLGQKEAFSPLRVRGTPDANTFQRFEEAGTDLGQLLNRKKNIANIKSFSGDLMKAMGRISGGLYVVTASQGKGKEQRRGAMVASWVSQASFNPPGITVAVAKDRAIETLMQVGDRFVINVLQENNYQKLFRQFLKRFPPGADRFEGISILEDVTKGGPVLVDALAYLDCLVKQRLETTDHWVIYALVEHGNVANVESKTAVHHRKVGTSY

SEQ ID NO: 15585 - protein, 613 aa, Prochlorococcus marinus
MSNTTSHPLSQTKTDKHVVSIPIEEDLICLKCMSPRKLRFEIEYALEKGTTANAFLFTQINETNSSAVLVHPPGINFEEVFIAELINIISHKDTNLLVVIGHINPNRVALLKKLAEIFNHIEFVASNPAAKLLKDLWYQVKPSQLRNNEESNTIIPPLPNIKLIKQEQTIALFNEYEMQLIPSPTARWPGGLISFERKLGLLMSDKLFGAHLCNDLWAEPNRSSTEEERRHYFDCLMSPMISQVSSIIEKLEDLDIQTIAPGHGPAIETSWRSLLNDYQRWGEGQQKASLKVVLLFASAYGNTASIADSLAKGINSTGVKVDSLNCEFTPANELVQAIKEADAYLIGSPTLGGHAPTPIVAALGTLLAEGDRQKPVGIFGSYGWSGEALDLLENKLRDGGFEFGFNPIKIKFSPNNNIIKTLEETGTQFGRQLLKEQRRKKRRLGGGISTTKSDPALLALGKVIGSLCILTAFKNTEEESLSGAMVASWVSQASFNPPGITIAVAKDRAVETLLHKEDLFALNILNEENYHKLLKQFLQPFKPGADRFKGIQVDQSPGKQPILPEALAWLEGSVQQRMECGDHWLIYAQIHHGKVLSSDGVTAVHHRNTGANY

SEQ ID NO: 15586 - protein, 320 aa, Prochlorococcus marinus
DDVRRLIVSRELKSIPAVMQELGWMTSCGCAKCRPALNFYLLAAWPGEYVDDNQSRFINERVHANIQKDGTYSVVPRTWGGVTTASELRAIADVVDKFKIPTVKYTGGQRIDMLGVKKEDLPAVWADLNAAGMVSGHAYGKSLRTVKTCVGTDWCRVGTQDSTGLGIKLEKLMWGSWTPHKVKLAVSGCPRNCAEATCKDIGVVCVDSGYEIHFAGAAGMEVKATELLTKVTSEAEAVEMCTAVLQLYREQGFYLERIYKWAARVGIDRVQAQIVEDAENRKNLVERFAYSQRFAQIDPWAERATGGVDAHEFKKLEPMG

SEQ ID NO: 15587 - protein, 514 aa, Ipomoea batatas
MGNRTSRHKHGEKHRSEAGSHQTHIEYTKSPGQGAGLPVRPPSIPKSVSKSDAILGKAYEDVRAHYSLGKELGRGQFGVTYLCTEIRTGKQYACKSISKKKLVTKGDKDDMRREVQIMQHLSGQPNIVEFKGAYEDANSVYLVMELCAGGELFDRIIAKGHYSERAAASLCRSIVNVVHTCHFMGVMHRDLKPENFLLSDKTENAALKATDFGLSVFIEEGRVYKDLVGSAYYVAPEVLGRKYGKEADVWSAGVMLYILLSGVPPFWAETERGIFNAILKGELDFQTKPWPSISSIAKDLVRGMLAPDPKRRLTAAQVLEHPWMREDGEASDRPLDSAVLSRMKQFRAMNKLKKLALKFIAENLSEEEIHGLKAMFTNIDTDNSGTITYEELKKGLAQLGANLTEAEVKQLMEAADVDGNGSIDYIEFITATMHKHRLEREENLYKAFQYFDKDSSGFITRDELETAMKEHGIADAATIKEIISEVDADHDGRINYEEFCTMMRSGTKQQAKLF

SEQ ID NO: 15588 - protein, 619 aa, Ostreococcus tauri
AMASRVAAERKIMCRVAPDGRRARRRARAVRARAIETPETVRASDVEVVDGRRRLQTQATTVGADTTCIRSLDWDRDRFDIEFGLERGTTYNSYVIRGAPGNAALIDASHEKFRELYLATLRREIDPEEIKYVICSHTEPDHSGLIGDVLKMAPNATVLGSKVCLTFLENLIHEPFKSRAVKGGDVIDLGDGHELKFIMAPNLHWPDTMFTFDAKSKLMYTCDAFGSHFCSEDVFDSDLNALMPHYRFYYDCLMKPNARSVLTALRKCESEGADFVGICNGHGPLLRYNLDELVGGYKNWSESALAKAKANVAVFYTAEYGFCDRLSQSIARGLTKTETEVVMMDLLTADSQEVIETTKHASGIVVLSPPSSGPANDQLANIIGAVDSKQKFFIAESFGGADEPVDLLATKFAELGVTEAFSPLKVTNEPTEGVYQLFEEAGTDLGQLLTKKKTLADMKSAMSPEVAKALGRVSGGLYVVTAAQGDARSAMIASWIAQASFEPLGFTVAVAKDRAIESLMQVGDTFVLNCLPEDGYEPIMKHFLTRFPPGADRFEGVEWAPANCGAPILGDAVAFMECRVKSRMEANDHWIVYSEVFNGKVFNSDARTASHHRKVGSYY

SEQ ID NO: 15589 - protein, 333 aa, Glycine max
  misc_feature (232)..(232): Xaa can be any naturally occurring amino acid
MAIEHEDDLKDEKNPRPLDEDDIALLKTYGLGPYSTSIKKAEKEIKDMAKKVNDLCGIKESDTGLAAPSQWDLVSDKQMMQEEQPLQVARCTKIINPNSEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPDWETLLARAVANRTDACFIIXGVSFEIGKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 15590 - protein, 341 aa, Xanthomonas axonopodis
MSDLTHKIAVLGAGSWGTALAALLARHGHPTVLWGRDAAMVDTIDRTHENARYLPGIALPDSLRATTDLQAAVADATWILVVVPSHAFTETIRLIAPLRPPGAGVAWATKGFEPGSGRFLHEVARDILGPSVPLAVVTGPSFAKEVTLGLPTAITVHGDDAAFAQVVADAMHGPTFRAYTGDDMVGAELGGAMKNVLAVATGVADGMQLGLNARAGLITRGLNEMLRLAAVIGARPETLMGLAGLGDLVLTCTGDLSRNRRLGLALGRGQSLDEAIREIGQVVESVQTADEVMRQAEHHGIELPISNAVRAVLHGEITPEAGLKELLARERKPEYPQTLFT

SEQ ID NO: 15591 - protein, 965 aa, Colwellia psychrerythraea
MTSKTIVNSLAELEQTQDFIRRHIGPSESETQAMLNDLGVESVDALIDEIVPSDIRLADLPNVEESKTEVQALADLKAVASLNKVNDTYIGLGYFGTLTPNVILRNVLENPGWYTAYTPYQPEIAQGRLESLLNYQQMCIDLTGLELASASLLDEGTAAAEAMALAKRVSKNKKSNLFFISDDVYPQTIDVVKQRAEMFGFDIVVAPAADAAEHDIFGALIQYPGASGQVTDVSELIAKIHDNKGIVAVAADIMSLVLLKSPGELGADAVIGSSQRFGVPMGYGGPHAAFFTTLDKYKRSLPGRIIGVSKDTRGKNALRMAMQTREQHIRREKANSNVCTAQVLLANMAAFYAVYHGPQGLKTIANRIHRLADILCLGTATKGLTAVHANYFDTLTFNVDNKDEIVARALAANANFRTDVDGQISIALDETTTRENVAQLFDILLGEGHGLNVSDLDDQIVASGHSSIPASLVRESAILTHPVFNSYHSETEMLRYIKRLENKDLALNHSMISLGSCTMKLNATAQMIPVSWPEFANMHPFAPVNQAQGYKAMIDELAKWLVELTGYDKMSMQPNSGAQGEYAGLIAISKYHESRGDSHRNICLIPASAHGTNPASAMMVDMKIVIVACDKEGNVDMADLKAKAEELADNLACIMITYPSTHGVYETTIAEICNIIHDNGGQVYLDGANMNAQVGLTSPGFIGADVSHLNLHKTFAIPHGGGGPGMGPIGVKSHLAPFLPDHALINVDEATKGNGAVSSAPFGSASILPITYLYIALLGKKGVTDATKYAITNANYVSKKLSEHYPILYSGKNGRVAHECIVDLRPLKASSGVTEVDMAKRLMDYGFHSPTMSFPVAGTFMIEPTESESKVELDRFIEAMVCIRDEVRKVESGEWASDNNPLHNAPHTLADITEPWDRPYSIQEAVFPVVAVTANKFWPTVNRIDDVFGDRNLICSCPPIESYID

SEQ ID NO: 15592 - protein, 839 aa, Escherichia coli
MSKVRLAIIGNGMVGHRFIEDLLDKSDAANFDITVFCEEPRIAYDRVHLSSYFSHHTAEELSLVREGFYEKHGIKVLVGERAITINRQEKVIHSSAGRTVFYDKLIMATGSYPWIPPIKGSDTQDCFVYRTIEDLNAIESCARRSKRGAVVGGGLLGLEAAGALKNLGIETHVIEFAPMLMAEQLDQMGGEQLRRKIESMGVRVHTSKNTLEIVQEGVEARKTMRFADGSELEVDFIVFSTGIRPRDKLATQCGLDVAPRGGIVINDSCQTSDPDIYAIGECASWNNRVFGLVAPGYKMAQVAVDHILGSENAFEGADLSAKLKLLGVDVGGIGDAHGRTPGARSYVYLDESKEIYKRLIVSEDNKTLLGAVLVGDTSDYGNLLQLVLNAIELPENPDSLILPAHSGSGKPSIGVDKLPDSAQICSCFDVTKGDLIAAINKACHTVAALKAETKAGTGCGGCIPLVTQVLNAELAKQGIEVNNNLCEHFAYSRQELFHLIRVEGIKTFEELLAKHGKGYGCEVCKPTVGSLLASCWNEYILKPEHTPLQDSNDNFLANIQKDGTYSVIPRSPGGEITPEGLMAVGRIAREFNLYTKITGSQRLAMFGAQKDDLPEIWRQLIEAGFETGHAYAKALRMAKTCVGSTWCRYGVGDSVGLGVELENRYKGIRTPHKMKFGVSGCTRECSEAQGKDVGIIATEKGWNLYVCGNGGMKPRHADLLAADIDRETLIKYLDRFMMFYIRTADKLTRTAPWLENLEGGIDYLKAVIIDDKLGLNAHLEEEMARLREAVLCEWTETVNTPSAQTRFKHFINSDKRDPNVQMVPEREQHRPATPMNVSQ

SEQ ID NO: 15593 - protein, 391 aa, Brassica napus
  misc_feature (84)..(84): Xaa can be any naturally occurring amino acid
MAMAAAVIVPLGILFFISGLVVNLLQAICYVLIRPLSKNTYRKINRVVAETLWLELVWIVDWWAGVKIQVFADNETFNRMGKEXHALAACNHRSDIDWLVGWILAQRSGCLGSALAVMKKSSKFLPVIGWSMWFSEYLFLERNWAKDESTLKSGLQRLNDFPRPFWLALFVEGTRFTEAKLKAAQEYAASSELPVPRNVLIPRTKGFVSAVSNMRSFVPAIYDMTVAIPKTSPPPTMLRLFKGQPSVVHVHIKCHSMKDLPEPEDEIAQWCRDQFVAKDALLDKHIAADTFPGQKEQNIGRPIKSLAVVLSWACLLTLGAMKFLHWSNLFSSWKGIALSAFGLGIITLCMQILIRSSQSERSTPAKVAPAKPKDNHQSGPSSQTEVEEKQK

SEQ ID NO: 15594 - protein, 254 aa, Symbiobacterium thermophilum
MQLFSLEGRVALVTGAGRGIGRALALGLADAGADVVCLARTGSEVEAAAEEVRARGRRALAVTADVTSQAQVTEAVEAALDRFGKIDILVNNAGINIRKPALEVAEADWDRVVQTNLKGPFLVAQTVGRHMCERGYGRIINVASVGGAVALRTGVAYGASKAGLMHMTRILAMEWARYGVTVNGIGPWYFRTPLTEKLLQDEQYVAEILARTPMRRIGDLAELVGPVVFLASDASSYVTGQVLMVDGGMSVYGF

SEQ ID NO: 15595 - protein, 555 aa, Arabidopsis thaliana
MEVSNQTRKRKAIDAGHGSQPTAYRGSDGVDLSLLEALEKSSHNGVEALDLKTLKKLVLSFERRLRDNIAARLKYVENPEKFADSEVDLHDDLQKLKVLAGAPELYPDLVASNTVPSIVNLLSHENSDIANDVVQLLQDLTDEDALEDNDEPARVLVDALVENNVLELLVQNMNRLSEADPDEATAIYATLTVIENLVEVKPAVAQLVCERTKLLRWLLTKIKVREFEGIKQYASEILAILLQNSTANQKRLGQMNGVDAVLEGVAMYKSKDPKTPDEEEMLENLFDCLCCLLMPLENKERFVNAEGVELMIIIMKQKKYAYGSAIRALDFAMTNYPPACERFVDVMGLKTAFAAFMGKASFSIPFLFTIFMNCLVTYWIPLNKRIKRERYKEELEERVISLIASLFAGILRGSRRDRLLSKFVENEFEKIDRLMELYLRYSDRVRSEAERLDQLELDDLELDEDEKYNRKLESGLYSLQLVAVILGHIWCSEHSGMRARVELLLKQQKLSKTDVKQILQRRRNEDRREFSCSYQRCDLEKERKKLEIVQMAWYY

SEQ ID NO: 15596 - protein, 538 aa, Unknown
  Synechocystis sp. PCC 6803
MAEKLPHPQCLGVPGRSPRRESNLIFTMLSTDSRAKVYLMGAGLGPVAYLTQRAIAVLGRANVVIYDALVSQELFDLLPPDCERIFVGKRGGQPSTPQAKINQLLVDHYRRGKQVVRLKSGDPWIFGRIMPELATLVTHHCAYEVVPGISSAIAGAGLASIPLTAKDSGAGFFVMDGHDPHRWPWPALAQLPTLVILMGTKNLSLLVNELVRAGKSPHTPMAVIKNAGRPEQQTWEGTLADMVEKTQGQSLAPAVIVIGDVVSQRIIPALPPLPLTEKTILVTRAADQASQFTELLHQQGATVLAMAALEIVPPKDWQPLDQAIAKLGDFDWLILTSANGVEFFFQRLQHHGLDSRALAGLKLAVVGKKTAQSLEKFGLKPDFIPPDFIADALVEHFPHSPAGLKILFPRVESGGRAQLVQELSQKQALVTEVPSYQSACPGHMPEEVWQSIVNQTVDVITFASSKTVSHFRQLLAQTSQANGYQDWRSLINHCQIASIGPQTSERCLRELGRVDIEATEYTLEGLTGAITNYVYQNP

SEQ ID NO: 15597 - protein, 536 aa, Enterococcus faecalis
MKTPETRKKSFFPKQNLGGYHLKFKELGLAPELLSAVERAGFEEATPIQSETIPLALAGKDVIGQAQTGTGKTAAFGLPMLNKIDADNRVIQGLVIAPTRELAIQTQEELFRLGRDKKIRVQAVYGGADIGRQIRGLKDRPHIVVGTPGRLLDHINRRTLKLETVETLVLDEADEMLNMGFLEDIEKIISQVPEQRQTLLFSATMPPAIKNIGVKFMKQPEHVKIKAKEMTADLIDQYYVRSKDFEKFDIMTRLLDVQTPELTIVFGRTKRRVDELARGLEARGYKAEGIHGDLSQQKRMSVLRSFKNGNLDILVATDVAARGLDISGVTHVYNYDIPQDPESYVHRIGRTGRAGKGGMSVTFVTPNEMGYLHVIENLTKKRMTPLRPPTEKEAFKGQLSAAVETIESDLEENGLDKYLESAEALLEKYSATDLAALLLKTVAKDPADAVPVKITPERPLPSNKKGFNKNGRGGGGGNNRNRNRGGNGKGGSYRGNKNHKDGDRNYKNSDRKNKDQRGGKRHNDKKRGFVIRENAK

SEQ ID NO: 15598 - protein, 244 aa, Oryza sativa
MEGEDDDDEEEEDVDDDDLLDDNEDDDDDYSFEDDFESDDEQDLYVGDGGAGGGISLAGTWWDKEALALAEEVSNSFDGDLKIYAFKTAANLTIRVRIEKMSTRYGSPTIDDIEAFTIAYRAKMDDAESAGRIPQNISLEVSSPGVERVIRIPDDLERFKERAMYVRYTITSDGGEGMTPQEGDGVFRLISYDMDLCECTWGIADVKINRQQAGKGRPLSKKQREWRLQTPFESLKLVRVHSDC

SEQ ID NO: 15599 - protein, 417 aa, Streptococcus agalactiae [sequence omitted]

SEQ ID NO: 15600 - protein, 440 aa, Prochlorococcus marinus
MENRQINFFKSKDFNTVLKPFKKGTVVKIDSLDVKESPNELKIGLFGWYAICPSKELKNNKLYYFSLFDEPLVLYRDENENVRCIKNICPHRGASFFEGSLSDGVITCPYHGAKFSSGGSCQNLDRITCKHIVDNNYDNYAKRIHLSQYKALEKNGYIFVHFSKKSDTDLSNISEDVPISNYELYENGFLHKDYVFEEVLVDFKCDWSRIIENHLDILHLFWVHGDTIPDKDVNKNVLVSFNQKINVTHKYIESIYYYKNEPTKEFIRIKYIPPGRILIYKGDPSAARYLQVLDHIPLGNNKARVIVRHYRKFLRNKLLNNLMLFKENQRKIFYKIFDEDYMILKTQTYNHNMGFISKDEIKLLGEDRIINYFWKWYKKSEDKDEPWKNNIKNQNLDVYDKVILKYPPEIKKLEIVNNIEIIRKTLVRFAAPLIFFILII

SEQ ID NO: 15601 - protein, 469 aa, Xylella fastidiosa
MGAPAKNDALVIALKEVIGGRLSDAFHIREKLQRRDAIAAVKDDVIQQLAGRLEVEGWNLAELLKEFGELEYRTMRDALLDTKVRIDGRSLEAVRPITVKVGVLPRVHGSGLFTRGETQAIVVTTLGTARDGQVIDAVTGEYKENFLFHYNFPPYSVGECGRFGVQKRREIGHGRLARRGVLAVMPSLDEFPYTIRVVSEITESNGSSSMASVCGSSLALMDAGVPVKAPVAGIAMGLVKEGERFVVLSDILGDEDHLGDMDFKVAGTSEGVSALQMDIKIEGITEEIMRQALQQAKVGRLHILGEMDKALAAPRAELSDYAPRLLTIKIHPDKIRDVIGKGGSTIQAITKDTGTQIDIQDDGTIVIASVNNAAAREAKRRIEQITSDVEPGRIYEGKVAKIMDFGAFVTILPGKDGLVHVSQISSERVERVGDKLKEGDVVRVKVLEVDKQGRIRLSIKAVEEEVASI

SEQ ID NO: 15602 - protein, 472 aa, Zinnia elegans
MSDPHTIDPELIQKLVHDALVWSSLHGLVVGDRNVERSGLVPGVGMVHAPIALLPNSFPEVQWNQACELAPIFNKLVDRVSLDGKFLQDTLSRTKKVDAFTSRLLDIHSRMLQIGKKEDIRLGLHRSDYMLDEKTNLLLQIELNTISCSFSGLGCLVSDLHRSLLSYYKKQLGLDSQKVPINASASKFAEVLAKAWTEYSNPSAVVMVVVQPGERNMYDQHWLTATLKERHNVTSIRKTLAEIDAQGKILADGTLQVDGETVAVIYFRAGYAPTDYPSESEWKARLLMEESSAIKCPSISYHLTGTKKVQQELAKPNVLESFLENKDDIAKVRECFAGLWSLDDLDAVKSAIQKPEAYVMKPQREGGGNNIYGDDVKETLLRLQKEGSEEEAAYILMQRIFPAVFPTVLVRDGICYKEHAVSELGIFSAYLRNKETVISNEQCGYLMRTKVSSSNEGGVAAGFAVLDSLYLI

SEQ ID NO: 15603 - protein, 771 aa, Pseudomonas amyloderamosa
MKCPKILGALLGCAVLAGVPAMPAHAAINSMSLGASYDAQQANITFRVYSSQATRIVLYLYSAGYGVQESATYTLSPAGSGVWAVTVPVSSIKAAGITGAVYYGYRAWGPNWPYASNWGKGSQAGCVSDVDANGDRFNPNKLLLDPYAQEVSQDPLNPSNQNGNVFASAHYRTTDSGIYAPKGVVLVPSTQSTGTKPTRAQKDDVIYEVHVRGFTEQDTSIPAQYRGTYYGAGLKASYLASLGVTAVEFLPVQETQNDANDVVPNSDANQNYWGYMTENYFSPDRRYAYNKAAGGPTAEFQAMVQAFHNAGIKVYMDVVYNHTAEGGTWTSSDPTTATIYSWRGLDNATYYELTSGNQYFYDNTGIGANFNTYNTVAQNLIVDSVAYWANTMGVDGFRFDLASVLGNSCLNAVHASAPNCPNGGYNFDAADSNVAINRILREFTVRPAAGGTVWICLRNLGPSAATRTSWVDSRRVVRVEWSVPRQLRQAQNELGSMTIYVTQDANDFSGSSNLFQSSGRSPWNSINFIDVHDGMTLKDVYSCNGANNSQASYGPSDGGTSTNYSWDQGMSAGTGAAVDQRRAARTGMAFEMLSAGTPLMQGGDEYLRTLQCNNNAYNLDSSANWLTYSWTTDQSNFYTFAQRLIRSARHIPLRPSSWYSGSQLTWYQPSGAVADSNYWNNTSNYAIAYAINGPSLGDSNSIYVAYNGWSSSVTFTLPAPPSGTQWYRVTDTCDWNDGASTFVAPGSETLIGGAGTTYGQCGQSLLLLISK

SEQ ID NO: 15604 - protein, 240 aa, Pinus strobus
MEHLNTAAAAQASSSLYGVNMAEYGDAGVSSMMGLITQHEPEQSENIMSTRMPSSFSSFHGHADCLLSAAMFQVSQGDHKLKPQPGMNQQLVSEQSIMSDSSMPSVKSKVCSGLRNQFEFHREQPGNCYTDQSSNMPISPIVTSLASQARGEARMIPSLDANSAHFNVDNEEHAIKSKILAHPQYPSLLGAYIDCQKIGAPPEAVARLDALTREHQDQQRRTASIGMDPELDQFMEAYCE

SEQ ID NO: 15605 - protein, 377 aa, Unknown
  Candidatus Blochmannia floridanus
MVKSDYYEILGVSKNADEREIKKSYKRLAMKFHPDRNPGDVSAESKFKEIKEAYEVLSNPEKRSAYDQYGHAIFEQNSGGMGGSNTGGSDFSDIFGDVFGDIFGGSRRSRSRRGSDLRYDIELSLEEAVKGVVREICVPTLVTCLQCRGSGAKSSASIVSCVTCHGHGQIQMRQGFFSVQQSCPSCNGHGKIIKEICNKCRGSGRIERTKTLSVKIPAGVSTGDRIRLSGEGESGKNGAPAGDLYVQVQIKKHPIFDREEKNLYCEVPISFSMAALGGEIEVPTLDGRVKLKIPPETQTGKLFRMRGKGVKSVRGIGGHGDLLCRVVVETPVRLSDRQKQLLQDLSDSFGGPYGHKNSPKSKTFFDGVKKFFDDLTR

SEQ ID NO: 15606 - protein, 292 aa, Pseudomonas fluorescens
MSRTVTVAATQMACSWDLEANLETAEKLVREAAAKGAQIILIQELFEAPYFCQKPNPDYLQLATTVDSNAAIAHFQKVARELQVVLPISFYELAGRARFNSIAIIDADGSNLGIYRKSHIPDGPGYHEKYYFNPGDTGFKVWNTRYAKIGVGICWDQWFPECARSMALQGAEILFYPTAIGSEPHDQTISSRDHWQRVQQGHAGANLMPLIASNRIGNEEQDGYDITFYGSSFIANQFGEKVQELNQTEEGILVHSFDLDELEHIRSAWGSFRDRRPNLYGALKTLDGSLES

SEQ ID NO: 15607 - protein, 180 aa, Medicago sativa
YRIGELITSGSHSSNSSPNNSMHNDATNLAPIKEMLKDTPLRSVALNPREKTSCKLLFKKSISHDVRLFRFALPYEEQLLGLPVGKHIFLCATIDEKLCMRAYTPTSSVDEKGHFDLVVKIYLKGVHPKFPNGGLMSQHLDSMPIGSTLDIKGPLGHIEYTGRGNFMVHGKHKFAKRLTM

SEQ ID NO: 15608 - protein, 506 aa, Oryza sativa
MAAAPAAAGLQAPAPPARPRLVVAAAARHVALAPRRAVASRAISAEAPLGVAPAAAEKEMAAVVDPDGGGGPPSGAPATGSSSATARNRLWSYIAGRFDGLHSASSCHVLDQEFHMRSGTIPGVGLVHAPFALLPTRFPASFWKQARELAPIFNDLVDRVSLDGEFLQDSLSRTRQVDDFTSRLLDIHAKMMEVNKEEDIRLGLHRSDYMLDSGTNSLLQIELNTISSSFPGLSSLVSELHRTLLNRHGKVLGLDSKRIPQNWAATQFAEALSMAWTEFNNKRDGQTVSVVYFRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGGNNIYGYDLRETLVRLQKEQGEALAAYILMQRIFPRASLTHLVQGGVCFEDLTISELGIFGAYLRNKDKVVLNNQCGYLMRTKVSSSNEGGVAAGFAVLDSILLTDEVILHTN

SEQ ID NO: 15609 - protein, 591 aa, Triticum aestivum
  misc_feature (324)..(324): Xaa can be any naturally occurring amino acid
MCGILAVLGVGDVSLAKRSRIIELSRRLRHRGPDWSGIHSFEDCYLAHQRLAIVDPTSGDQPLYNEDKTVVVTVNGEIYNHEELKAKLKSHQFQTGSDCEVIAHLYEEYGEEFVDMLDGMFSFVLLDTRDKSFIAARDAIGICPLYMGWGLDGSVWFSSEMKALSDDCERFISFPPGHLYSSKTGGLRRWYNPPWFSESIPSAPYDPLLIRESFEKAVIKRLMTDVPFGVLLSGGLDSSLVASVVSRHLAETKVARQWGNKLHTFCIGLKGSPDLKAAKEVADYLGTVHHELHFTVQEGIDALEEVIYHIETYDVTTIRASTPXFLMSRKIKSLGVKMVLSGEGSDEIFGGYLYFHKAPNKKELHEETCRKIKALHLYDCLRANKATSAWGLEARVPFLDKNFINVAMDLDPECKMIRRDLGRIEKWVLRNAFDDEKKPYLPKHILYRQKEQFSDGVGYSWIDGLKDHANAHVSDSMMTNASFVYPENTPTTKEAYYYRTVFEKFYPKNAARLTVPGGPSVACSTAKAVEWDAAWSKLLDPSGRAALGVHDAAYEEEKAPASVDPVLENAFHPPAHGESTLVKSAVPAAAV

SEQ ID NO: 15610 - protein, 882 aa, Arabidopsis thaliana
MAAWSPSVGIGSCCLNNGITRTWKFPSARLFTGRKNKIKLGSETLMFTRKRFMGDLVTSALQSYQFSKICASKTSIELREALSSRRAEADDLKKVTSYSFRTKAGALVKVKVEKKREKYSILVYVSSLELSGDDKSRLVMVWGVYRSDSSCFLPLDFENSSQDSQTHTTETTFVKSSLSELMLGLEFDGKESPFYLSFHLKLVSGRDPDGQEMLTHRDTDFCIPVGFTAGHPLPLGLSSGPDDDSWNFSFFSRSSTNVVLCLYDDSTTDKPALELDLDPYVNRTGDVWHASVDNTWDFVRYGYRCKETAHSKEDVDVEGEPIVLDPYATVVGKSVSQKYLGSLSKSPSFDWGEDVSPNIPLEKLLVYRLNVKGFTQHRSSKLPSNVAGTFSGVAEKVSHLKTLGTNAVLLEPIFSFSEQKGPYFPFHFFSPMDIYGPSNSLESAVNSMKVMVKKLHSEGIEVLLEVVFTHTADSGALRGIDDSSYYYKGRANDLDSKSYLNCNYPVVQQLVLESLRYWVTEFHVDGFCFINASSLLRGVHGEQLSRPPLVEAIAFDPLLAETKLIADCWDPLEMMPKEVRFPHWKRWAELNTRYCRNVRNFLRGRGVLSDLATRICGSGDVFTDGRGPAFSFNYISRNSGLSLVDIVSFSGPELASELSWNCGEEGATNKSAVLQRRLKQIRNFLFIQYISLGVPVLNMGDECGISTRGSPLLESRKPFDWNLLASAFGTQITQFISFMTSVRARRSDVFQRRDFLKPENIVWYANDQTTPKWEDPASKFLALEIKSESEEEETASLAEPNEPKSNDLFIGFNASDHPESVVLPSLPDGSKWRRLVDTALPFPGFFSVEGETVVAEEPLQQLVVYEMKPYSCTLFETINTTA

SEQ ID NO: 15611 - protein, 448 aa, Zea mays
MATPGEQPAEVVSVEMPAPDGWTKKFTPLRGGRSEIVFVSPTGEEIKNKRQLSQYLKAHPGGPAVSEFDWGTGDTPRRSARISEKVKVFDSPEGEKIPKRSRNSSGRKGKQGKKETPETEEAKDAETGKEAEEAPSEDAAKETDVEMKPAEEVKGASAETEDADMADAPAPAPMEEDKKQTEELAEAIAAPPVPSEEKKDVKPAEPEAAASNPTEDSAPAPAEPADVAAPAAEPKSDAKPAAVAAPVPETKSDAEPAAVAAPAPETKSDAEPAAVAAPAPETKSVAEPAAVAAPAPETKSDAEPAAVAAPVPETKSDAEPAAVAAPVPETKSDAEPAADAAPVPEMKSESEPAAVAAPASETKSDAEPAAVAAPAPETKSDAEPAAAAAPVPGTNSDAAATDPAPGTKATAADPAPGAPAENSTDKDGSQESQPVNNGQLPHSTVKCT

SEQ ID NO: 15612 - protein, 59 aa, Glycine max
EVKLWNDKREREMNDNCGELYVFFKAADRIEKAHVRDIISPQEYELECPKLIARRKTLG

SEQ ID NO: 15613 - protein, 495 aa, Unknown
  marine gamma proteobacterium HTCC2080
MIPETNAKTYKAVSVAIVGGGFGGVGAAIRLLKAGVKDLTVFERSGGVGGVWHANTYPGAACDVPSHLYSFSFAPGTEWSRRYAPQADIERYLNTLVDDFGVRPHLRCNTSVESAEFDAEVGAWHVRTSDGESRNFDLLIAACGQLSNPAIPELEGIDAFEGPTFHSANWDHDCDLTGKRIAVVGTGASAIQFVPEIAKQAGQLDIYQRSAPWIMHKFDREYPEWEKRLFRKVPARVGLSRRFFFSVFEILTYGFTNRHWVLKPMAKLSNAYRRKELGEYPKLLAKATPDYQIGCKRALFTNDWYPTLKRDNVELVHGQAPRVTATGLVDAEGVERPADVIIWGTGFQPLDFVAPMEIRGLEGRELSEVWNGRPEAYLGTTVAGFPNFFMMYGPNTNHGSGSVPYSNECQYNYILDAVERLCAGGYRYLDLEADALKRWRTEMAERSAETVWTQGGCNSWYVTDSGVNTNNWPGPWLEYKRRTQQIDVSDYRFVK

SEQ ID NO: 15614 - protein, 66 aa, Glycine max
ICYTENQVNGEIYNHEELRKQLPNHTFRTGSDCDVIAHLYEEHGENFVDMLDGIFSFVLLDTRDNS

SEQ ID NO: 15615 - protein, 220 aa, Zea mays
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAPGKAFLDAVA

SEQ ID NO: 15616 - protein, 659 aa, Bacillus pumilus
MHIFETRLILFNTVQNTNGMTRRWSFLVQCFTFKKKEGVRSRYMSDYNYVEVLQKSILFYEAQRSGKLPESNRLNWRGDSGLEDGKDVGHDLTGGWYDAGDHVKFGLPMAYSAAVLAWTVYEYREAYEEAELLDDMLDQIKWATDYFLKAHTGPNEFWAQVGDGNADHGWWGPAEVMPMNRPAFKIDEHCPGTEVAAQTAAALAAGSIIFKETDAPYAAKLLTHAKQLYAFADQYRGEYTDCVTNAQPFYNSWSGYIDELIWGGIWLYLATNDQTYLNKALKAVEEWPKDWDYTFTMSWDNTFFASQILLARITKEKRFIESTERNLDYWSTGFVQNGKVERITYTPGGLAWLDQWGSLRYTANAAFLAFVYADWVSDQEKKNRYQTFAIRQTHYMLGDNPQNRSYVVGFGKNPPMHPHHRTAHGSWSNQLTTPSSHRHTLYGALVGGPNAQDQYTDDISDYVSNEVATDYNAAFTGNVAKMVQLFGQGQSKLPNFPPKEKVEDEFFVEAAVMSNDTTSTQIKAILYNRSGWPARSSQSLSFRYYVNLSEIFAKGFTDKDIQVTAVYNEGASLSPLTVYDASSHIYFTEIDFTGVAIFPGGESLHKKEIQFRLSAPNGANIWDASNDYSFQGLTSNMQKTARIPVFDQGDLVFGTLPNK

SEQ ID NO: 15617 - protein, 124 aa, Unknown
  Frankia sp. BMG5.4
PLMRSKTRIVKGGKEPEIWGFDGSSTNQAPGSNSDCVLQPVFTCPDPLRGGDNVLVLCEVQLTDFTPHPTNTRAAARAVAEKYADMSPMFGIEQEYTFFQNGRPLGWPEVRLPRGAGPVLLRRR

SEQ ID NO: 15618 - protein, 489 aa, Escherichia coli
MKRMLINATQQEELRVALVDGQRLYDLDIESPGHEQKKANIYKGKITRIEPSLEAAFVDYGAERHGFLPLKEIAREYFPANYSAHGRPNIKDVLREGQEVIVQIDKEERGNKGAALTTFISLAGSYLVLMPNNPRAGGISRRIEGDDRTELKEALASLELPEGMGLIVRTAGVGKSAEALQWDLSFRLKHWEAIKKAAESRPAPFLIHQESNVIVRAFRDYLRQDIGEILIDNPKVLELARQHIAALGRPDFSSKIKLYTGEIPLFSHYQIESQIESAFQREVRLPSGGSIVIDSTEALTAIDINSARATRGGDIEETAFNTNLEAADEIARQLRLRDLGGLIVIDFIDMTPVRHQRAVENRLREAVRQDRARIQISHISRFGLLEMSRQRLSPSLGESSHHVCPRCSGTGTVRDNESLSLSILRLIEEEALKENTQEVHAIVPVPIASYLLNEKRSAVNAIETRQDGVRCVIVPNDQMETPHYHVVRV

SEQ ID NO: 15619 - protein, 489 aa, Phytophthora infestans
MADLSDIGLFGLAVMGQNFALNMASHGFKVSVCNRSPDKVDATVQRAKDEGNLPLVGFKDMKEFVASLARPRKVVILVVAGKPVDLTIAALSEFMEPGDIIVDGGNEWFPNSVRRASELEPKGIHFVGMGVSGGEEGARNGPSLMPGGPKEAFDALEPIITKCAAQVDDGACTTYLGPIGSGNYVKMVHNGIEYGDMQLIAEAYDILKIAGGLTNDELASVFDEWNKGELESFLIEITAQIFAKKDDLTDDGYVVDKILDKTGMKGTGRWTVQEAAERSIAAPTITASLDARYLSARKDERVFASKILSGPSEIPAVDKQQLIDDVRQALYASKICSYAQGLNLIREAGVQMGWNVDLGECARIWKGGCIIRAKFLDRIKSAYTKDASLISLLVDPDFAAELQARQYSWRRVVSLAVASGIPAPSFSGSLNYYDTFRRERLPANLTQAQRDFFGGHTYERTDREGLYHCAWSAAHHSIGDVSERIRGNL

SEQ ID NO: 15620 - protein, 238 aa, Picea glauca
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPSVKTEVCSGLRNQFEFHREQTGNCYTDQSSNTPVNPLVTSLASQARGEAQMIPSLDGNSPHFNVDNEEYAIKSKILAHPQYPSLLGAYIDCQKIGAPPEAVARLDALTREYQNQQRRTVSIGMDPELDQFMEAYCE

SEQ ID NO: 15621 - protein, 168 aa, Oryza sativa
MAAFTSTTTAAAASPTPCRPAALVARSSAAPLRSAAPVVVAAGLRRAAAPSRRGATLRVQAKKQTFSSFDELLEKSEKPVLVDFYATWCGPCQYMVPILQEVSEKLGDKIQVVKIDTEKYTSIANRYQIEALPTFIIFKNGKPCHRFEGALPANQLIQQIESALEVAK

SEQ ID NO: 15622 - protein, 244 aa, Pinus strobus
MEHLNAAAAQASSSLYGVSMAEYGDVGVSSMMALMTQHEPHESESTMTTSMPSSFSSFHGHAECLLSAAMFQASQGDHKLKRQPGMDQLVSEQAVMSDSSMPSVKTEGCSSIRNQFEIRREQSGNCYADQSSNAAPLVTSLASQTGGGAARMITSMEADSPHFNEGDAIKSKILAHPQYPSLLGAYIDCQKIGAPPEVAARLDALTREYENQQHRSTLSIGMDPELDQFMEAYCEMLTKYHEEL

SEQ ID NO: 15623 - protein, 297 aa, Deinococcus radiodurans
MTRTPDTVHLAVVQMHMTDQLEDNVERAAEHVREAARRGAQVILLPELFENLYFCQVEREDYFGLAHPLEGHPFIGRFQELARELNVVLPVSYFEKAGQAHYNSLVCIDAGGELLGNYRKTHIPDGPGYEEKYYFNPGDTGFKVWDTRFGRVGVGICWDQWYPETARVMMLQGADFLLYPTAIGSEPAEVETPNNHQMWQRAMVGHAVSNSSYVGSSNRIGKEIVGGLEQTYYGHSFISDYTGELVAELGDSEEGPLLHELNLKEARKFRAGMGFFRDRRPELYGPLLTTDGVTRRG

SEQ ID NO: 15624 - protein, 214 aa, Zea mays
  misc_feature (84)..(84): Xaa can be any naturally occurring amino acid
  misc_feature (102)..(102): Xaa can be any naturally occurring amino acid
  misc_feature (172)..(172): Xaa can be any naturally occurring amino acid
MGRRPAICYRQIKNKSYPKSRYCRGVPDPKIRIYDVGMKRKGVDEFPYCVHLVSWEKDNGSSEALDAARIACNKYYRPSTAGKXAFHLKIRVHPFHVLRINXMLSSAGADRFHTGMMGAFGKPQGTCARVDIGQVLLFVRCKDNYAAHASEVLRRAKLRIPGRQKIIESRKXAYTKFSRADYLKYKSEGRIVPDGVNAKVQLSHILLHLDISLN

SEQ ID NO: 15625 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYCEMLTKYHEEL

SEQ ID NO: 15626 - protein, 419 aa, Thermobifida fusca
MSTTVVLFTRDLRVSDHPALHAAVTEADRVVPLFVVDPALVRVSARNRIAYLLEALAELRGLLRERGGELVVRQGDTVAETVRIVAEAGAQAVYLSADVSAAAVRRARQLTEAVRAAGAHVRTFPGVTVVPPGALRPAHGDHYQIFTPYLNAWRAAQWRSPRPAPERVRLPEGLVPGPLPGAELIRLGTGVLAPQREQGGPRTARERIRAWLAQPNQDSRFGCHLHFGCLSPLEVALVAREHPRGALLLRQLALRDFHHQVLQAFPRLPRADYRPRPIQWRDDDSAFAAWCSGRTGVPIVDAGMRQLLWEGYVPGRIRMLTATYLTQVLRIHWKRGADHFYSLLVDGDVANNYGNWQQIAGTGGVPRPARRINLYRQAERYDPSGDYVRRFVPELRSISGSAVHHPPVPRPGGYPPPLR

SEQ ID NO: 15627 - protein, 485 aa, Thermobifida fusca
MTSSTEATSTPQVAVNDIGSEEAFLAAIDETIKYFNDGDIVEGTIVKVDRDEVLLDIGYKTEGVIPSRELSIKHDVDPHEVVAVGDHVEALVLQKEDKEGRLILSKKRAQYERAWGTIEKIKEEDGVVTGTVIEVVKGGLILDIGLRGFLPASLVEMRRVRDLQPYVGRELEAKIIELDKNRNNVVLSRRAWLEQTQSEVRQTFLNTLQKGQIRKGVVSSIVNFGAFVDLGGVDGLVHVSELSWKHIDHPSEVVEVGQEVTVEVLDVDMERERVSLSLKATQEDPWQQFARTHQIGQIVPGKVTKLVPFGAFVRVEEGIEGLVHISELAERHVEVPEQVVQVGTEIFVKIIDIDLDRRRISLSLKQANESISPDQTEFDPTMYGMVAEYDEHGNYKYPEGFDPETGEWMEGYEAQRDEWERQYALAQARFEAHRKQVQEAQAAEAAAAQEQQADDDSGSGQGGGELASDEALAALREKLAGGGES

SEQ ID NO: 15628 - protein, 290 aa, Pinus strobus
MEHMNTSAQSSSSLYGVHMVEYGGDVGVGSMMALMTEHQPESESIMTSIPIPSSYSSYSHGHGHGHGHGHGHGHGHGHSECLLSAAAMFQTSRPCQGSNKFEPANAHIGGGGGGGAGHFVMEQFIPEQAVISDSSISSVKTEVCSGSGGQFELIRRKEEGRCHARGYPEPSFVVTPLVSSLPPQQQEGRMVTSLAVDMDSSCSCKPNEADAMRAKIIAHVHYPRLVAAYIDCQKVGAPPEVVSELDDLSHKCQTQQCVPTISVGADPELDQFMEAYCEMFIKYQEELTKP

SEQ ID NO: 15629 - protein, 284 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 15630 - protein, 225 aa, Oryza sativa
MATLAKHLILCSTATSSSSSASSPTSARRRGTASQADAAAAAGERHQRGGPQSATRRLAVAASTALAATAALSARRPAAPPPAMAAEAAAVPPPPPGPGTVPRWGTRSYVRERFFEPGLTAEEAAARIRQTAEGMRTLRPMLETMSWKYVLFYVGLKSKYVDLDLTTAMFGVPEARRADYVRVANELVDDMTEFDRFVRTPKVYESYLYYEKTLKSLDDVTEFLA

SEQ ID NO: 15631 - protein, 665 aa, Avena fatua
MDASAGSSPPPHSQENPPKHGGGRGKAPAGEIRKGEAATADDFMFAEDTFPSLPDFPCLSSPSSSTFSSSSSSNSSSTLAAAGRGRGRCRGGAPEGALGEPSDPAAAGDDDVLDDIDELLNFATLSDSMPWEDEPLFPDDVGMMIEDAISHQPPATGHRGARNAASSEAAAGGGGQDSSSAADDLPRFFMEWLTNNRDCISAEDLRSIRLRRSTIEAAAARLGGGRQGTMQLLKLILTWVQNHHLQKKRARVDDELPSPGANPGYEFPAETVAPATSWLMPYQQAYGREAIYPNAAATGQYPFQQGGSTSSVVVSSQPFSPPAPVADMQAANMPWPQQYAAFPGAAPYPMPPPQPLAAAGFGVCPQPLAGVKPSASKEARKKRMARQRRLSCLQHQRSQQLNLGQIQNAMIHPQQEVPFSPRSAHSVPVSPPSPGGWCGLWPPPSVQVQGQGQLMVPNPLSTKPSSSSRQKAQKPSPDAGARPPSSGAQQGAKPGADKNLRFLLQKVLKQSDVGALGRIVLPKEAETHLPELKTRDGISIPMEDIGTSRVWSMRYRFWPNNKSRMYLLENTGDFVRSNELQEGDFIVIYSDVKSGKYLIRGVKVRPPQDLAKQKHGSLEKGSTSDAMPCAEDGGAEAGGCKGKSPHGVRRSRQEAASMNQMAVSI

SEQ ID NO: 15632 - protein, 745 aa, Triticum aestivum
MDRTSNFMPTPDQDVLDIQPLRTLAPMFPAPLGVNTFNVPNTTPPLIFVTSAGQFPGGVGAPGHPAFRSFAAAFGAQDAYGGQPASSGGQHDGGGHPASSRRQDGGGGQATTFADKYAANGGQTAANGATNLGASADSPIDVIPISAYRPTPPPVIPLDDDDDDNEHFTGNQTSASGRKIKRPSHLSGYKMSGGLGSDDNNGVKTKRNKTSHRKAGADNEFTSVPLSSSNPREAVEEVLMNFEALRRRHLQLDAAQESTKRPDLKIGAVMMANNLRANIRKRIGVVPGVEIGDIFYFRMELCIIGLHAPTMAGIDYMTHTFGDKDDDSVAVCIVAAGVYENEDDATDTLVYSGSGGSSKNNEEMHDQKLERGNLALQMSLSRKNVIRVVRGFKDPGSLGGKVYMYDGLYKIHESWKERTKTGINCFKYKLLREPGQPEGMSIWKMSRKWVENPATRGRVLHPDLSSGTENLPVCLVNDVDSEKGPGLFTYITQVKYPKPLSSMKPLQGCSCLNACLPSDTDCDCAEFNGGNLPYSSTGLLVCRKNRLYECGESCQCSVNCRNRVTQKGIRVHFEIFRTGNRGWGLRSWDPIRAGSFICEYVGEVIDESKRNLDGEDEDDYLFQTVRPGEKTLKWDYVPELMGEQITNNSADTFEPLPIKISAKKMGNISRFMNHSCSPNAFWQPVQFDHGDDGHPHIMFFALKHIPPMTELTYDYGEIGADSGGIGSPGAKRCLCGSSNCRGYFC

SEQ ID NO: 15633 - protein, 183 aa, Brassica napus
MAEVLRPEMLDISNDTSSLASPELLHVLAVDDSIVDRKFIERLLRVSSCKVTVVDSATRALQYLGLDGDNSSVGFQDLKINLIMTDYSMPGMTGYELLKKIKESSAFREIPVVIMSSENILPRIDRCLEEGAEDFLLKPVKLADVKRLRDSLMKAEERVFKNIMHKRELEANDIYSQLKRAKI

SEQ ID NO: 15634 - protein, 117 aa, Medicago sativa
MAAEEGQVIGVHTVEAWKEHLEKGNGSKKLIVVDFTASWCGPCRFIAPILAEIAKKLPNVTFLKVDVDELKTVAEEWAVDAMPTFLFLKEGKLVDKVVGAQKEQLQAAITKHATTDA

SEQ ID NO: 15635 - protein, 524 aa, Oryza sativa
MALKSPVDFAGSITSGQKDPCCFGVPGCNPRCVRYNKKSRTCRLVTRAISVDRPQLDFSDSDWKKQFQEDFDRRFSLPHLKDVIDVEPRPTTFSLKSRTPLENVNGSMQGSWNGYVNDDDRALLKVIKFASPTSAGADCIDPDCSWVEQWVHRAGPRKQIYFEPQYVKAGIVTCGGLCPGLNDVIRQIVLTLEKYGVKNIAGIQHGFRGFFEDHLAEVPLNRQVVQNINLAGGSFLGVSRGGANISDIVDSIQARRLDMLFVLGGNGTHAGANLIHEECRKRKLKVSIVGVPKTIDNDILLMDKTFGFDTAVEAAQRAINSAYIEAHSAFHGIGLVKLMGRSSGFITMHASLSSGQVDICLIPEVPFTLDGPNGVLQHLEHLIETKGFALICVAEGAGQEHLQQSNATDASGNMILGDIGVHLHQKIKAHFKEIGVHSDVKYIDPTYMVRAVRANASDAILCTVLGQNAVHGAFAGFSGITTGICNTHNVYLPISEVIKSTRFVDPNSRMWHRCLTSTGQPDFH

SEQ ID NO: 15636 - protein, 484 aa, Xylella fastidiosa
MHPLPTTTVDAPRLQNISHRLPSHPLSTSSTATTHPPHHLLTSQPLRCPVPHCQHPPPTPIPLHPRPYLMSHIRHLAQQCRDAARRLATLSTDAKRRLLETMATALNTDAATILAANAADLDAARTQQVGTAMLDRLALDPQRLAAMADALRDIAALPDPVGQVTRDDQRPNGIHVQKIRVPLGVIAMIYEARPNVTADAAALCIKAGNGIILRGGSEAIRSNIAIATALQRALRLASLPETALILVQDMARHTMLELLQLSDLIDLVIPRGGEGLIRFVAEHARIPVIKHYKGVCHQFVDASADIEMAIRLLIDGKTTRPAACNALETLLVHTDIAPRFLPAAAAALRPYGVQLRGDHATCTLLPDVVLATDADYAAEYLDLILAIRIVPNVDAALEHIRRYGSDHTEVIVTADPAHADTFVQQLYSAVVMVNASSRFSDGGALGLGAEIGISTTRLHAYGPMGLDALTVERFVVRGQGQVRH

SEQ ID NO: 15637 - protein, 354 aa, Brassica oleracea
FEKPSAIQQRGIIPFCKGLDVIQQAQSGTGKTATFCSGVLQQLDYTLVQCQALVLAPTRELAQQIEKVMRALGDYLGVKVHACVGGTSVREDQRILQSGVHVVVGTPGRVFDMLRRQSLRADAIKMFVLDEADEMLSRGFKDQIYDIFQLLPSKVQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGVAINFMTTDDERMLSDIQKFYNVVVEELPSNVADLL

SEQ ID NO: 15638 - protein, 184 aa, Unknown
  Rhodococcus sp. RHA1
MYEGDIASVLISEDEIRRRTVELAEEIAKRYPEGAPEGDLLLVGVLKGAIFFMTDFARALPIPTQMEFMAVSSYGSSTSSSGVVRILKDLDKDIAGRHVLIVEDIIDSGLTLSWLMRNLSSRNPASLEVVTLLRKPDAIKVDVNVANVGFDIPNEFVVGYGLDYAERYRDLPYIGTLEPSVYGG

SEQ ID NO: 15639 - protein, 117 aa, Unknown
  Frankia sp. BMG5.6
TRIVKDGKEPEIWGFDGSSTNQAPGSNSDCVLRPVYTVPDPIRGGDNVLVLCEVELTDFTPHPTNTRAKAPLVAEKYADMAPHFGIEQEYTVLPERSSARLAGSRLPGAAGPVLLRR

SEQ ID NO: 15640 - protein, 169 aa, Oryza sativa
MAANGSNVVSRGAVRFTEEQEALVLKSWAIMKNDSAHIGHRFFLKIFEVAPSARQLFSFLRNSDVPLEKNPKLKIHAMAVFVMTCEAAAQLRKTGRVTVRDTTIKRLGSTHFKNGVSDAHFEVAKFALLETIKEAVPASMWSPAMKGAWGEAYDHLVAAIKQGMKPAAA

SEQ ID NO: 15641 - protein, 114 aa, Unknown
  Frankia sp. BMG5.3
IVKGGKEPEIWGFDGSSTNQAPGSNSDCVLQPVFTCPDPLRGGDNVLVLCEVQLTDFTPHPTNTRAAARAVAEKYADMSPMFGIEQEYTFFQNGRPLGWPAAGYPEAQGPYYCG

SEQ ID NO: 15642 - protein, 113 aa, Unknown
  Frankia sp. BMG5.10
PLMRSKTRIVKGGKEPEIWGFDGSSTNQAPGSNSDCVLQPVFTCPDPLRGGDNVLVLCEVQLTDFTPHPTNTRAAARAVAEKYADMSPMFGIEQEYTFFQNGRPLGWPAAGYP

SEQ ID NO: 15643 - protein, 438 aa, Pseudo-nitzschia pungens
QNFALNMASHGFKVCVGNRSLAKVDSTVARAKEEGGLPLIGATSAEEFIARLRKPRKVVILVQAGKPVDETIKKLSTYMEPGDILVDGGNEWYPNSVRRSGELLHKGIQFIGMGISGGEDGARNGPALMPGGPKQAYDFVAPIFEKCAAQVERTGPCVGYLGPVGSGNYVKMVHNGIEYGDMQLIAEVYDVMKNVLYMPNDEIADVFADWNKTELDSYLIEITEICLRKQDDKTDGYLVDKILDKTGMKGTGLWTAKESAERAVAAPTIVAALDSRVLSSRKEERVAASKIFGPPKIEAVDKDQVIADLRAALYASKICSYAQGLSLIKAASDEFSWNVNLAECARLWMGGCIIRAKLLDSIQMAFSKNPALPNLMIDPGFAEQIIGAQSSWRRTVALCATSGIACPSLCGSLMYFDTYRRERLPACLTQAQRDFFGG

SEQ ID NO: 15644 - protein, 257 aa, Bartonella quintana
MALPDFTMHQLLEAGVHFGHQTHRWNPKMIRYIYGQRNNIHIIDLAQTVPLLHQALKLVSDTVARGGRILFVGTKRQASDIIADAANRSAQYYVNARWLGGMLTNWKTISNSIHRLRKLDKILATETQGFTKKERLNLERDREKLNRALGGIKDMGSVPDLIFIIDTNKENIAIQEAKRLGIPVIAIIDTNCNPDNVDHPIPGNDDASRAISLYCDLFARAALDGIARQQGAMGIDLGAQADAPVKPILENTIPVSE

SEQ ID NO: 15645 - protein, 469 aa, Porphyromonas gingivalis
MDKKMKRTRIADALHGGLVGQEINIKGWVRTKRGNKAVNFIALNDGSTIHNMQIVADLASFDAAQMSQITTGACIGVIGTLVESQGAGQSVEVQASAIEIYGTADPATYPLQKKGHTLEFLREIAHLRPRTNTFGAIYRIRHHMAIAIHTFFHNKGYYYFHAPLITASDCEGAGQMFQVTTLNPDSLPRTEEGQVDYRKDFFGRHTSLTVSGQLEGEMAAMALGGIYTFGPTFRAENSNTPRHLAEFWMIEPEVAFLEIEDNMDLAEEFIKYCVQWALDNCMDDISFLSEHFDKELIDRLKFVLEKPFVRLAYTEGIRILEEAVKNGVKFEFPIYWGADLASEHERYLVEVHFKTPVIMTDYPKEIKSFYMKLNDDGKTVRGMDVLFPKIGEIIGGSEREADYDKLVARANEMGVPEKDIWWYLDSRRYGTAPHSGFGLGFERLLLFVTGMSNIRDVIPFPRTPNNAEF

SEQ ID NO: 15646 - protein, 103 aa, Unknown
  Frankia sp. BMG5.12
IVKSGKEPEIWGFDGSSTNQAPGSNSDCVLQPVFTVPDPLRGGDNVMVLCEVQLTDFTPHPTNTRAAARKVAEKYADMTPNFGIEQEYTFFQNGRPLGWPATG

SEQ ID NO: 15647 - protein, 490 aa, Chlamydomonas reinhardtii
MAVAEIGLVGLAVMGQNLALNIAEKGFPISVYNRSYDKTEAAVKRAQKEGLGEKLHGYEQVKDFVQSLQRPRRVIILVKAGAPVDQTIDQLCEFMEPGDIIIDGGNEWYENTEKRMAKVAAKGILYMGMGVSGGEEGARRGPSMMPGGSPEAYSHIKSVVEKVAAQVDDGPCVMYIGGGGAGNFVKMVHNGIEYGDMQLISEAYDVLKTLGGLNNEELAAVFKEWNDAELKSFLVEITAIIVNKKDDQAPGYLVDQIVDQTGSKGTGKWTVQQAAELAVAAPTMASALDARYMSALKSERVAASKSFTSCVTPGPVAGVDKAQLINDVRAALYASKICSYAQGMNIIKAKSVEMKWNVDLGGLARIWKGGCIIRAQFLDRIRVAYERNPELPSLLVDPDFAKELTAAEASWRRVAALSITHGVPIPSMTSSLGYFDTYRRERLPANLVQAQRDFFGSHTYQRFDKEGWYHTVWDETFGSADSITTSGYVV

SEQ ID NO: 15648 - protein, 221 aa, Unknown
  Erythrobacter sp. NAP1
MARSGRDPDKRVKTAKKRTESSTRWLQRQLNDPYVKQAKADGYRSRAAYKLLELDEKFSLLRGTRRVVDLGIAPGGWSQVVRAKAPKAEIVGIDLLPTEPIEGVTIFEMDFMDDAAPEKLESALGGPPDLVISDMAANTVGHKQTDHLRTMALVEAGAWFAVETLEKGGAFVAKVLAGGTDAELLKLLKRHFKTVKHAKPPASRKGSSEWYVVAQGFKGRE

SEQ ID NO: 15649 - protein, 213 aa, Zea mays
MEVKLWNDKRERELLESYADLYAIIKVTEKLERAYVRDLVSAADYEAECLKLISQFNSLSSSLAGTVAVPRFVQAYRLDCPAALNRLLQSGVPATVELRAASASSAPAATSASAAAIAHCVQTFITAMDAVKLNMLANDQVRPLLQDVATSMARLGSLLPPDFEGKVKVNEWLGKLHKMGAADELTEQQARQLNFDLDSAYSAFLAALPAAGL

SEQ ID NO: 15650 - protein, 346 aa, Porphyra yezoensis
PSLMPGGPRSAYEALEPMLRSIAAQVDDGPCVTYIGTGGAGNYVKMVHNGIEYGDMQLIGEAYDVLKTVGGMSASEIAAVFEEWNESNLQSFLVEITAAILRTSDDLVGDGSALVEKVLDQTGAKGTGMWTVQEAAARLVPIPTIAAALEARYLSALKEDRTAASAVLAGPSTDAAPSVTAEEKAALVAAVRSALYASKICSYAQGMNLIRAAGKEYGWGLDLGSISRIWKGGCIIRAVFLDRIKAAYDVDAELASLLVDPGFASELASAQSAWRSVVTTAINAGVSVPAMSGSLAYYDTYRRTVLPSAQMVQSQRDFFGSHTYKRLDKDGVYHTRWSSDGVTETQ

SEQ ID NO: 15651 - protein, 230 aa, Oryza sativa
MAGRNNHELKLLGTWPSPFVVRVRLALGLKGLSYEYVEQDIRDKSELLVVSNPVHKKVPVLIHGGKPVCESQIIVQYIDEAFPGAGASLLPSDPHERAVARFWATYIDDEFATKFRAMGEAKEEEEKDEAAAQVFAALETLEEAMKGKVFFGGDSAGYVDVALGGFLGWIKAAEALAGVAFLDGARTPLLAAWAARFSALEAAKEAIPSVERLREFHGAMHAAAATVAGN

SEQ ID NO: 15652 - protein, 385 aa, Porphyra yezoensis
HYPDSIRRTKELEKQGILFVGTGVSGGEEGARYGPSLMPGGHPEAWPHIKDIFQAISAKSGDEPCCDWVGENGAGHYVKMVHNGIEYGDMQLICEAYSLLRTVLGLSNDKCADVFDEWNKGSLDSYLIEITANILRYKDTKDGKGDADTPSLVDKIMDRAQQKGTGKWTVGTSLDMGVPVTLISEAVFARMLSSMKEERVRASEKLSGPSSEFKGNAADFIEAVRQALYASKIVSYAQGYMLFREAAKEYNWNLNYGGIALMWRGGCIIRSAFLGDIRDAFTNDPELENLLLSPYFKKEVAGCSEGWREAVAVAARQGVPIPAFMTALAFFDGYRSATLPANLLQAQRDYFGAHTYERVDKKVGEYFHTNWTGTGGDITSNAYAA

SEQ ID NO: 15653 - protein, 2271 aa, Cryptococcus neoformans
MPMFRRSASSHSTSDAAAPPTITNVTEGSPVSSGSITRQKRSRSHGGGGSPASTFSSRFGISRHLSHQFQQPHEQEQGQVPPPEKPATREVPVSLEPEIYGSEAGEDSNFGQEPAGEQLIPETRSSSRQSRRSSRELSVQTIEPSSDDEIRSPEKRRVSPLMKRLGEEPPFMLPHPSLSDSTYQAYPGVVIGSFAGGGPDTLFGNGMQLEGTVDDILDPNAARQEDRGNQVPAGANIAPWLMDDGPPSRSENPSPALSETQERPVKGPAAALREKDPRKTSTVLNHFSSVPSLPKIRRHGRAATTTPDQTPRGSTHSQSNLASSSSSLNNESRESRAGSDDSIQTTLTQKGRRQSPGEWGQASAVPPPSKGTRPGRFGSTASIISGTGSVGEKKKSLFGGLLKRKTNPNLSLNPISHDFTTSEHRGSAGSIPLSASSSKLSSCSLSSLPSKSPPFTSPPEAFSRQFLPANYVHEGAVSPLQEISESPFHLDMNLDDMEGIIDPAKAGLPSTVAYRPSASSEVTTDSSASESMRLEEALNQTSSFGTSVSGASRGSDGTKMPGRIVLGEAERLPTPFTGTDPFQQHRESASTTGSDGKPFSPPSPHTLSPKHHLPSSSANQPRRPSALRNVETGQVDETPQLSASEGSIQPISPSWAGGSGITVFNDPFSTSRQRQEQPPNSAGLSPSTTAYPSAVTQPGPSTARFLITAGSTTPSAAWAAPESWGVEADEAPAEEITSSDEDDWAGLGVEEVASASPTSDTLPSPPTSPRASSLPSPKRAPPFGFKSQQRAKPGTSGTTDSTTSAAGRRKGKRVGSSGRPATGRPGTSGSAYNPSSLHWIRIYRADKSYMLYNLPLNTSTGELLALLAAQAEQGMVRGKNVAINMKLYICERGQNRMLLPSEKPLTIQHRRLLQLGHTEADHLDELGKNDMAVLCRFIYQAPILPIMDPEEESSYDSFEFIDIASRDLQTIPIFLHLHAHDIIILNISKNPMTDIPLDFIQACTSLKELRMSNMALKRVPISIRASTTLARLDVSCNRIADLESVALHEVETLVSLKVQNNKLTSMPSYFAQMKSLKYLNISNNKFETFPSVVCEMSNLVDLDVSFNNIAELPAKMSDLKSLEKLGLYSNDISKFPESFCTLANLRILDVRRNKITDLSAVYALPNLATLQADNNNIVTLDAQLGANVRQFSVPHNSVTRFTLAPPPNMAVVTYMLTNLDLSHGKISTLADEAFSGLTNLVTLNLNFNQFTKLPATLGRLTSLEVFSCTDNMLNLVPAGFGKLQRLRMINLHNNNLKSLPEDLWACGALEVFNASSNLLDSFIPPPADIESVVGRVGSGTSQTSNGRKKYSVPPIGLSIRKLFLADNRLNDDVFHWISLMPSLRIINLSFNDIYEVPPFTLCKCERLEALYLSGNKLTNLPSEDLEKLQSLKVLHLNGNKLQTLPSELGAIKTLQHLDVGSNVLKYNIANWPYDWNWNWNTSLRYLNLSGNKRLEIKPTSAHEMSHASSFRKELSDFTALTQLRVLGLMDVTLRIPSLPDESEEKRVRTSFSDINNMAYGISDMLGSIDNLAMFDLVVPHFRGKENECLFGMFGRVTTTLQGGKIAKYVQEIFAETLTAHLHQLEPGEEPSEALRRTFLLGDRKAFEFFSDKLQLEKERKPSWTSFASFDSMFRGWTPGVNSVLRTGASGAVVYLVDKVLHVGSIGDTLVVLSRKGDAELLSKRHDPTDREESARIRKAEAWVSTKGFVNDDKDLDISRAFGYWHECPAVNAAPEIRTRRLQESDEFVIIGNHALWQFCSYQTAVDIARTERDDPMMAAQKLRDFAISYGAEGNVMVMVVNVSDLFLAKGGRARGPSKQTATDANADVEGYAVAKRQVRRRYDEVGDRTLNRLQQEIEPPVGQVAIVFTDIVNSTHLWETNPAMPTAIKMHHNLMRRQLRLDGGYEVKTEGDSFMVSFQSVASALLWSFNCQIGLLQQEWPRELLEAHDGKVVYDSNGTIVQRGLRVRMGVHWGAPECEKDPITRRMDYYGPMVNRAARINASADGGQLMASQDVLNEIAPLMEYLNSSDEQVLNDLQGDLKREVMELRRIGLEVRDMGDRKLKGLEVPERLHLLYPKTLAGRLEISNEIRAEVEVNDARKSAERQRSVDIDQVYQLSDIALRLEAVCCYNPTPSSPGDTPTAGVMRLHPPASYLGPSIREDMNDEELWTIIESLVGRIENVMSTLYLKNFGEFSAVLAALESATKIDQKLIVHALALMNEAMGKDEENAI

SEQ ID NO: 15654 - protein, 566 aa, Mycobacterium smegmatis
MELLLVVVGAILVTAIAHHRGFEPALMIVVVGSAVSFLPDFEPPELDSHILLSVVLPPLLYSAALNFSFPTFLRHIRPILGLGVGLVVVSAFAVAAVSSWLVIVPLTFGTALVLGAIVAPPDAVTAVAVGRKLGLPKRMMAILTGESLINDAAALTLFSIAVTQVAGGHIFIENPLLLFGYSATVGPLVGAVLGYVTLWIRKRLANPGLETVQGLVVPFAAFITAEELHASGVLAVVVAGFVVGNGNLGAGYQTRLQERYVWNSVDVLLEAFVFAYIGLHLRFVLEHLNEAHESLTEVITASAVVLLIVLVIRPLSVFAIFGRNKLSRHVEKKLSVPAPDGSRSSLGAAVRKQRKKKRRANWRTMVDRRTLSWQENVVLSWTGMRGVVTLAAAAAIPAYTESGEPFPERATIQAIAFVVAVGTLLLQGSTLPWLIRKLHISRFNDDHEADRAEEVKAERVAHDAAEKILVEFQANPPANLNPALVEEIYIRIARHTQDVDEMPDPEAPIKRAAAFTTLYREVLAAQRAALIDQRDAGHIEDEAVRAMLERLDLQEAGVTARLESRL

SEQ ID NO: 15655 - protein, 618 aa, Wolinella succinogenes
MCGIVGYSQNHPQAIQEMLQSIRHRGPDDLGIYCDEGFSLGHTRLSILDLSHAGHQPMEFEHLVIVFNGEVYNFRAIQKELLGLGYTFFSDSDTEVILKAMHCWGEKAVDKFIGMFAFALWDKRKEELLLYRDRVGVKPLYYYFEGGELLFASELRAITAIKPNLALSQAGLYEYFQFGYISSNLSIHQAIHKLPAGHYLRFKAGKIEVKPYWSIHTFLEMPPFEKSEEELIDELEELLVDAFKLRMVADVPVGVFLSGGIDSSLVAAILQKHHGHIHTFTIGFENPRYNEALYAKGVAEHLGTEHTERILSAEEAREILYRFPEVYDEPFGDSSGIPTLLVSKVAKESGVKVVLSADGGDEIFCGYERYPIAHSLSRKILSLPYPLRAFAGRAMESFGAKRAGYLFKVRNLEHKFNQLSEMLRAKDLEEFYELLVHNSKNYEIKELLGETFPPKSRAFKVGERIHPMQGMMSWDYERYMVDDILVKVDRATMFHSIEGREPLLDHRIAEFAARLPFNMKFREGKTKYILRKVLERYLPKEMIERPKMGFGIPMFEWFSQDLRSLFETHFTPERLKSSGVLNPSYVLRELGKLQRGEPVNVNKLWLILVFLMWQEKAR

SEQ ID NO: 15656 - protein, 262 aa, Pinus strobus
FYGVNMSEYGDTGVGSMMALMTEQEPGNESIMSTMTMTIPSSAFSSYSHAGQVEGLLSAAAATMFNQGGHHHHQKHLVGGHFPPPEQLVMNEQAAVISDSSLSSVKTEVCSNQLDYHRKTSGGGGGGGGGRSCCPQPSLMVRAPQQQQQQRQQQHHHQHHQQEASRMVTSLEVDIDSACSSNPNDSIDALKSKIACHPHYPQLLAAYMDCQKVGAPPEVVTVLDDIIQENQLGRHSVTMDIGVDPELDQFMEAYCQMLIKYH

SEQ ID NO: 15657 - protein, 441 aa, Symbiobacterium thermophilum
MHGSSRSRRCRTWSEPSRRSTIVQEFDTQGRKNVETMEEAEARAELEAALRVPKPGDIVRGQVVRVSDDSIMVDVGYKSEGIIPLNELSHRPLRSAHDAGLKVGDEVQVVVLSVDTKGEGGLRISKRRADEQLAWAEVERKFEAGEVIEAEVTEAVKGGLVVDLGLRAFLPASQVDRGYVADLSKFVGQKIRVKIIELDPYKGRVILSRKQVLEAERTAARERFWSTVQEGDVLEGTVKSITDFGAFIDLGGVDGLLHISEMSYGRIKHPSQVVSEGERIKVKVLRLDREKGKVSLGLKQVLPDPWDSVEEKYPEGAIVEGTVARLTTFGAFVELEPGVDGLIHISQMADRRINNPGEVVSIGDVVKVKVINVDAQNRRISLSLRAAIEELAAEAIAADVATPYRDVVPAEAGEAPSGAEQQDEPAREAEESGSAEETQSE

SEQ ID NO: 15658 - protein, 248 aa, Picea glauca
FYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQQQHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 15659 - protein, 112 aa, Shewanella oneidensis
MKLVSAIIKPFKLDDVREAIAGIGIEGMTVTEVKGFGRQKGHTELYRGAEYQVDFLPKVKLEIATKAENLDMLIEAITTAAHTGKIGDGKIFVIDLEHAIRIRTGELDTEAL

SEQ ID NO: 15660 - protein, 140 aa, Unknown
  x Citrofortunella mitis
MQAALSISPTTLVPLTTSKNFSQVAIYTPKLVGSSLASRRSAIKVAATTSNDPSTFDYNSAFSVFPAEACEVIGGDACSAEMYPEAKLKPEAKNDTSTTASEPIEREYLEYNDTNTVFKGEACDDLGGTFCEREYQRGVY

SEQ ID NO: 15661 - protein, 119 aa, Medicago sativa
MGKSYPTVSADYQKAVEKAKRKLRGFIAEKKCAPLMLRLAWHSAGTFDSKTKTGGPFGTIKHQAELAHGANNGLDIAVRLLEPLKEQFPIISYADFYQLAEVVAVGITGWNLEIPFHPR

SEQ ID NO: 15662 - protein, 115 aa, Glycine max
  misc_feature (47)..(47): Xaa can be any naturally occurring amino acid
GSSLSTLKAKVHAFSVCDDPDYFHNFTQGLIDGLKAGVSSRDIVHIXTGKAAYAMVKDMSENPKKWEGRKILFIHTGGLLGLYDKVDQLASFVGNWQRMDVNESVPKHDGIGKMF

SEQ ID NO: 15663 - protein, 965 aa, Pseudomonas fluorescens
MITLFDPATDIDLNAVDFGTPARDSQVQVSLNIDGRSISVPQGTSVMRAAALMGTTIPKLCATDSLEAFGSCRMCLVEIDGMRGYPASCTTPVSEGMVVHTQTPKLATLRRNVMELYISDHPLDCLTCSANGNCELQTVAGQVGLREVRYGYDGANHLDDQKDTSNPYFDYDPSKCIVCNRCVRACEETQGTFALTISGRGFESRVAAAGGDNFLDSECVSCGACVQACPTATLMEKSVVQMGQPERAVITTCAYCGVGCSFRAEMKGDQLVRMVPDKNGQANHGHSCVKGRFAWGYATHPDRITKPMIRKHISDPWQEVSWDEAVSYAASELRRIQFKYGRDSIGGITSSRCTNEETYLVQKLVRAAFGNNNVDTCARVCHSPTGYGLKQTLGESAGTQSFDSVMQADVILVMGANPSDAHPVFGSQLKRRLREGAKLIVIDPRRIDLVDSVHARAELHLALRPGTNVAMLNALAHVIVTEGLVDQEFVSARCEPEAFALWSAFVSRADNSPEVLGAICGVPAADIRAAARLYATGGNAAIYYGLGVTEHSQGSTSVMGIANLAMATGNIGREGVGVNPLRGQNNVQGSCDMGSFPHELPGYRHISNQAVRQQFEQAWNVTLQADPGLRIPNMFEAALGGSFKGLYCQGEDIAQSDPNTQHVTAALSAMECVVVQDIFLNETAKFAHVFLPGSSFLEKDGTFTNAERRISRVRKVMEPLGGKADWEGTLALAAALGYPMHYSHPSEIMDEIARLTPTFTGVSYASLDRHGSLQWPCNDAAPDGTPTMHIDEFVRGKGRFMLTGYVPTDEKVNGRYPLLLTTGRILSQYNVGAQTRRTDNVAWHAEDRLEIHPTDAESRGINEGDWVGIGSRAGQTVLRARVTERVAPGVVYTTFHFPESGANVITTDNSDWATNCPEYKVTAVEVSRVYHPSEWQKRYQAFSEEQHRLLDKRGRSRGGKAEVRR

SEQ ID NO: 15664 - protein, 689 aa, Rhodopseudomonas palustris
MTKLNVALLATTALTLGSLIGHPAAAESASAPMLLAQAVQGGPAPAPSEEKAKEAPPPGPRPAPAPPKAAPSAPPPPPAAAPPHVAPPPPPPAPPRAAPPPPPPAAAPAPAPKRAEPPPPPPPSHSAPPPPPPHAAPPPPPAPKPSAPPTAAPAERPAAPPPAAAPVRPPAPPAGEAPQRRGPPPGAVPPNAVPPNAAAPDAAKPDAAKQPPGERRGPPPGAPGTPPNATAPGMTPPPGEAPRRGPPPPPAAANPPPAAAPTPAPSAAPQAAPTSPANPSGPAVAPVARPSGERGPQPGAPAGGPPPRPQAGPGAPGAGPAVAPPPGQPQPVPPQPGQPPAGPAVAPPAPPPPAVTAPIPPAPPPPQALTPIAPGAQAPGPRNMSDFRGQRREVNENGRIVITEPGRIIVRDPSGQEFIRHNEVDRFRYGARDIRTEQIRGGGTRTIVVRPDGTEIINITGDDGQLMRRIRRDRDGREIIIIDNSYGPRDRANFYVDLPPPVIRIPRDRYIVDYEDASPELIYETLEAPPVERIERRYTMDEIRYSPAVRQRMPSIDLNTINFDLGSWDIPPDQAAKLQAIADGLNRAIQRNPREVFLIEGHTDAVGNDTDNLSLSDRRAEAAAALLTQQFGVPAENLTSQGYGEQYLKIQTQAPERQNRRVTIRRITPLLNGGQAALPPPPPGVAPPR

SEQ ID NO: 15665 - protein, 320 aa, Trichodesmium erythraeum
MRIAHNITELVGRTPLVQLNSIPKAEGCLAKIIVKLEGMNPAASVKDRIGVNMINVAEREGLIKPGKTTLVEPTSGNTGIALAMVAAARGYKLILTMPETMSMERRVMLRAYGAELVLTPGSEGMKGAITKAQEIVDLSSNGYYMLQQFQNPANPEIHSKTTALEIWEDTDGKVDILVAGVGTGGTVTGVAETIKARKPEFQAIAVEPSNSPVLSGGKPGPHKIQGIGAGFVPDVLDTKIIDEVIQVPDSEAMVYGRRIAKEEGILSGISTGAALCAAIEVGKRPENDGKLIVMIQPSFGERYLSTPLFQELGPTLAEVR

SEQ ID NO: 15666 - protein, 328 aa, Unknown
  Polaromonas sp. JS666
MTLPDFQHFPNQFFTMKHSKVLILGSGPAGYTAAVYAARANLDPVLITGIAQGGQLMTTTDVDNWPADAQGVQGPDLMQRFLEHAERFKTEIIFDHINQVDLSKRPFTLTGDSGTYTCDTLIIATGASAKYLGLESESAFMGRGVSGCATCDGFFYRNQDVCVVGGGNTAVEEALYLSNIASKVTLVHRRDKFKAEAILIDKLHEKVAAGKIELRLHHTLDQVLGDASGVTGVRLKSTLHDTAQDLALKGCFIAIGHQPNTEIFAGQLEMKDGYIITKTGLQGFATMTSVPGVFAAGDVQDHVYRQAITSAGTGCMAALDAQRFLEQS

SEQ ID NO: 15667 - protein, 458 aa, Streptomyces coelicolor
MATSVVLFTRDLRLHDHPPLRAALDRSDAVVPLFVRDRAVDAAGFAAPNRLALLADCLRDLDSGLRDRGGRLVVRSGDLVEEVCAVAGEAEADEVHLAADVSAHAHRREELLRSALSARGCRLHVHDAVTTVLAPGSVTPASSDHFAVFTPYFRRWSERAVREPLAAPRRVRVPDGVGSEPLPARGDLTGLSPGLPTGGERDARKRLTAWLRGGIADYADHHDDLAGDATSRLSPDLHLGALSPVELVHRARRAGGPGAEAFVRQLAWRDFHHQVLAARPHASAADYRTRHDRWRTGAAAEADAAAWRDGRTGYPVVDAAMRQLRHEGWMHNRGRLLVASFLTKTLYVDWRVGAWHFLELLVDGDVANNQLNWQWAAGTGTDTRPHRVLNPTTQARRFDPGGTYVRRWVPELAGLAGRSVHEPWRLARAARAAYDAYPDPIVDLSEGLDRFRRARGRD

SEQ ID NO: 15668 - protein, 124 aa, Unknown
  Frankia sp. BMG5.2
PLTRSKTRIVKSGKEPEIWGFDGSSTNQAPGSNSDCVLQPVFTVPDPLRGGDNVLVLCEVQLTDFTPHPTNTRAAARKVAEKYADMTPNFGIEQEYTFFQNGRPLGWPATGFPEPQGPYYCGVG

SEQ ID NO: 15669 - protein, 382 aa, Campylobacter coli
MQAVKKIILSETFPGILLIFFTLLALLFKNSSLSVIYTDFFHANFTIGFDHFQIAKSLDLWINDGLIAIFFLCIGLELKYEILRGQLKNIRSVSLPIFGALGGMIVPALIFSAINYSHEFAMKGWAIPTATDIAFAVGILMLLGNRIPSSLKLFLLSLAIFDDLGAIVIIALFYTDQLSALAIIICLFCIFALLLLNYYHITHLSLYVLVGVVLWIAMLKSGVHATLAGVIIALFIPLDTKNKKPYLHEVHKDLNPWVVYFILPLFAFANAGIDLRDMHLGSVFSPVSLGIILGLFLGKQLGVFGFCYLAIKLKLAKLPENIKYGKFYGICILTGIGFTMSLFIDGLAYKNSDIFEYADKLAILVASFLSAIVGFIYLKIIK

SEQ ID NO: 15670 - protein, 96 aa, Unknown
  Frankia sp. BMG5.5
KTRIVKSGKEPEIWGFDGSSTNQAPGSNSDCVLQPVFTVPDPLRGGDNVLVLCEVQLTDFTPHPTNTRAAARKVAEKYADMTPNFGIEQEYTFFHN

SEQ ID NO: 15671 - protein, 399 aa, Streptomyces coelicolor
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGHLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDPRAELFQAAKGA

SEQ ID NO: 15672 - protein, 230 aa, Campylobacter coli
MNNIVHKLRTLVLNEAFGGVLLIVCTLLALLVQNGSFSEHYREFLNLKVGFSVGEFELNKPFLLWINDGLISIFFFAIGLELKKEFLHGDFKNPKNIVLPFMGALGGILIPALIFAIVNIGDAYTLKGWAIPTATDTAFALAILMMCGKHIPSSLKIFLLSLAIFDDVGAILIIAIFYTTKLSVAAFVVVGIAIFMMLILNILGITRKSFYFICSGILWISVFKVVCMQL

SEQ ID NO: 15673 - protein, 237 aa, Prochlorococcus marinus
AIFDDFGTLVIIAFSYSEGLSLPSLLMAGLGTLGLLALNRLRVASLTAYILVGVFVWVSVLESGVHSTLAGVIIAWCVPMRVAGREFLHKIEHDLSPWVALLIVPVFAFFNAGIDLRGVEFSTFFGPLGLGIILGLFIGKQVGVMLGVGLAVLLRIGDKPIGVSWGQLYGAALLSGVGFTMSLFVAGLAFDQPGAVLTVNLAVVVGSLLSAVSGLLVVDRTSARHGCSDSSKNGETA

SEQ ID NO: 15674 - protein, 377 aa, Prochlorococcus marinus
MADFYDLLGVSRDADADSLKRAYRRLARQYHPDINKEPGAEERFKEIGRAYEVLGDPQKRATYDQFGEAGLGGSAGMPDMGDMGGFADLFETFFSGFGGASSSGARSQRRGPQQGDDLRYDLTVDFQQAVFGQETEIKIPHLETCDTCNGSGAKPGTGPTACSTCGGAGQVRRATRTPFGSFTQVAECPACNGSGQLIANPCSSCGGQGVKQIRKKLRINIPPGVDTGTKLRVSGEGNAGLRGGPSGDLYVFLKVKSHPKLRRDGLTIHSEVNVSYLQAILGDTIEVDTVDGPTNIEIPIGTQPNAVLTLDNKGIPKLGNPVARGNHCILVKINLPTRLTEDEKTLLEQLATYHSAKGVQHHHHKSGLFGKLFSNNE

SEQ ID NO: 15675 - protein, 163 aa, Campylobacter coli
MHATLAGIITAFFIPMQTKNGEAFLEEIYESLKFWLAFVILPLFAFANAGVNLSNIDIGAIFSGVSIGIFLGLFVGKQVGVFLFSYLAIRFKFAALPQGSNLKQLYGVCILTGIGFTMSLFIDGLAYEVSDIFNYADNLAILIASFFSGIWGFIYLKFFTTRP

SEQ ID NO: 15676 - protein, 353 aa, Jaltomata procumbens
DAWDTSVAVEVKVGDSIEIVRFFHCYKRGVDRVFVDHPMFLEKVWGKTGAKIYGPKAGQDYLDNELRFSLLCQAALEAPRVLNLNCSKYFSGPYGEDVLFIANDWHTALIPCYLKSMYQSRGIYVNAKVAFCIHNIAYQGRFAFSDFPLLNLPYEYRGSFDFIDGYEKPVKGRKINWMKAGILESHRVVTVSPYYAQELVSTVDKGVELDNVLRKTSISGIVNGMDTQEWNPATDKYTDVKYDITTVMDAKPLLKEALQAAVGLPVDRKIPLIGFIGRLEEQKGSDILVAAIHKFIGLDVQIVVLGTGKKEFEQDIEQLEVLYPDKAKGVAKFNVPLAHMITAGADFMLIPSR

SEQ ID NO: 15677 - protein, 315 aa, Staphylococcus aureus
MRKRARIIYNPTSGKELFKRELPDALIKLEKAGYETSAYATEKIGDATLEAERAMHENYDVLIAAGGDGTLNEVVNGIAEKPNRPKLGVIPMGTVNDFGRALHIPNDIMGALDVIIEGHSTKVDIGKMNNRYFINLAAGGQLTQVSYETPSKLKSIVGPFAYYIKGFEMLPQMKAVDLRIEYDGNVFQGEALLFFLGLTNSMAGFEKLVPDAKLDDGYFTLIIVEKSNLAELGHIMTLASRGEHTKHPKVIYEKAKAINISSFTDLQLNVDGEYGGKLPANFLNLERHIDVFAPNDIVNEELINNDHVDDNLIEE

SEQ ID NO: 15678 - protein, 353 aa, Solanum accrescens
DAWDTSVAIEVKVGDSIEIVRFFHCYKRGVDRVFVDHPMFLEKVWGKTGSKIYGPKTGQDYLDNELRFSLLCQAALEAPRVLNLNCSKYFSGPYGEDVLFIANDWHTALIPCYLKSMYQSRGVYLNAKVAFCIHNIAYQGRFAFSDFHLLNLPDEFRGSFDFIDGYEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15679 - protein, 313 aa, Porphyromonas gingivalis
MSEHARCLIIGSGPAGYTAAIYASRANLNPILYEGIQPGGQLTTTTEVENFPGYPEGITGTELMEDLRKQATRFGADIRSGIATKADLSKAPYRITIDGEKEITADTLIISTGATAKYLGLADEAKYAGMGVSACATCDGFFYRKKKVAVVGGGDTACEEALYLASLAEHVYLIVRKNYLRASKVMQERVMNTANITVLFEHNTVGLFGENGVEGAHLVKRKGEPDEEMVDIAIDGFFLAIGHTPNSKIFADYLDLDEVGYILTEGSSPRTKVPGVFAAGDVADPHYRQAITAAGSGCKAAIEAERYLGEHGL

SEQ ID NO: 15680 - protein, 308 aa, Geobacter metallireducens
MEHTPFSLSGSIGSTPLVEIRKLNPNPKVRILAKLEGNNVGGSVKDRPALYMLAKAEAAGELSPERTILEPTSGNTGIAIAMLGAAKGYRVKLVMPACVSLERRAVLEAYGAELVLSPAEEATDGAIRLAHRILDEEPDRYYMPNQYANPNNPLAHYETTGPEIYRGTDGTVDFFVAGMGTGGTLMGVSRYFRETKPSVRIVGVEPRLGHKVQGLKNMQEAIVPAIYNPAALDLKLTVQDEPAFDTARDLAVREGLFVGMSSGAAMAGAIRVAKDAPAGSTIVVLLPDRGDRYLSTVLFRSVCGKCPP

SEQ ID NO: 15681 - protein, 330 aa, Haloarcula marismortui
MYSTHSILGALLRGPIVFSRCMQSYAQRDDDGTVPASVTDLIGDTPLVCLDSFAGNLLGKVEAANPYSVKDRIALYMVEAAAESGDLTDDGMVVEATSGNTGIGLAAVCAARGYDCVLTMPESMSEERRQLLSGLGADLELTPADGGMSGAIERANELADAPGTVRARQFENEANPRAHRETTGPEIWADTDGDVDAVVAGVGTGGTITGISEYIKERVGADLTSVAVEPEQSKLLSAADPDSHDIQGIGPGFVPDILRRDLIDEVRTASKAESVAASQRLASQAGIMVGISSGAALHAAAEYATEHPEETVVVVLPDTGERYLSTDLWE

SEQ ID NO: 15682 - protein, 509 aa, Unknown
  Bacillus sp. F5
MSQWWKEAVVYQIYPRSFYDSNGDGFGDLQGVIQKLDYIKRLGADVIWLCPVFDSPQDDNGYDISDYRSIYEKFGTNDDMFQLIDEVHKRGMKIIMDLVVNHSSDEHAWFAESRKSKDNPYRDYYFWKDPKADGSEPNNWGAIFSGPAWSAMSTAQYYLHYFSKKQPDLNWENEAVRREVYDLMTFWMDRGVDGWRMDVIGSISKFVDFPDYETDDSRPYVVGRYHSNGPRLHEFIQEMNREVLSRYDCMTVGEAGGSDVEEAKKYTDPSRHELNMIFTFEHMDIDTKQHSPNGKWQMKPFDPIALKKTMTRWQTALMNVGWNTLYFENHDQPRVISAGAMTRELRKQSRQSISNSSARHEGNPFIYQGEEIGMTNSEMPLEMYDDLEIKNAYRELVIENKTMTEEDFRKAVAKKGRDHARTPMQWDDGKYAGFTDGEAWLAVNPRYQEINVKESLADEDSIFYYYQKLIGLRKQNKVIVYGDYRLLLEEDPRIFAYIREYRGEKLLVP

SEQ ID NO: 15683 - protein, 387 aa, Gossypium hirsutum
MVHCLPKVFVIQDKPMLPSTAAVAKDEHRPLAFDASILGSESNIPSQFIWPDDEKPCLDAPALVIPTIDLGAFLLGDSLAVSKAAEVVNEACKKHGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFEQNDSILRLNHYPPCQKPELTLGTGPHTDPTSLTILHQDQVGGLQVFADEKWHSVAPIPGAFVVNVGDTFMALTNGFYKSCLHRAVVNTETVRKSLAFFLCPKLERPVTPAAGLVTAENPRKYPDFTWAALLKFTQNHYRADMKTLVAFSKWVQEQESNYKLIP

SEQ ID NO: 15684 - protein, 299 aa, Glycine max
MEGRRRGGYSGRRIVASRRGSGKSNANNNNNNNNNKNNNNINVIKKLQSREIWSKPHRAFASVTASHRFRSMCLTHQYDTHDPSKTPSSLWPFLMKRTKVVEIVAAKNVVFALYHSGLCAAFSRETDERICFLNVCPDEIIRSLFYNKNNDSLITVSVYASENFSSLKCRSTKIEYLRRGKPDAGFPLFQSESLKWPGFVEFDDVNGKVLTYSAQDCIYKVFDLKNYTMLYSILDRNVQEIKISPGIMLLIYNRTSGHIPLKIISIEDGTVLKVFNHLLHRNKKVDFIEQFNEKLINDS

SEQ ID NO: 15685 - protein, 342 aa, Symbiobacterium thermophilum
MDMAILPAGVWGTALAVPASAAGRRVRLWRRTPGWAESWDRGHPVLPGLKLPENVVACDSAQAAVSDADLVILSPAGAGLRPVCRLVRPHLRPDAVIVCATKSIEPETHLLVHQVVEEELPGHRGRIVALSGPNFAHEVAAGLPTGAVAACPDLSLADWVQQALMTDRFRVYTNPDLVGVELAGALKNVIALGAGISDGLGMGDNARAALITRGLVEMARLGRAMGANPLTFAGLAGMGDLVLSCTGDSSRNRRAGLAIGRGQSAEAFLAETGLTVEGITTARAGWQLAQRLGVRMPITEAIYQVLYEGLPPLTAMERLMARPRAHELEEVAGADLKPPFDP

SEQ ID NO: 15686 - protein, 245 aa, Leuconostoc mesenteroides
MIEQNYTNKNVLLTGAASGIGFSQLKTYLSQGATVYALDKEKITYTHKHLHTYQIDIRQHKKLEMLVEHITSDVSIDILLNTAGILDDYQPSLTIDLETWQRVMDTNLTPMFILSNAVLPKMIASGYGHIINMASIAGFTAGGGGAAYTTSKHAIIGYTKQLAFDYASKGLHINAIAPGAIKTPMNAKDFAGDASMAQQVANQTPAKRWAAPQEVADLTMFLTSPQADYINGTVVPIDGGWTLGH

SEQ ID NO: 15687 - protein, 242 aa, Prochlorococcus marinus
MFKFLKNIMNNEEVNLTNDAYSLHRILKTDIKKDPNLEEDEIIFGCGCFWGAEKCFWKLPGVITTSVGYAGGEKNNPTYYEVCSGLTGHSEVVRVIWDKRQIDLSDLLKMFWECHDPTQKNRQGNDMGTQYRSAIYYKNENNIPIILASKEQYQTELSKKNFGLIETEIKMIDSYFYAEQYHQQYLASAGSRQYCSASPTKVKLGVFSGSNYKLEDHIWENFNWEVDKCVLRSDNNPIKNNI

SEQ ID NO: 15688 - protein, 309 aa, Prochlorococcus marinus
MTATISRPKISNWETSNIPNLTGKTALITGANSGLGYYTAKALAEKNAHIVIACRSFEKANQTIKKLKGLNPEGIFTPLELDLSDLKNIVEVQSKIFDNFENLDLLINNAGIMHPPKTLSAQGYEIQFAVNHLAHMLLTLKLLPIIEKKEESRIVTVTSGAQFFGKVGWKNLKAENYYNKWESYSNSKLANVMFALELNENLKHKNILSLAAHPGIAKTNLFTAQKPNPSPLETFSLELFSPIFQTAEMGALPQLFAATSPDARGGDHYGPRFNFRGHPKLSPTSPFAMNKKERKNLWEKSLEILKNFL

SEQ ID NO: 15689 - protein, 172 aa, Bdellovibrio bacteriovorus
MAQLKDQMVSFLTSDEIKELVENLASQIEADYEGKEIVFICPLRGSIHFTADLMRKVDLPQQVDFVHVQAVERGGAIKIVKDISVNIAGKHVIVVEEIIDTGRTLSFLRSRLFASAPASLKIVTLLDKPARRELPIKADYIGKTIEDRYVVGYGMDSEELGRNYPDIYALKN

SEQ ID NO: 15690 - protein, 446 aa, Unknown
  Malus x domestica
MAPTRNTFRVGPTTCSTGTACFTPLGSPEAARCSAADMSRPTSTPLSVTPATLYFPTSSLASTASPLPPHVALSAARVLTGQYNPANGIGLANTSLAFFGDRLYALGESDLPYSLRLTSNGDIETLGRHDFDGKLSMNMTAHPKIDPDTGEAFAFRYGFIRPFLTYFRFDSNGVKQPDVPIFSMVTPTFLHDFAITKKHAIFADIQIGLNLIDMITKRATPFGLDPSKVPRIGVIPLYAKDESEMRWFEVPGFNGVHATNAWDEDDAIVMVAPNVLSAEHVLERVDLVHCLVEKVRIDLKTGIVTRQPISTRNLDFAVINPAYLGRKNKYVYAAEGDPMPKISGVVKLDVSNVEHKECIVASRMFGPGCYGGEPFFVAREPENPEADEDNGFLVSYVHDEKAGESRFLVMDAKSPQLDIVAAVRMPRRVPYGFHGLFVRESDLNNL

SEQ ID NO: 15691 - protein, 175 aa, Streptococcus thermophilus
MVREDAMERAIFAGGCFWCMVQPFEEQEGILSVRSGYTGGHVPNPTYEEVCRKTTGHTEAVEIIFDPEIISFADLVEIYWAQTDPTDAFGQFEDRGDNYRPVIYYFDERQKKIAEQSKANLQASGRFDRPIVTKIEPAETFYEAEAYHQGFYKTNPERYAQSSAIRHQFLEENWK

SEQ ID NO: 15692 - protein, 444 aa, Arabidopsis thaliana
MPTFSAAALGRSLNSGTSLSSKFPSTLQSKPSILNDESKQPKEKTFTRPQMSPSLYATTKEIPHPNSPSSYPPSPYIINHKARGPVLFNRDSEVDGPSHPITSGEEKISGNVDVEATASLSKSTSLSFPITEAIAVDHTNGVHTQGIHERPVWDCSPPLGTFLNEKSGRDISNGGIGSNNATSNLEWQSYLLEPVRIKADKELEPENFYNPGELVSFTSNTEVEDFERAESSHSLATHVGEFYDACDELSTDSGMQSSANNIESEVREMRLGLLMEIERRRQAEATLEQMQVHWRRLRDQLADVGMFLPLDPTRSQYSMNLADELRCQLEVTRFVSDTLGSDLAKTEVEMEMEAELEAKNFEITRLSDRLHYYETVNQEMSQRNQEAIEVARRDGQKRKRRQRWIWGSIAATITLGSGVLAWSYLPPGMLSSDEAQPQLSPKDS

SEQ ID NO: 15693 - protein, 99 aa, Unknown
  Malus x domestica
MGFRLPGIVSAKRSLIRSLSNSKQTASKTLDIPKGYFAVYAGERQKKRFVIPISYLNDPLFQDLLSQAEEEFGYDHPMGGITIPCSEYTFLHLTSRLSV

SEQ ID NO: 15694 - protein, 395 aa, Haemophilus somnus
MTEKIRECIRQFLQMEAAGGILLLVFSVGAVIFANSPLRDHYFSFLNAPVIIQFGSIVELNKPLLMWVNDGFMAIFFVLVGLEVKREMLIGAISSYQKAIFPAIAACGGMIVPALVYWLVNQGVPDYHGGWAIPMATDIAFAIGVLVLLGTRVPLALKVFLLALAIIDDLGAIIVIALFFSHDLSTKALILASIAIVGLILLNRFKVSNLIAYVVVGIILWVSVLKSGVHATLAGVIIGFCVPLKGKNNSEPLVEMEHAIAPWSSFLILPLFAFCNAGIPLSGLGMEALTSPLTLGVTLGLLLGKPIGVFLFSYLSVKLHIAKLPEGINFKQIFAVSVLCGIGFTMSMFLASLAFGGGDGHLTAYARLGILFGSSVSAVVGYWLLFVTTKENANQ

SEQ ID NO: 15695 - protein, 541 aa, Pseudomonas fluorescens
MRHFVLQVSRPVTKWRNAIVLNDLGFPSVGSPTLVARGSVTFWRNSCVRYKERPVGFFLRERMQTGWSYSFFVAKVLFMSGTQLSNDLEQGLKPRHVTMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNVAIWVFTLVITLLLTATNLFSVKNYGEFEFWFALIKVVAIIGFVILGLAAICGLLPNSQVSGVSHLVDTQGFMPNGMGAVLAAMLTTMFSFMGTEIVTIAAAESHNPGKQISKATNSVIWRIGLFYLVSIFIVVALVPWNDPSLAQVGSYQTVLDRMGIPNAKLIVDLVVLVAVTSCLNSALYTASRMLFSLGKRGDAPAAAKRTNASGTPYWAVILSTAAAFLAVFANYVAPAAVFEFLLASSGAIALLVYLVIAVSQLRMRHKRMAAGEKIAFRMWLFPGLTYAVIVFIVAVLGIMLFQEEHRVEILATGLLSVIVIAAGLMVARRRKAERNGALALN

SEQ ID NO: 15696 - protein, 352 aa, Solanum adhaerens
AWDTSVAIEVRVGDNIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15697 - protein, 183 aa, Burkholderia pseudomallei
MNREEALHIFQHSEEIVSAGEVNASIGRMAGEIRGQIGEEFPLVLSVMGGAAVFTGMLLPHLDFPLEFDYIHLTRYRNTTKGGPEMHWRVAPRESVKDRIVLVLDDILDEGETMAAIRDRILEMGAKRFMSAVLCEKTLAKAKPLHPDFCGFAVPDRYVFGCGMDAKGYWRNLPTIRALTADV

SEQ ID NO: 15698 - protein, 162 aa, Geobacter metallireducens
MDETPELEKATFGAGCFWHVEAEFRRVSGVVATHAGYMGGWKDHPTYEEVCSKETGHAEVVEVVYDPARVSYDELLRIFWTIHDPTQLNRQGPDIGTNYRSVIFFHTPEQEQAARLSMEKEGGSGRYSRPIVTEIASASAFWWAEEYHQQYLEKRGGGSCNW

SEQ ID NO: 15699 - protein, 315 aa, Unknown
  Erythrobacter sp. NAP1
MSEFGHDTTADEVLEGKDLSGKTVFITGGNSGLGQETGRAMAAKGAHVILAGRDQGKLDEAVSAIRSEVPDANLETITCDLASLDSVHAAGAEANERFDKIDLLINNAGVMACPKMHTDDGFEMQLGTNHLGHFALTKHLMPLVEAGTDKRIVNLSSRGHHIAPVDFDDPNFESTDYVPFLSYGRSKTANVLFTVGLEKRFGDKGIHSYAVHPGGIQTNLGRHMSEEESAALVERVTENDPGFSWKTIPQGAATQTWAATADELEGKGGLYCEDCNVAEVDDASPNSGVRTYALDPVAADKLWAMSEEMTGVTFA

SEQ ID NO: 15700 - protein, 350 aa, Solanum aethiopicum
DTSVAIEVEVGDSIEIVRFFHCYKRGVDRVFVDHPMFLEKVWGKTGSKIYGPKAGQDYLDNELRFSLLCQAALEAPRVLNLDCSKYFSGPYGDDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSISGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15701 - protein, 353 aa, Solanum allophyllum
DAWDTSVAVELKVGDSIEIVRFFHCYKRGVDRVFVDHPMFLEKVWGKTGSKIYGPKAGQDYLDNELRFSLLCQAALEAPRVLNLNCSKYFSGTYGEDVLFIANDWHTALIPCYLKSMYQSRGIYLNAKVAFCIHNIAYQGRFAFSDFPLLNLPDEFRGSFDFIDGYEKPVKGRKINWMKAGILESNRVVTVSPYYAQELVSAVDKGVELDNVLRKTSITGIVNGMDTQEWNPATDKYTDVKYDITTVMDAKPLLKEALQAAVGLPVDRKVPLIGFIGRLEEQKGSDILVAAIHKFIGLDVQIVVLGTGKKKFEQEIEQLEVLYPNKAKGVAKFNVPLAHMITASADFMLVPSR

SEQ ID NO: 15702 - protein, 236 aa, Unknown
  Synechococcus sp. WH 8102
MLPSWLTQRGGESSTEAMHAVLGTPLRAPLMSDQEEALFACGCFWGAEKGFWRLPGVVSTAVGYAGGQRTNPTYQEVCTGTTGHTEVVRVVWSTPAVDFSDLLKLFWECHDPTQGNRQGNDTGTQYRSAIYTTTNQQMSLAQASRTSYQDALNQRGYGPITTEILADQAFTFAEPYHQQYLAKPGSRPYCSAMPTQTVLGDFDGNNYRLPSTVWAAYDWSINHCVLRSDNAPIRMA

SEQ ID NO: 15703 - protein, 571 aa, Unknown
  Magnetococcus sp. MC-1
MHIAIVDDSPDDRLLLMRILSKAGYSTLQLHDSGEAFLQTLGLTPTDTASIAPFNPPHTSLPDIIFMDVMMPDMDGLSVLRQLKANPPTQNIPVIMVTGNDRPRDLAHAFEEGATDYITKPIRRVELLARLRSIIKLERAMQQVRSSEKRLRDLTASLGEGLLSVDNAQRIIFLNPAGEKLLEYSESALHLTTLNEQLIPHTCGSLHDQQSADHMLAALRGETEQISGETLFRTRTGKLIPISFNAAPILDGHFLSGGVLSFRDIRDQREKEERLKLAAKIFNHSQEGLVVLDAERIIVDVNPAFSYITGYTREEVIGRSPELLRSQRHDAAFYQSIWQQAENQGNWQGEIWRRRKNGEEFPEWLSLSIIRGENQQISHYIGLFSDITTRKIAEEKLKHQAHHDPLTGLPNRSLLEDRLQQAVSKARRYEGKIAVLYIDLDHFKPVNDNYGHEAGDAVLREISARIRYELRQSDTAARVGGDEFVAVLTEIREEHLVMGVAQKLIHAIQKPVNFGNESFQVGCSIGISLYPIHGNSITKLLKSADTAMYRAKQEGRNRFCVATLDKETQNP

SEQ ID NO: 15704 - protein, 572 aa, Unknown
  Frankia sp. EAN1pec
MNESEPFAEQPLRETAAEGGDTGTSQDPLWFKRAVFYEVLVRGFADSNGDGTGDLAGLVSKLDYLEWLGVDCLWLLPIYSSPLRDGGYDISDYFQILPEFGDLGDFINLVDEAHRRGLRIIADLVMNHTSDEHPWFQASRSDPDGPYGDFYVWSDTDEKYPDARIIFVDTEKSNWTWDPVRGQYYWHRFFSHQPDLNYDNPDVQEAMLEVLRFWLDLGLDGFRLDAVPYLYVREGTNGENLPETHEYLRRVRKEIDAKYADRVMLAEANQWPSDVVQYFGNDDECHMAFHFPLMPRIFMAVRRESRYPISEILAQTPEIPPNCQWGIFLRNHDELTLEMVTDEERDYMYAEYAKDPRMKANIGIRRRLAPLLDNSRDQMELFTALLLSLPGSPVLYYGDEIGMGDNIYLGDRDGVRTPMQWSPDRNAGFSTTDPARLYLPVIMDPVYGYQALNVEAEQRMPTSFLSWTRRMIEVRKRHPVFGLGTYEELGASNPSVFAYVREFGDDRVLCVANLSRFAQPVELDLRRFAGLVPVELLGRVHFPPVGELPYLLTLPGHGHYWFALSNPGEFTQ

SEQ ID NO: 15705 - protein, 112 aa, Unknown
  Oceanospirillum sp. MED92
MKLVTAVIKPFKLDDVREALSEIGIQGVTVTEVKGFGRQKGHTELYRGAEYVVDFLPKVKIEIAVDDDMIDQVIEAISKTANTGKIGDGKIFVTPLEQVIRIRTGESGPDAL

SEQ ID NO: 15706 - protein, 514 aa, Cucumis sativus
MGHPLDHSDAHHRPPSNGVIKVLPPDSDPSLPPPLPKQLPTSSAPPALGRVLARPFSDVRSFYSFRGELGRGQFGVTYLVTHKETKQDFACKSIATRKLIDQDDVEDVRREVQIMHHLTGHPHIVELKEVYEDRHYVNLIMELCAGGELFDRIIAKGHYSECTAASLCRQIVTVVHNCHSMGVMHRDLKPENFLFLSADENSPLKATDFGLSVFFKPGDVFKDLVGSAYYVAPEVLRRRYGPEAAVWSAGVILYILLSGVPPFWAENDQGIFDAVLRGHIDFSSDPWPSISSGAKDLIRKLLHSDPKERLSAIEALNHPWMKEDGEASDKPLDIAVLTRMKQFRAMNKLKKVALKVIAENLSEEEIVGLKEMFKSMDTDNSGTITFEELKAGLPKLGTKLSESEVRQLMEAADVDGNGSIDYIEFITAAMHMNRVEREDHLFKAFEYFDKDKSGYITMEELETALKKYNMGDETTIKEIIAEVDTDNDGRINYDEVVAMMRKGNQELTTTSRQK

SEQ ID NO: 15707 - protein, 352 aa, Saccharum sp.
TTYDLKADDKTKSWKKLVNVAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASRNVKVLVVGNPCNTNALICLKNAPNVPAKNFHALTRLDENRAKCQLALKADVFYDKVSNVTIWGNHSTTQVPDFLNAKIDGRPVKEVIKDTKWLEEEFTMTVQKRGGVLIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAFCDLPE

SEQ ID NO: 15708 - protein, 508 aa, Sulfolobus solfataricus
MWRQAKWNEPLIFELNKSGAARQGFLINKDEEIRSQIKEMKIPKNLLRENEPDLPSLSELEVVRHFVRLSQMNFGVDIGIMPLGSCTMKYNPKIEEKATAITEFHHPLEDEDYIQGILEMIYELQNWFSEITGMDECSLQVPAGSAGEFAGVLMIKKYHEEHNRNYKDTILVADTAHGTNPASAAMAGYKVMYVKSNAEGLVDMDILREIVNDKTAGFMLTNPNTLGLFEENILEISKIIHSTNAVLYYDGANLNGVLGIARPGDMGFDIVHLNLHKTFAVPHGGGGPGAGAICAKGELVNYLPYPMVEKVNGKYKLSKIPKNSIGKIATFYGNVGNLARSFAYILGLGPQGIQMIGKMSTLATNYLIAKLRDVKELELIAPNRHRKHEVVFSVKQLMENYGVSANDVAKALLDNGFYAPTIYFPPIVEEALMIEPTETETKETLDMFAETLKKIVNDAKINPEQVMKSPNNTSIARLDQAYANHPSTITPTYRVLRLRRLGKIDYLK

SEQ ID NO: 15709 - protein, 962 aa, Shewanella oneidensis
MTKQTLTQLEQHDLFLRRHIGPDSSQQQEMLNYVGAESLDDLTAQIVPESIRLSQELSIGDSCGEAEGIAYIRGLAKQNQVFKSYIGMGYYGTQVPNVILRNVLENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPASEAVNHELFGALFQYSNRFGQITDFTDLFAELRAKNVIVTVAADIMSLVLLKSPGSMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFADILAAGLQAKGVSLVNNTWFDTISIKGLDVAAVNARALAAEMNLRFDADGIVGVSLDETTIRTDIDALFEVILGAGHGLDVAALDAQIVAQGSQSIPASLVREDAILSHPTFNRYQSETEMMRYIKRLESKDLALNYSMISLGSCTMKLNAAVEMIPVSWPEFANMHPFCPLDQAKGYTQLIEELSSWLVNVTGYDAVCIQPNSGAQGEYAGLLAIRKYHESRGEAHRNICLIPQSAHGTNPASAQLAGMQVVVTACDKQGNVDLEDLKAKAAEVAENLSCIMITYPSTHGVYEETVREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSKGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDSAFDSRPYSREVAVFPSAAVRTNKFWPTVNRIDDVYGDRNLFCACVPLSDYE

SEQ ID NO: 15710 - protein, 455 aa, Sulfolobus solfataricus
MYKHPWLPNLDLTDEMLKEIGVNSLDDLFNDIPAEIKINRLLKVAKDKPLSEYEIEKEIYEKVKKNVELEAPPFIGAGICPHYIPNAVKFIIGRSEFYTSYTPYQPEISQGILQALFEYQSLMAELLEMDVVNASMYDWGSALAEAVLMANRINGKKTVLVPENANPFHKEVMRTWIQGKGIKIEEVKYDKNSGEVDIEDLEKKSSSNDVSAIYVQQPNFFGIFESNIEHIIDVAKHKKALSIIGVNPLSLGLIKPPGSYEADIVVGDGQELGLPLNFGGPLMGIFAVRWDMGLVRQMPGRIVGITRDVNNNMGFTLILQTREQFIKREKATSNITTNEALLALANAVYLSLLGKEGIRELAEEIYFRSHYAAKRLTEIDNVIMPFTSDFFEEFVIKFPIEYNIINDKLKERKLQGGLKLSIHTSLFCVTEVHDKKSIDLLVSTIQEAIKSVETS

SEQ ID NO: 15711 - protein, 639 aa, Arabidopsis thaliana
MLRTNSCVLVDEPLNDSMGMADPDDGQSDEKVVPFDGPLSLASASVDVTSDLSRNDDVNLSEESEDKEQEAEISSTVSGNDIESKDTYLLKQSEINKKDTGIDAGSKYDDFPKKSEINNTGTWNDTEGKDDNNFLKQSQLNKTGTGNDTESSDNEFLEQNQMNKTVLGNGTEINVSKVDQPSRAVPLGLDEFKSRASNSRNKSLSDQVSGVIHRMEPGGKEYNYASASKGAKVLSSNKEAKGAASILSRDNDKYLRNPCSTEGKFVVVELSEETLVNTIKIANFEHYSSNLKEFELQGTLVYPTDTWVHMGNFTASNVKHEQNFTLLEPKWVRYLKLNFISHYGSEFYCTLSLIEVYGVDAVERMLEDLISVQDNKNAYKPREGDSEHKEKPMQQIESLEGDDGADKSTHREKEKEAPPENMLAKTEASMAKSSNKLSEPVEEMRHHQPGSRMPGDTVLKILMQKLRSLDLNLSILERYLEELNLRYGNIFKEMDREAGVREKAIVALRLDLEGMKERQEGMVSEAEEMKEWRKRVEAEMEKAEKEKENIRQSLEQIVFDTMKSSYIVYRKIEKNGHNSFADVSKSENFFCLEKLIIQCGAGNNLRLDCVSHPSPPPPHRSMAPPIFVPPSTSHKGQGP

SEQ ID NO: 15712 - protein, 420 aa, Streptococcus pyogenes
MTMIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDADTEMLNYEAILEQAKAVQPKLIVAGASAYSRSIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQILLDEVNITLNKNAIPFETLSPFKTSGIRIGCAAITSRGMGVKESQTIAHLIIKALVNHNQTVILEEVRQEVRQLTDAFPLYKK

SEQ ID NO: 15713 - protein, 482 aa, Unknown
  Vibrio sp. Ex25
MKGDIGVIGLAVMGQNLILNMNDHGFKVVAHNRTAAKVDEFLEGPAKGTNIIGAYSLEELVEKLETPRKVMLMVRAGDVVDKFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPELAFLGSDDYFKGILQNSLVAWRKVAAKSLEAGIPMPCTTSALTFLDGYTTARLPANLLQAQRDYFGAHTYERIDRERGEFFHTNWTGTGGDTASTTYDV

SEQ ID NO: 15714 - protein, 358 aa, Cryptococcus neoformans
MSQLIATKRVDLLAPYLALDQGSRVQAEYIWIDAEGGIRSKTMTLDKAPSSVADLKEWNFDGSSTNQAPADNSDVFLRPVAIFKDPFRGGANILVLCECYDNDGTPNKSNYRAHCKKVMDAAKDTEPWFGLEQEYTLFDADGQVFGWPKNGFPGPQGPYYCGVGAGKVFARDFIEAHYRACLYAGIKISGINAEVMPSQWEFQVGPCTGIEMGDHLWMPRFLLLRIGEEWGITPSLHPKPLKGDWNGAGCHSNYSTKDMRTPGKGMAAIEDAIKKLEKKHLEHIAVYGEDNDLRLTGKHETASMTTFSAGVANRGASIRIPRHVGAQGYGYLEDRRPASNVDPYRVTAILVETTVLNN

SEQ ID NO: 15715 - protein, 150 aa, Zea mays
  misc_feature (102)..(102): Xaa can be any naturally occurring amino acid
MAPKAEKKPAAKKPAEEEPAAEKATAGKKPKAEKRLPAGKSAGKEGGEKKGKKKAKKSVETYKIYIFKVLKQVHPDIGISSKAMSIMNSFINDIFEKLAAEXAAKLARYNKKPTITSREIQTSVRLVLPGELAKHAVSEGTKAVTKFTSS

SEQ ID NO: 15716 - protein, 688 aa, Streptococcus thermophilus
MHLSLALLVLLFSLILSNVINRIFPRLPLPLIQIIFGVGIGFLLKGEVFELETELFLAFIIAPLLFREGEESDITSILRNWKLILFLIFPVIFVSTLGIGYLAKAVLPASVPLSACLALGAALGPTDFVAYSAISKRFSFPKWISYILQGEGLLNDASGLVAFRVAVTALTTGSFSLLDASWNLVISVIGGFLVGLITALLNRLFLTILDNMDAADVTGALLLELVLPIPSYFVAEEIHVSGIIAVVVAGISLASRFKKITVFDAKLDSVSHTIWGTITFVLNGMVFFLLGTELPTLATPVLSSSTYDTLWMLLAIVLLTAIMFGIRFVMISAVFAQRAWRTKRSLKKIWKVATILTFSGVKGTVSIATILLLPVANMTALEHSLLTFTVAGVTLLSFLIGILILPRLATGPAHTTNHYMQIAILNDVVRELEKDLKQSANQGAVYATIDNYNQRLEDLILEQESNDVKEELANIRIMIMEIESEGLEYAYKKGKISELEYNLYQRYIKGLERRINRGFVSSLSYASAVFVLGLRRILHLAFTFKFRFEQEENRRGPQLTEENRDHMTELYLTNTEQVLEALSNLEGVYHSDLLSYLKRSRIREAEIIQSGAFVERVITHLNPDYVDEMLRGYFLERKIIIEYEQAGRISSRYAKQLRKEVNTLENYSLKETSNTLIYDMINLARRGA

SEQ ID NO: 15717 - protein, 372 aa, Burkholderia pseudomallei
MRSIIADSKRLVVKVGSSLVTNDGRGLDHDAIGRWAAQIAALRGAGKEVVLVSSGAIAEGMQRLGWSKRPREIDELQAAAAVGQMGLAQVYESRFAEHGIRTAQILLTHADLADRERYLNARSTLLTLLRLGVVPIINENDTVVTDEIKFGDNDTLGALVANLIEGDTLVILTDQPGLFTADPRKDPGATLVAEASAGAPELEAMAGGAGSSIGRGGMLTKILAAKRAAHSGANTVIASGRERDVLVRLAAGEAIGTQLIARTARMAARKQWMADHLQVRGHVVIDAGAVDKLTAGGKSLLPIGVVAVQGVFARGEVIACVDDTGREVARGITNYSSAETKLIQRKPSGEIETVLGYMLEPELIHRDNLVLV

SEQ ID NO: 15718 - protein, 353 aa, Solanum arboreum
  misc_feature (27)..(27): Xaa can be any naturally occurring amino acid
  misc_feature (217)..(217): Xaa can be any naturally occurring amino acid
DAWDTSVAIEVKVGDSIEIVRFFHCYXRGVDRVFVDHPMFLEKVWGKTGSKIYGPKAGQDYLDNELRFSLLCQAALEAPRVLNLNSSKYFSGPYGENVLFIANDWHTALIPCYLKSMYQSRGMYLNAKVAFCIHNIAYQGRFAFSDFPLLNLPDEFRGSFDFIDGYEKPVKGRKINWMKAGILESDRVVTVSPYYAQELVSAADKGVELDNVLRKTXITGIVNGMDTQEWNPATDKYTDVKYDITTVMDAKPLLKETLQATVGLPVDRKIPLIGFIGRLEEQKGSDILVAAIHKFIGLDVQIVVLGTGKKKFEQEIEQLEVLYPNKAKGVAKFNVPLAHMITAGADFMLIPSR

SEQ ID NO: 15719 - protein, 351 aa, Solanum argentinum
  misc_feature (245)..(245): Xaa can be any naturally occurring amino acid
WDTSVAIEVKVGDSIEIVRFFHCYKRGVDRVFVDHPMFLEKVWGKTGSKIYGPKTGQDYLDNELRFSLLCQAALEAPRVLNLNCSKYFSGPYGENVLFIANDWHTALIPCYLKSMYQSRGMYLNAKVAFCIHNIAYQGRFSFSDFPLLNLPDEFRGSFDFIDGYEKPVKGRKINWMKAGILESDRVVTVSPYYAQELVSAADKGVELDNVLRKTSITGIVNGMDTQEWNPATDKYTDVKYDITTXMDAKPLLKETLQAAVGLPVDRKIPLIGFIGRLEEQKGSDILVAAIHKFIGLDVQIVVLGTGKKKFEQEIEQLEVLYPNKAKGVAKFNVPLAHMITAGADFMLIPSR

SEQ ID NO: 15720 - protein, 547 aa, Haemophilus somnus
MSESFAQLFEESLKDLETRVGSIVNATVVAIEKGFVYVDAGLKSEARIPAEEFQNAQGELDVKVGDVVNVALDAVEDGFGETKLSREKAVRQESWIDLEKAYEEQATVIGLINGKVKGGFTVELNGVRAFLPGSLVDTRPTREADHLLGKEQEFKVIKLDQKRNNVVVSRRAVIESENSQEREEILANLAEGSEVKGTVKNLTDYGAFVDLGGVDGLLHITDMAWKRVKHPGEIVSVGDEITVKVLKFDKDKTRVSLGLKQLGQDPWVAIAENHPVNSKLTGKVTNLTDYGCFVEILEGVEGLVHVSEMDWTNKNIHPSKVVHLGDVVEVMVLEIDEERRRISLGLKQCKPNPWLQFAETHNKGDKVSGKIKSITDFGIFIGLEGGIDGLVHLSDISWNIPGEEAVRNYKKGDEVEAVVLQVDSAKERISLGIKQLEEDPFNNFIAVNKKGAVVSAKVVEVDAKGAKVELGIGVEGYIRTADLSNEVVVGDVVEAKYTGVDRKSRIVHLSVKAKDQAEEAAAVANVNKEEIVIPNAMAEAFKAAKGE

SEQ ID NO: 15721 - protein, 1464 aa, Unknown
  Magnetococcus sp. MC-1
MSRSSIRVWPGNPFPLGATWDGRGVNFAIFSEHAERVELCLFGPDGFRETARISLSEYTNQVWHGYLPDVRPGQLYGYRVYGPYQPEHGHRFNHNKLLLDPYAKLLNGQLQWHEALFGYRYDDPLGDLSFSDLDSAPYVPKCVVVDTAFTWGGEQPPNVNWLDSIIYEMHVRGFTMQHPKVPQNQRGTFAGLCAPEVISYLQDLGISSVELLPVHASVDEWHLAQKGLSNYWGYNTLAFFVANPRFASGPDAIREFKTMVQVFHEAGIEVLLDVVYNHTAEGNHEGPTLSFKGIDNKAYYKLEPGYNRYYRDFTGCGNSFNLRHPKVLQLVMDSLRYWAGEMHVDGFRFDLTTTLAREADGHFDRHSGFLDAIAQDPLLSRKKMIAEAWDIGDGGYQVGNFPPGWGEWNDRYRDAIRRYWKGDKGMAGELASRLTGSSDIFNHNGRRPWSSINFVTAHDGFTLRDLVSYNHKHNSDNLEDNRDGRDANDSWNCGVEGASEEPAIRILRLRQMRNFLTSLLLSQGLPMLVAGDERGRSQNGNNNPYCQDNDISWVNWDEHDEEAKELLSFTRFLIKLRREHGVFHRHSFFNGQKITGLEVKDVVWLRPDGREMERCDWDNVHTLCLGMLLSGEAGEKFLSRYGDAQVDDTFLLLLNSHHEPLPFHLPEVEDGSGWTRLLDTMERGGGCDEPQPGIVNSYQMGGRSAVLFVLQRRERAVEVKPKPATSGDEHELLRQLAEAAGIDRGYWTVFGEWFDLPDASLRSFLGAMDLAADNQGQIRASLTRLEEEPWRRAMPPVVMCRYPCTGVDIAIVVGAEMVDEALEWVLVDEAGHIIPGKVVPSDMPLDGERLVDGQHLERRIFHLYQKLEVGYYRFELHGAGLPDGDFASMRLVVAPSRCYLPKALEKNDGRIWGFSPQLYALRSQRNWGIGDFEDLKQLVEITASHGGGIIGLNPLHTLFLTRPEQVSPYSPNSRHYVNPLYIAPEQVPEMESCEEAQIRLNSPGVRRLLNKLRESEMVDYVEVSALKLSIMRLLYGVFRDKHMTPDKSCVTSPRGLQFRAFVKAGGDALMRLAVFNALSVQFAQTGEDVGGWRSWPTPYRRPDSPEVRRFMQEQEEEVFFYLYLYWIADTQLQEAKASAQQQGMPVGLYADMALGVDPDGADFWNEQSAYAGDMRIGAPADLFNPKGQNWGLPPFDPRALRAQGYQPFIDALRNTMRHAGAIRLDHVMSLARLFWVPVGAPATEGGYVRYPVEDLLGLVALESQRNQCTVIGEALGTVPEGFREKLAENGILSYRLLYFERAEEGRFLQPHEFNTRSLVAATTHDLPTFSGFWEGVDLAVKEQLDLYPNEEMAVRFRGERVHDKMKLREALQQVGIPLTEQFEQADATPELIEAVYRMLARTPAHLLMVQLEDVLQQKEQVNLPGTVNEHPNWRRKLPADLEALVQDPRFKGLTKMLNSERPPL

SEQ ID NO: 15722 - protein, 360 aa, Arabidopsis thaliana
  misc_feature (43)..(43): Xaa can be any naturally occurring amino acid
  misc_feature (55)..(55): Xaa can be any naturally occurring amino acid
  misc_feature (66)..(66): Xaa can be any naturally occurring amino acid
  misc_feature (103)..(103): Xaa can be any naturally occurring amino acid
MSLLADLVNLDISDNSEKIIAEYIWVGGSGMDMRSKARTLPGXPVTDPSKLPKWXNYDGSSTGSSXLGQDSEVILYPQAIFKDPFRRGNNILVMCDAYTPSGXEPIPTNKRHAAAEIFANPDVIAEVPWYGIEQEYTLLQKDVNWPLGWPIGGFPGPQGPYYCSIGADKSFGRDIVDAHYKASLYAGINISGINGEVMPGQWEFQVGPSVGISAADEIWIARYILERITEIAGVVVSFDPKPIPGDWNGAGAHTNYSTKSMREEGGYEIIKKAIEKLGLRHKEHISAYGEGNERRLTGHHETADINTFLWGVANRGASIRVGRDTEKEGKGYFEDRRPASNMDPYVVTSMIAETTLLWNP

SEQ ID NO: 15723 - protein, 531 aa, Streptococcus mutans
WHKATVYQIYPKSFMDTNGDGIGDLKGITSKLDYLQKLGVMAIWLSPVYDSPMDDNGYDIANYEAIADIFGNMADMDNLLTQAKMRGIKIIMDLVVNHTSDEHAWFIEAREHPDSSERDYYIWCDQPNDLESIFGGSAWQYDDKSDQYYLHFFSKKQPDLNWENANLRQKIYDMMNFWIDKGIGGFRMDVIDMIGKIPAQHIVSNGPKLHAYLKEMNAASFGQHDLLTVGETWGATPEIAKQYSNPVNHELSMVFQFEHIGLQHKPEAPKWDYVKELNVPALKTIFNKWQTELELGQGWNSLFWNNHDLPRVLSIWGNTGKYREKSAKALAILLHLMRGTPYIYQGEEIGMTNYPFKDLNELDDIESLNYAKEAFTNGKSMETIMDSIRMIGRDNARTPMQWDASQNAGFSTADKTWLPVNPNYKDINVQAALKNSNSIFYTYQQLIQLRKENDWLVDADFELLPTADKVFAYLRKVREERYLIVVNVSDQEEVLEIDVDKQETLISNTNESAALANHKLQPWDAFCIKIN

SEQ ID NO: 15724 - protein, 112 aa, Unknown
  Oceanospirillum sp. MED92
MKMVSAVIKPFKLDDVREALSEIGVQGITVTEVKGFGRQKGHTELYRGAEYVVDFLPKVRVDAAVASDIVDQVVEAISSAAQTGKIGDGKIFVSEIEQVVRIRTGETGTEAL

SEQ ID NO: 15725 - protein, 373 aa, Unknown
  Fragaria x ananassa
MAVGCMKTLSHHKEDDQKPLVFDASLLRYETDIPKQFIWPDDEKPCPNTRELQVPLIDLGDFLSGNPEAAMKASRLVGEACEKHGFFLVVNHRVKESLIADAHQYMDEFFGLPLSEKQRTQRKAGEHCGYASSFTGRFSSKLPWKETLSFSYTADQSSSNVVKDYLCNAMGEEFDEFGRVYQDYSEAMSTLSIGIMELLGMSLGVGRTHFKEFFGDNDSIMRLNYYPPCQKPDQTLGTGPHCDPTSLTILHQDQVGGPEVFVDEEWRSISPNLNAFVVNIGDAFMALSNGRYKSCLHRAVVNSKTPRKSLAFFLCPKDDKVVKPPRELIDSSYPRIYPDFTWPMLLEFTQKHYRADMKTLQAFTNWLQEQRSS

SEQ ID NO: 15726 - protein, 419 aa, Colwellia psychrerythraea
MTIEKIDTLVIGAGQAGVAMSEHLSKQDVPHLVLERNRIAEQWRTGRWDSLVANGPAWHDRFPGLEFEEHDPDSFVPKEKIADYLVDYAKKFDAPIRTGIEVKNVERNTNGQGFIIETSQGTIEAKRVVSATGPFQVPVIPPIAKNEKITQIHSADYRNPEQLEDGAVLVVGAGSSGVQIADELQRSGRKVFLSTGPHDRPPRSYRNRDFCWWLGVLGEWDRESLEPGTEHVTIAVTGAHGGNGTVDFRALAHQGITLLGMTKEFNNGKVTFQKDLNTNVERGNKNYMDFLDSADAYIERNGLDLPEEPTARDVLSDPECMTNPILELDLAKEGITSIVWATGFALDYSWLNVDAFDENGKPAHQRGVSTEPGVYFVGQAWLSRRGSAFIWGVWHDAKHIAGHISTQRTYSAYQDASQR

SEQ ID NO: 15727 - protein, 455 aa, Campylobacter lari
MSMAKQYINETLEKIQTISPRQPIFFQAATEVLNSLEPLLESNKTYQDHAILERIVMPEKTTIFRVVYINDAGKAQTHFGYRVQFNSSLGPYKGGLRFHPSVNLDVLKFLGFEQIFKNSLTGLMIGGAKGGANFDPKGKSEAEIMRFCQAFMAELSKIIGANTDVPAGDIGVGAREIGYMFGAYKKISSNFDGTLTGKKIPWGGSLARTEATGYGCVYFTQEMLAKYNNALEGKECAVSGSGNVAIYTIEKLHQLGAKAITISDSDGFVYDKDGIDLDLLKEIKEVKRARVSDYAALKKGAIFTPKSAYKQGCNGVWSIPCDLAFPSATQNELNLEDIKTLYHNGCRMVAEGANMPSTLEAIDFMLNQKDFLFAPAKAANAGGVATSQLEMQQNASMCQWSFEEVDAKLHKIMKNIFENSYECAKAYNHEGNLVVGSNIAGFKKVADAMIDHGYI

SEQ ID NO: 15728 - protein, 614 aa, Oryza sativa
MVPLYVAMILAYGSVKWWRIFTPDQCSGINRFVALFAVPLLSFHFISTNNPYTMNLRFIAADTLQKLMVLAMLTAWSHLSRRGSLEWTITLFSLSTLPNTLVMGIPLLKGMYGEFSGSLMVQIVVLQCIIWYTLMLFMFEYRGARMLITEQFPDTAANIASIVVDPDVVSLDGRRDAIETETEVKEDGRIHVTVRRSNASRSDIYSRRSMGFSSTTPRPSNLTNAEIYSLQSSRNPTPRGSSFNHTDFYSMVGRSSNFGAADAFGVRTGATPRPSNYEDDASKPKYPLPASNAAPMAGHYPAPNPAVSSAPKGAKKAATNGQAKGEDLHMFVWSSSASPVSDVFGGGAPDYNDAAAVKSPRKSSNLLSSPCTICLIWGAFLGLICTDSYISFTSVDGAKDREDYVERDDFSFGNRGVMDRDAEAGDEKAAAAAGADPSKAMAAPTAMPPTSVMTRLILIMVWRKLIRNPNTYSSLIGLIWSLVCFRWNFEMPAIVLKSISILSDAGLGMAMFSLGLFMALQPHIIACGNKVATYAMAVRFLAGPAVMAAASFAVGLRGTLLHVAIVQAALPQGIVPFVFAKEYSVHPSILSTAVIFGMLIALPITLVYYILLGL

SEQ ID NO: 15729 - protein, 122 aa, Glycine max
NGKTSLQQFKNVVAIVDPPRAGLHPTVIKALRTHPGLRRLVYISCNPETLVANAIELCTPSPLKIEKGNKDNRGWRNMSSAGLARHRAKSMPISEAFHPVKAMAVDLFPHTPHCELVMLLER

SEQ ID NO: 15730 - protein, 75 aa, Unknown
  delta proteobacterium MLMS-1
MAKEEPITVEGTIIEPLPNAMFRVELENGHRVLAHISGKMRMHFIKILPGDRVTVELSPYDLTRGRVTFRSKNKR

SEQ ID NO: 15731 - protein, 236 aa, Nicotiana tomentosiformis
MTRRYWNINLEEMMEAGVHFGHGTRKWNPKMAPYISAKRKGIHITNLTRTARFLSEACDLVFDAASRGKQFLIVGTKNKAADSVEWAAIRARCHYVNKKWLGGMLTNWSTTETRLHKFRDLRMEQKTGRLNRLPKRDAAMLKRQLSRLQTYLGGIKYMTGVPDIVIIVDQHEEYTALRECITLGIPTIYLTDTNCDPDLADISIPANDDAISSIRLILNKLVFAICEGRSSYIRNP

SEQ ID NO: 15732 - protein, 315 aa, Prochlorococcus marinus
MTWSINSIPSQEGRTVFVTGANSGLGFDTAQALLEKGATVILGCRTLEKAERSRQKLLDETDCGKIDVLEIDLADLEKVNEALDKIAVKYKKLDLLINNAGVMAPPQTFSKQGFELQFAVNHLSHMALTLKLLPLIAKQPGSRVVTVSSGAQYMGKINLDDLQGGEGYDRWSSYSQSKLANVMFALELSKRLQQSNLDIASLSAHPGLARTNLQSTSVKLNGSWQEAIAYKLMDPMFQSSRMGALPQLLAATDPTAKTGEQYGPRFNFRGYPKICRIAPSALNSDEREQLWQLSEKLIGDAVDISKGKELLSTKK

SEQ ID NO: 15733 - protein, 210 aa, Propionibacterium acnes
MNKTEMVSSENALPGGHTPVLAMPFFHRVTGDRLDRPFPSSETIYLAMGCFWGAEKLFWNTDGVLQTAVGYMGGLTPNPTYREVYTGCTGHAETVRVTYDPTQVSTEAILTIFLENHDPTQGMRQGNDVGTQYRSAIWCTTTEQFMTATTVKGSYQANLLNAGYGAITTAISMANGVEFYLAEAEHQQYLEDNPFGYCPVHATGVCLAGS

SEQ ID NO: 15734 - protein, 195 aa, Arabidopsis thaliana
MRRPKSSHVRMEPVAPRSHNTMPMLDQFRSNHPETSKIEGVSSLDTALKVFWNNQREQLGNFAGQTHLPLSRVRKILKSDPEVKKISCDVPALFSKACEYFILEVTLRAWMHTQSCTRETIRRCDIFQAVKNSGTYDFLIDRVPFGPHCVTHQGVQPPAEMILPDMNVPIDMDQIEEENMMEERSVGFDLNCDLQ

SEQ ID NO: 15735 - protein, 154 aa, Glycine max
  misc_feature (33)..(33): Xaa can be any naturally occurring amino acid
  misc_feature (126)..(126): Xaa can be any naturally occurring amino acid
  misc_feature (137)..(137): Xaa can be any naturally occurring amino acid
MASSMISSPTVTTANRPGAGLVVQLIGLNSLVXFPTLKTHHDITFIASNGGRVQCMPVWPPVGKKKFETLSYLPDLDDAQLAKEVEYLLMKGWIPCLEFELEHSFLYREHIRSPGYYYGRYWTMWXAAMFGCTDASXELKELQEAYDCISNGYI

SEQ ID NO: 15736 - protein, 416 aa, Wolinella succinogenes
MNYALETNDKEIFDLIHEELDRQNTHLEMIASENFTFPAVMEAMGSVLTNKYAEGYPYKRYYGGCEFVDRVEEIAIERAKKLFGCGFANVQPHAGSQANVAVYNALLKPYDKILGMDLSHGGHLTHGAKVSVTGQTYQSFFYGVELDGYINYDKVEEIAKIVKPQMIVCGFSAYARELDFKRFREIADSVGALLLGDVAHVAGLIVAGEYPNPFPHCHIVTTTTHKTLRGPRGGMILTNDEEIAKKIDKAVFPGMQGGPLMHVIAAKAVGFGENLKPEWKEYAKQVKANAKVLAKVLMARGYTLVSGGTDNHLILVSLLDKEFSGKDADRALGEAGITVNKNTVPGETRSPFVTSGVRIGSAALTARGMREKEFEFIATKIADVLDDVNNAAKHAEIKKEIAEFAKGFPVYTKAIF

SEQ ID NO: 15737 - protein, 488 aa, Cryptococcus neoformans
MTLPEVCKQFEPYFILDDAKLVDIVKHFRKEMEEGLASYGKDMAMIPTFVTGVPDGTEEGVFLALDLGGTNLRVCLILLQGHNQFKIKQQKYKVSEELKTGQARVLFDYIAESVDNFLTEVESHEDIAIPATGEPMHLGFTFSFPVEQTAIDAGKLLTWTKGFNTKNAIGHDVVRLLQDAFDRKHMHVRCSALVNDTVGTLLSRSYQSGPALIGAIFGTGTNGAYIDKTRTISKLGKEKIEDAEEGGEHAGEFMVVNMEWGAFDNKRQCLPISIFDNKLDRESINPRKQAFEKLVSGMYLGEITRNMLLYMIDSSLLFGGHSSEIINTHYGFDTSFVSGIEGISSPEEVKKLIVKELKVDPKHVTDKCPEIVQWAVRLVSDRACKLAACAIAAVVLHTGNDKAPEGEEDKGVDVGVDGSVAEFLPMFSERVMAALKAILGEKSAARVKLGLAKDGSGVGAALTALQAKKALDRRSDRSIKFVPGERGP

SEQ ID NO: 15738 - protein, 545 aa, Lotus japonicus
MGVGGCGSGCCFITSGTSHSFSHSTFPSFSSIQLHHQSLSLSLSFPKHHLKLIMSQHLSVSSSPIVEEVNDSSSFDYHQIDPELLENVVYDALVYATLNGLLVGDKSVQRSGKVPGVGLVHLPFSLLPPPLPESYWKQACELAPLFNELVDRVSLDGKFLQESLSRTKKADEFTSRLLDIHSKMLEINKKEEIRMGLHRSDYMLDEKTKRLLQIEMNTISTSFSGVGCVTTELHRNILSHYGKLLGLDSIRVPANSATNKFAETLAKAWLEYNNPRAVIMIMVQPEEHNMYDQHMISAVLREKYHIPTIRKTLAEVDQEGAVLPDGTLSVDGQAIAIVYFRAGYTPKDYPSESEWRARLLMEQSSAIKCPPISYHLVGTKKIQQELAKPNVLERFFENKDDVAKLRECFAGLWSLDDSDIVKQAIEKPELFVMKPQREGGGNNIYGDDLRETLIKLQKSGSEEDAAYILMQRIFPTSTAAILMRNGCWHKDHVLTEFGIFGTYLRNKDKVIINSESGYMVRTKMSSSDEGGVLPGFGVIDSVYLT

SEQ ID NO: 15739 - protein, 252 aa, Unknown
  Burkholderia sp. 383
MFELSGKVAVITGGASGIGLGIARGMVDAGANVVLVGRDRDKGDAAIASLPGGSERGLFVPADITRRDACMTAIEQAERRFGRLDILVNNAGMNIRQQGHELTADDWYRIIDTNLSGAHFCAQAIHPAFRRAGGGKIINIGSMLSLFGTTYGAAYAASKGGIVQLGKAWAVEWAPDNIQVNTLLPGWIETELIAEAKRLFPDLERSVLERTPLRRWGKPQDLAGIAVALCAPECDFVTGAVIPVDGGYSVQG

SEQ ID NO: 15740 - protein, 281 aa, Triticum aestivum
MFPAPMARGISVVAAEVLHQTWSVPRHGFQYFIPAAKAGINRQIELAILRADRMGVKVLSLAALNKNEALNGGGTLFVDKHPDLRVRVVHGNTLTAAVILNEIPSNTKEVFLTGATSKLGRAIALYLCRKRIRVMMLTMSSERFLKIQREAPAEFQQYLVQVTKYQAAQNCKTWIVGKWLSPREQRWAPPGTHFHQFVVPPIIGFRRDCTYGKLAAMRLPKDVQGLGSCEYTMERGVVHACHAGGVVHFLEGWEHHEVGALDVDRIDVVWKAALKHGLTPV

SEQ ID NO: 15741 - protein, 552 aa, Unknown
  Burkholderia sp. 383
MNQPLDVLDAVVVGAGFGGLYAIKRLTDAGFRIQAFESGDGVGGTWYWNRYPGARVDLECWDYSYSFSPELQDEWDWPERYPTSSELMRYLNHVADRFDLRRHVRFNTRVESAVFDEQRNIWRVTTSDGKVTHARFFVPATGVLSVPKPPEIPGIDTFVGESHHTGRWPHHEVDFSNKRVGVIGTGSSGIQVIQALAGKCKHLTVFQRTAVYVVPAKNHPLTPEMRARVRATYPERRAVSRLTRFGIAVPFPVESALDATPEERQKKYENAWENSQLLGFRMCYGDILSNEAANDTVAEFIRGKIRETVKDPAVAEKLMPRGFPFGTKRPCLGDTYYSVYNRDDVTLVDLKQTPIDRVVPEGIVTSEGLHELDVLIYATGYDALTGALTHIDVRGVNGRPLTEKWASGAKTYLGLMTSGFPNLFTVTGPGSPGPLANMSMSIEQHIDWIARCMTDLRDAGVDRIDAGQQAEEDWMQHVQDVVAKTLYLKANSWYVGANVPGKPQVFLPYLGGHGNYRKKCDDVAAAGYAGFVLTGAGDRETESQNETIGDAA

SEQ ID NO: 15742 - protein, 587 aa, Glycine max
MQRMAYTFSFPEEVLEHVFSFIWNERDRNAISLVCKSWYEIERWCRRKVFVGNCYAVSPLMVVKRFPEVRSIALKGKPHFADFNLVPDGWGGYVCPWIAAMARAFPCLEEIRLKRMVITDESLELIAKSFKNFKVLVLTSCEGFTTDGLAAIAANCRNLRELDLQESEVEEDLSGHWLSHFPDSYTSLVSLNISCLNNEVSLSALERLLGRCPNLRTLRLNRAVPLDRLPNLLLQCPQLVELGTGVYSTEMRPEVFSNLEAAFSGCKQLKSLSGFWDVLPSYLPAVYPICSRLTSLNLSYAIIQSSDLIKLISQCPNLLRLWVLDYIEDAGLYALAASCKDLRELRVFPSEPFGLEPNVSLTEQGLVSVSEGCPKLQSVLYFCRQMSNAALHTIARNRPNLTRFRLCIIEPRTPDYLTLEPLDSGFGAIVEQCKDLQRLSLSGLLTDRVFEYIGTYAKKLEMLSVAFAGDSDLGLHHVLSGCDNLRKLEIRDCPFGDKALLANAEKLETMRSLWMSSCSVSYGACKLLGQKMPRLNVEVIDERGPPDSRPDDCPVEKLYIYRTVAGPRLDMPGFVWTMEDDSSLRLE

SEQ ID NO: 15743 - protein, 306 aa, Streptococcus thermophilus
MYDTIVIGAGPAGMTAALYAARANLKVATLEQGAPGGQMNNTSDIENYPGFESISGPELSMKMFEPLEKLGVENLYGIVSGIEDRGNYKVVKTGDEEYQTKTVIIATGAKHRHIGVAGEEEYNSRGVSYCAVCDGAFFRNQDLLVVGGGDSAVEEGIYLTRFANSVTIVHRRDELRAQKVLQARAFANEKVKFIWDSVVEEIKGDDIKVRSVDIKNVKTGEVTNHEFGGVFVYVGLDPVSDYLTGLDITDQNGWVITDDKMATSVPGIFAIGDVRQKDLRQITTAVGEGAIAGIEAYNYVTALGDK

SEQ ID NO: 15744 - protein, 197 aa, Pseudomonas fluorescens
MAERKASVERDTLETQIKASINLDGTGKARFDIGVPFLEHMLDQIARHGLIDLDIESKGDLHIDDHHTVEDVGITLGQAFSKAIGDKKGIRRYGHAYVPLDEALSRVVIDFSGRPGLQMHVPFTRATVGGFDVDLFQEFFQGFVNHANVTLHIDTLRGTNTHHQIETVFKAFGRALRMAVELDERMAGQMPSTKGVL

SEQ ID NO: 15745 - protein, 457 aa, Aglaothamnion neglectum
MQIFVKTLTGKTITLEVESSDTIENVKTKIQDKEGIPPDQQRLIFAGKQLEDGRTLSDYNNQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTITGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNLQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGM

SEQ ID NO: 15746 - protein, 342 aa, Unknown
  Polaromonas sp. JS666
MQLTLNLKKFPRHSLTFGPTPIQPLRRLSAHLGGKVELYAKREDCNSGLAFGGNKTRKLEYLIPEALAQGCDTLVSIGGIQSNQTRQVAAVAAHLGMKCVLVQENWVNYSDAVYDRVGNIEMSRILGADVRLDAAGFDIGIRPSWEQAMDDVRKAGGKPFPIPAGCSEHPYGGLGFVGFAEEVRAQEAELGFRFDYIVVCSVTGSTQAGMVVGFAADGRADRVIGIDASAKPEKTKAQILRIAKNTARLVELDRDITAKDVVLDTRYGGPEYGLPNEGTLEAIRLCARQEGMLTDPVYEGKSMHGMIDMVRRGEFAEGSKVLYAHLGGVPALNAYSFLFRNG

SEQ ID NO: 15747 - protein, 539 aa, Glycine max
MDSNSSSPNNNNNHHASTTKTNGFLIHPKLGFEPARSRSRLAMASPANTSEPKIVTGTAGYILEDVPHFTDYIPNLPTYPNPLQDNPAYSVVKQYFVHVDDSVPQKVVVHKDGARGVHFRRAGPRQKVYFEADEVQAAIVTCGGLCPGLNTVIRELVCGLHHMYGVKKVLGINGGYRGFYARNTITLTPKSVNDIHKRGGTVLGTSRGGHDTKKIVDSIQDRGINQVYIIGGDGTQKGASAIFEEVRKRGLKVSVVGIPKTIDNDIPVIDKSFGFDTAVEEAQRAINAAHVEAESVENGIGVVKLMGRNSGFIAMYATLASRDVDCCLIPESPFYLEGPGGLYEYIEKRLKENGHMVIVIAEGAGQELVSESVQSMSKQDASGNKLFQDVGLWISQKIRDHFAAQKTLPITLKYIDPTYMIRAIPSNASDNVYCTLLAQSAVHGAMAGYTGYTSGLVNGRQTYIPFYRITERQNHVVITDRMWARLLSSTNQPSFLDAKGDNEEKEEEEALNQLPDGHCAKDTSLASKEINSSIYPTAC

SEQ ID NO: 15748 - protein, 322 aa, Prochlorococcus marinus
MEIANDITSLVGNTPLVRLNRIRNHFNCYPEIIAKLESFNPSASVKDRIAYSMLCKAEEDGLIKPDKTTLIEATSGNTGIALAMVAAAKGYKLILTMPDTMSIERRAMLRAYGAELQLTPGKEGMKGALDLANELSSTIANSYQFNQFENFANPDIHERTTAQEIWSQSNNNLDGLVTGVGTGGTITGCARFLKKVNPNCKIYAVEPQKSAVISGEKAGSHSIQGIGAGFVPKVLDTKLIDEIIKIDDDEAFYYGRLLARLEGLLSGISSGAALAATIKIGERKELTNKRLIVILPSFGERYLSTAMFESNTSIQARKDGYL

SEQ ID NO: 15749 - protein, 136 aa, Lolium perenne
MQAAIGLPAVLPVAARGSRLAARRRSIVAAGTRRLAGGVVHAAPTGAVEVDYSSDVSVFPMEACDLVGVEACEAAEMYPETKLSDSASAAAASKVEEVEREYLSYDEAKTVFPGEACDDLGGEFCEAPYQTGVSKE

SEQ ID NO: 15750 - protein, 203 aa, Sorghum bicolor
MGRTPCCDRAAVKRGPWSPEEDEALRSYVQRHGSGGNWIAMPKKAGLKRCGKSCRLRWLNYLRPDIRHGGFTAEEDAVILSLYTQLGSKWSLIASQMEGRTDNDVKNHWNTKLKKRLLAAAGTFSPAPHARVPAPAPAFRTGHVSPLSLVPSVGIPTVKNRAYTYDDFLGAGARDPFAAADGSTSGAFRGCRPPMVHGGQRAQ

SEQ ID NO: 15751 - protein, 323 aa, Streptomyces coelicolor
MDTRPLVSTPFTASSTADEVLEDVDLTGVRAIVTGASSGLGIETARALTAAGAEVTLAVRNTAAGASAAETIARSTGAAPPRVVRLDLADRAGVTRFVDAWDGPLHLLVNNAGVVTGGLERTPEGWELHFATNHLGHFALATGLHQALARGAAERGGARIVSVSSTAHMRSGIDFDDLHFERRSHDPQTAYAQSKTANSLFAVEATRRWGSAGIVANAVNPGGVATGLQRNFTPEQKASLDAAEAAGVFTYKTVEQGAATSVVAAVAPEFAHSGGHYLDDGQEAYTVPNDADLAQHPHGVKEWALDPAAAKRLWTVSTDLLRS

SEQ ID NO: 15752 - protein, 425 aa, Unknown
  Magnetococcus sp. MC-1
MADKSKNGVANLNEAIRQSLILVLAGGRGSRLKNLTDTEAKPAVPFAGKFRIIDFALSNCVNSGMRRVGVLTQYRAHNLIQHVQRGWGSFRAEFDEFVEVWPAQQQTAAESWYSGTADAVYQNIDLIESHHPKYVVILGGDHIYKQDYSVMLDHHITSGAQVTVACLEVPVAEAREFGVMDVDEQDQIVKFLEKPQTPPELPNRPGWALASMGIYIFDHELLVEQLERDALLEDSSHDFGKDLIPYLVPKVKVMAHRFSHSCVGLDGKKEPYWRDVGTLDAYWEANMDLTHVTPELDLYDPKWPIWTYQVQRPAAKFVFNDDSRRGYAVDSLVSAGCVVSGSAVERSLLFTDVRVNSYSFVSDSVILSHADIGRKCTLIKCIVGPNTVIPDGMVIGKDPQLDAQRFYRTEGGVTLVTQEHIDKLK

SEQ ID NO: 15753 - protein, 219 aa, Medicago sativa
VHTERRRKPKKSLNVSGPVQSYHPNLKNFWYPVAFSADLKDDSMIPMECFEEPWVIFRGKDGKPGCVQNTCAHRACPLHLGSVNEGRIACPYHGWEYTTDGKCEKMPSTRMLNVKIKSIPCFEKEGMIWIWPGSDPPAPSLPSLLPPSGFIVHAEIVMELPVEHGLLLDNLLDLAHAPFTHTSTFAKGWSGPSFVNFLTPASGLQGILGIPIRMIWSFD

SEQ ID NO: 15754 - protein, 353 aa, Solanum betaceum
DAWDTSVDVEVKVADSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKAAFCIHNIAYQGRFDFSDFPLLNLPDEFRGSFDFIDGYEKPVKGRKINWMKAGILESHRVVTVSPYYAQELVSAVDKGVELDNVLRKTSITGIVNGMDTQEWNPATDKYTDVKYDITTVMDAKPLLKETLQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15755 - protein, 314 aa, Spinacia oleracea
QIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVAVY

SEQ ID NO: 15756 - protein, 281 aa, Flaveria trinervia
MKETLNNDYHITEEIGRGRFGTVYRCYSTVSGDSFACKTIDKRLLNDHTDRECLQKEPKILHILGGNPNIVQIYRLYEDDNYVHMIIDLCDSPDLFDRISNRNGVFSETEAATVFAPLMSAISYCHRLGIAHRDLKPDNVLFDSRGGLKLADFGSAEWFAMNDRRTMSGIVGTPYYVAPEVLSGMEYNEKVDVWSAGVILYIMLAGVPPFHGDSPADTFEAVLRGNLRFPTRLFRSVSPEAKDLLRKMLCKDVSRRFSADQVLRHPWVVNGGKTRSMADLT

SEQ ID NO: 15757 - protein, 353 aa, Solanum campanulatum
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCLHNIAYQGRFAFSDFPLLNLPDEFRGSFDFIDGHEKPVKGRKINWMKAGILESDRVVTVSPYYAQELVSAVDKGVELDNVLRKSSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15758 - protein, 636 aa, Oryza sativa
MDGCDCIEPLWPTDELLIKYQYISDFFIALAYFSIPLELIYFVKKSSFFPYRWVLIQFGAFIVLCGATHLINLWTFTTHTKTVAMVMTVAKVSTAVVSCATALMLVHIIPDLLSVKTRELFLKNKAEQLDREMGLIRTQEETGRHVRMLTHEIRSTLDRHTILKTTLVELGGTLGLEECALWMPSRSGSSLQLSHTLRHQITVGSTVSINLPVVNQVFSSNRAIIIPHTSPLARIRPLAGRYVPPEVAAVRVPLLHLSNFQINDWPELSAKSYAIMVLMLPSDSARKWHVHELELVEVVADQVAVALSHAAILEESMRARDLLMEQNVALDLARREAEMAIRARNDFLAVMNHEMRTPMNAIIALSSLLLETELTPEQRLMVETVLKSSNLLATLINDVLDLSKLEDGSLELEIKAFNLHAVFKEVMSFIKPIAAIKRLSVSVMLAPDLPLCAIGDEKRLMQTILNISGNAVKFTKEGHITLVASVVKADSLREFRTPDFHPTASDDNFYLKVQIKDTGCGISPQDLPQVFTKFPQSQPGGNRGYSGSGLGLAICKRFVTLMGGHIWLDSEGTGRGCTVTFVIQLGICDNTNAYQQKLIPLVWPSSGDADFVGPVPNAPNEEKGQASLKSRYQRSI

SEQ ID NO: 15759 - protein, 508 aa, Unknown
  Candidatus Kuenenia stuttgartiensis
MKRSIVYLVGAGPGDPGLITVKGHECIKKADVIVYDYLVNVELLKAAKPDVEMIYVGKQGGSHTLEQEDINKLLVEKALEDKIVTRLKGGDPYIFGRGGEEALVLREYKIPFEVVPGITAAIATPNYAGIPVTHREYTSTFGLITGHEDPAKNESSIDWSKISTGIGTLAFYMGVKNLPYITEQLMKHGRSGDTPVAVIRWGTTFRQETVVGTLNTIVAKAKNIKPPAITIVGEVVKLRDQLNWFENRPLFGKTIVVTRSREQASEFADRLYEFGANVIEFPTIEIVKPDSIQPLDEAINTINTYDWLVFTSINGVDSFFQRLFELGKDVRVLKGLKICAIGPATAGGIERYHIRVDCKPPKFVAESVAEELKKVTAIKGERFLLPRADIARSYLPEELQKSGGEVNDLIVYKTLMGQPKDVNILEKMRNGEINIITFTSSSTVRNFVQLIGKENITSLKGHIQFASIGPITTKTAEEMGIDIAIKAKEYTIPGLVNAILESTSPIDK

SEQ ID NO: 15760 - protein, 458 aa, Yarrowia lipolytica
MNYPAEPEFQQAYDELYNSIHDSTLFDKHPEFEKVIPVVSVPERIIQFRVVWEDDQGKLQVNRGYRVQFNSALGPYKGGLRFHPSVNLSILKFLGYEQIFKNALTGLNIGGGKGGADFDPKGKSDAEIRRFCYAFMGELHRHIGADTDVPAGDIGVGGREVGFLFGAYKKYKNTWEGVLTGKGLTWGGSLIRPEATGFGLVYYVEKMIEYATSGKESFKGKRVAISGSGNVAQYAALKVIELGGNVVSMSDSKGALVLVSDFTEGFTPAEIEQIADIKLQHKELASLYPSATLPETKFKYIEDARPWCHVGKVDVALPCATQNEVSGEEAKSLVAAGCKFIAEGSNMGCESDAIEVFEAERMARPNGIWYGPGKAANAGGVAVSGLEMAQNSQRISWTKEEVDQKLKDIMVDCFNTCVETASTYSSEKVDGLPSLVKGANIAGFLKVSAAMKDHGDFW

SEQ ID NO: 15761 - protein, 176 aa, Brassica napus
PRVRPRVRPRVRPRVRLVNIFWSAVYALTAAEFEGKIAEMNEISQDVARWFELFPPHLWAVAYFQGVRYGHFGLGITEVLYNWALECHELPITQMMEHIRHQISSWFEARRDMSMRWNSILVPSAERRVTEAVSDARCYQVLRANEVEFEIVSTERTNIVDIRTRVCSCRRWELYG

SEQ ID NO: 15762 - protein, 353 aa, Solanum campechiense
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDIATVMDAKPLLKEALQAAVGLPVDRKIPLIGFIGRLEEQKGSDILVAAIHRFIGLDVQIVVLGTGKKKFEQEIEQLEVLYPNKAKGVAKFNVPLAHMITAGADFMLVPSR

SEQ ID NO: 15763 - protein, 713 aa, Yarrowia lipolytica
MMLTKTLVALVAAALAPHTAAGHAHHAHHDTRDVSSAAYGPAPGHPRLLFDEAELYQKMGILGDRDTVNVTEQELHRRTITKEHTRHSHHEHKKRGGQCAFPTNEGLVSVDPSGENAGWAMSPDQPCEPGKYCPYACPPGQLMGQWDPKATSYSYPLSMNGGMFCNKNGEMEKPFPNKPCCYEGTGTFVARNKCGKQVSFCQTVLPGNEAMLIPTEVGSGSTAVLAVPDTNYWAGTAAHFYINPPGVDTATACVWGTLNNPWGNWSPYVAGANQDGNGNTFVKIAWNPIYLEPATPFRNTLPNWGVRVVCDEGSNCNGLPCSIDPRKNKVNEVTAEDAAQGDGASFCVVTAPKGSKAYIEVFEIGNDGNSGGNGGNGGNSGSSSSSSSAPASSSSAPASSSSAASTGMNTMLAHAAGFAAAGQVENLENVESSSSEEPVSSSEGPTSSPPPPPPTTSSSTPPPPSTTSSSTPPPPPPTTSSSAPPPPPTTSSSAPPPPPTTSSTPPPPPPTTSSTPPPPPPTTSSTPPPPPPTTSTTPPPPPTTSSTSPPPPPSSTYVPPSSSPTSSYVFPSAELAKEMAQLMMFNAESATVVSSTSSTKVSTFSSSKTTSTSSSSSRLSLSSTFKPTIKTVAHLRSHDSAAMNVANNGTVGVASSSSTLAATSVSVQEAPAAPTPPPVTVPQGVATIEVSANTSGSSKLAVPLMTLVLVLLL

SEQ ID NO: 15764 - protein, 257 aa, Brassica napus
MLSLVASPPVISAASLSKPLQSLSKAALSLSKRAKPTSPFPKTARSISVYKSPMNNLFTRLGFGSRPQPDPAASAAIAQGPDDDVPSPGQQFAQFGAGCFWGAELAYQRVPGVTKTEVGYSHGFVDNPSYEDVCSETTGHNEIVRVQYDPKEVSFESLLDVFWKRHDPTTLNRQGNDVGTRYRSGIYFYTDEQEKLAREAMEKQQKILNRKIVTEILPATKFYRAENYHQQYLAKGGRMGLSQSAEKGCNDPIRCYG

SEQ ID NO: 15765 - protein, 586 aa, Vicia faba
MCGILAVLGCSDDSQAKRVRILELSRRLKHRGPDWSGLHQHGDNYLAHQRLAIVDPASGDQPLFNEDKSIIVTVNGEIYNHEELRKQLPNHTFRTQCDCDVIAHLYEEYGENFVDLLDGIFSFVLLDTRDNSFIVARDAIGVTSLYIGWGLDGSVWIASELKGLNDECEHFEVFPPGHLYSSKEREFRRWYNPPWFNEAIIPSTPYDPLVLRTAFEKAVIKRLMTDVPFGVLLSGGLDSSLVASVTARYLADTKAAKQWGAKLHSFCVGLKGAPDLKAGKEVADFLGTVHHEFQFTIQDGIDAIEDVIYHTETYDVTTIRAATPMFLMSRKIKSSGVKMLISGEGSDEIFGGYLYFHKAPNKEEFHQETCRKIKALHRYDCLRANKSTYAWGLEARVPFLDKDFIKAAMDIDPEFKMIKHDEGRIEKWILRKAFDDEENPYLPKHILYRQKEQFSDGVGYGWIDGIKDHAAKHVTDKMMFNASHIFPFNTPNTKEAYYYRMIFERFFPQNSARLTVPGGPSVACSTEKAIEWDASWSGNLDPSGRAALGVHVSAYENQINPITKGVEPEKIIPKIGVSPLGVAIQT

SEQ ID NO: 15766 - protein, 147 aa, Glycine max
  misc_feature (101)..(101): Xaa can be any naturally occurring amino acid
PPPGWPEFPPPSPQATAQIGGFLSKKPYAPPLWATHLSPMPCHTFSLGHFPTPNHKWNLPNLPEGTEVWIKRDDLSGMQLSGNKVRKLEYLMPNAEAQGAXDCLITVGGITDLPLLGPQPLGAEVSQIWDCVPGYYGVLPRLPCGDI

SEQ ID NO: 15767 - protein, 382 aa, Methanosarcina acetivorans
MATKRDYYEILGLPKDASVEDIKKTYRKLALQYHPDRNKDPGAEDKFKEISEAYAVLSDTEKRAQYDRFGHAGIDNQYSAEDIFRGADFGGFGDIFEMFFGGGRRGGPMGPRRGSDLQYDLYITFEEAAFGVRKDIDIPRTERCSTCSGTGAKPGTSPKRCPTCGGTGQVRTTRSTLGMQFISTTTCSTCHGRGQIIESPCPVCGGAGRVRNKRTITVNVPAGADSGMSLRLSGEGDSGEPGAPSGDLYIIIHVMEHRHFKRVDYDVISELSITFTQAALGADVMVDTLYGKVKMNIPAGTQTHSVFRLRDKGIQRLHGHGKGDQLVRVIIKTPTKLNQEQKELLRQFENLSKGKKPQEEEKSKAEKHKKGIFEKVKDAFES

SEQ ID NO: 15768 - protein, 361 aa, Coccidioides immitis
MAHSKVIIIGSGPAAHTAAIYLSRAELKPVMYEGMLANGTAAGGQLTTTTDVENFPGFPAGVGGTELMTKMREQSIRFGTEIITETISRVDLSSRPFKLWKEWSDGPDDAPAHTADALIIATGANARRLDLPGEDKYWQNGISACAVCDGAVPIFRNKPLFVIGGGDSAAEEAMFLTKYGSSVTVLVRRDKLRASKTMATRLLNHPKVEVKFNTVAVEVQGEPQPRGLMTHLKIKNVVTGNEEVVPANGLFYAVGHEPATGLIKGQVETDSDGYIATKPGTSYTSVEGVFAAGDVQDKRYRQAITSAGSGCIAALEAEKYIAELGDVEQPANTIQQSATQAEKELEENPPASLEYKSNPLL

SEQ ID NO: 15769 - protein, 455 aa, Campylobacter upsaliensis
MSNSTKTFIIVADIILFIALLALLPFETKVNQGLAILAFIAVLWLSEALHVTITAILIPILAVIMGLMPTKSALHGFADPNIFLFFGGFALAAAMHFQELDKIIAQRILMLARGNFALAALYIFFTTAFLSMWMSNTATAAMMLPLAIGMLSQLDYEENKNTYVFVLLGIAFSASIGGIGTLVGTPPNAIVATNLNITFAQWLQYGIPIVIIFMPLMILVLYVTFKPNLKFQINTDLEQKIPMDTQKYITLIIFAIVAMCWIFSSYINPFVSNLLGFEKKIANFDSVIAILAAVLVCAFRVVSWKKVQENTDWGVLMLFGGGITLSLVLKDSGASKIMADGIISLIAGGHLFLIGFLVSLFIVFLTEFTSNTASAALLVPLFISMAESLGAPPLGLALIIGIGASCAFMLPVATPPNAIVFGTGYIKQSQMVRVGIYLNVLCSIIIALMAYFFWL

SEQ ID NO: 15770 - protein, 523 aa, Coccidioides immitis
MAQSSTRSPPTVMESVTEQIGNTPLVRLHKIPRSLGIEATVYAKLEFFNAGGSVKDRIALRMIEEAERKGRIKPGDTLIEPTSGNTGIGLALVAAVKGYKTIITLPEKMSAEKVAVLRALNATIIRTPTEAAYDSPESHIGVAKRLEKELPNAHILDQYGNEDNPLAHEFGTAEEVWTQTDGKITAIVAGAGTGGTITGLSRGLRKHNPKVTVIAADPQGSILALPESLNEEHKNEPYKVEGIGYDFIPDVLDRQAIDKWYKTGDKESFKYARQLIAEEGLLVGGSSGSAIAALAQASKDFKFQKDDVVVVILPDSIRSYLTKFADDDWLAANDLLPAAPVSVPPSPEIQPKGSRDQFAGVKVKALRLKPVSTVPSDSACEAAIEIMREKGFDQLPVLAPTGRRLVGLITLGNILSWIARGRATGKTPVSEVMFDFSKLSEVITDSRDLTKLEQNAVHRRGKEDRKFIEITLDTPLSTLNRFFEWNSAAVVTERDEQGNMKPVAVATKVDLLTWLLNQTKVNA

SEQ ID NO: 15771 - protein, 606 aa, Thermobifida fusca
MTTQPAPGARPTPTGSVPDTFTHAKPRDPYWYKHAVFYEVLVRGFYDSNGDGTGDLRGLIEKLDYLQWLGIDCLWLLPIYESPLRDGGYDVSDYMKILPEFGRISDFVELVEKAHQRGIRVITDLVMNHTSDQHPWFQASRHDPDGPYGNFYVWSDTTERYSDARIIFIDTEQSNWTYDEVRGQYYWHRFFSHQPDLNFENPDVQDAILEVMRFWLDLGIDGFRLDAVPYLYEREGTNCENLKETHEFLKRIRAEVDRLYPDRVLLSEANQWPADVVDYFGDYESGGDECHMNFHFPLMPRMFMAVRREQRYPISEILAQTPPIPRNCQWAIFLRNHDELTLEMVSDEERDYMYSEYAKDPRMRANMGIRRRLAPLLENDLNQIKLFTALLLSLPGSPVLYYGDEIGMGDNIWLGDRDSVRTPMQWTPDRNAGFSRCDPGRLYLPVIMDPIYGYQAINVEAQQNNPNSLLNWTRNMIQIRKQHPVFGTGDFTELHASNPSVFAFVREYGDDRMLCVNNLSRFPQPVELDLRRFEGITPIECTGGVHFPPIGELPYLLTLPGHGFYWFQLPPVAEEQPLAQPVTTVPAAPQPPAPADRPASDPTQRS

SEQ ID NO: 15772 - protein, 303 aa, Streptococcus pyogenes
MKTVRIFYNPNSGKKEDQLAGQVKDYFCQHGFSEDSVEIITPKDADQAFQLAKQAAKDKIDLVIPLGGDGTLNKIIGGIYEGGAHCLIGLVPSGTVNNFAKAMHIPLQITEALDTILTGQIKQVDICKANQQYMISSLTLGLLADIAADVTAEEKRRFGPLAFLKDSIRILKRNRSYAISLISHNHRIHLKTKFLLITMTNTIAGFPSFSPGAQADDGYFQVYTMKKVSFFKFLWHINDFKQGDFSKAEEISHFQANTLSLLPQAKKQAILPRARIDGDKSDYLPIQLDIIPKAISIIVPTED

SEQ ID NO: 15773 - protein, 239 aa, Prochlorococcus marinus
MNNKEQDNYSNVTLDLIKKFVDSNQRKRINSLTQIESEVENIFNLGPSLFDMFDREGDDWAAGWILQVLKKFKPEFFENSKFNNWFNTYSDIDINYEDLQLMLVEQKFEDADRLTSSYLRKLAGKLAEKRGYVFYSEVKNMSGKDLETIDRLWNIYSTGRFGFSIQAKILKSVGKKYELMWPKIGWKKEGLWTRYPGSFCWSLDAPDGHMPLINQLRGVRLMDSILRHPAIAKRHNNIL

SEQ ID NO: 15774 - protein, 424 aa, Unknown
  Burkholderia sp. 383
MSNTQPFFSQPLAERDAPVRSAILKELERQQSQVELIASENIVSRAVLEAQGSVLTNKYAEGYPGKRYYGGCEFADEVEALAIDRVKQIFNAGYANVQPHSGAQANGSVMLALAKPGDTVLGMSLDAGGHLTHGAKPALSGKWFNAVQYGVNRDTMLIDYDQVEALAHEHKPNLIIAGFSAYPRALDFARFRAIADSVGAKLMVDMAHIAGVIAAGRHANPVEHAHVVTSTTHKTLRGPRGGFVLTNDEDIAKKINSAVFPGLQGGPLMHVIAGKAVAFGEVLQADFKTYIDNVLANAQALGEVLKAGGVDLVTGGTDNHLLLVDLRPKGLKGAPVEQALERAGITCNKNGIPFDTEKPTVTSGIRLGTPAGTTRGFGVAEFREVGRLILEVFDALRANPEGDHATEQRVRREIFALCERFPIY

SEQ ID NO: 15775 - protein, 184 aa, Sorghum bicolor
MGRQPCCDKVGLKKGPWTAEEDQKLVTFLLANGHCCWRAVPKLAGLLRCGKSCRLRWTNYLRPDVKRGLLSSEEERTVIDLHEQLGNRWSKIASQLPGRTDNEIKNHWNTHIKKKLRKMGIYPVTHKPLHQPASPPPLTRQEQDTGGGSPEKEEKEKEKLLWQATPSVWARDVLRRRGAHGAPS

SEQ ID NO: 15776 - protein, 415 aa, Streptomyces coelicolor
MRRIVYLGGLTPRGVPERTLSPHLRSRAEVGPILVRDVLHYLAGAATMPDDIDRAFDVGGPDVPTYREMMRRHATVSGLRRRIIVPAPVLTPGLSSHWVGLVTPVPASIARPLTESLRHEVVCQEHDIARYVPDAPGRPLPFDVALTLALRRVREAQVATRWSSASVPGAPSDPLPTDPDWAGGSLYEDERHLPVDASPEALWKVVEGIGGDNGWYSFPPAWAVRGWLDRFVGGVGLRRGRRDAQRLHPARPVAWRGGRRRGHRRLAGRTGYPVVDAAMRQLRHQGWMHNRARLLVASFLTKTLYVDWRIGARHFLDLLVDGDVVNNQLNWQWAAGTGTDTRPHRVLNPLVQARRFDPDGVYVRRWVPELRSVEGGKVHEPWRLAAAERGELDYPDPLVELADGLARFKHARGRD

SEQ ID NO: 15777 - protein, 162 aa, Sorghum bicolor
MGRQPCCAKVGLKRGPWTVEEDQKLVTFLLTNGHCCWRAVPKLAGLLRCGKSCRLRWTNYLRPDVKRGLLSSEEERTVIDLHEQLGNRWSKIASQLPGRTDNEIKNHWNTHIKKKLRKMGIDPVTHKPLHQPASPPPPPPLTRQEQEEKDTRGSPKKKRRRR

SEQ ID NO: 15778 - protein, 294 aa, Cucumis sativus
MGRPPCCEKVGIKKGPWTPEEDIILVSYIQQHGPGNWRSVPTNTGLLRCSKSCRLRWTNYLRPGIKRGNFTPHEEGMIIHLQALLGNKWAAIASYLPQRTDNDIKNYWNTHLKKKLKKLNSAAVDTPEPPESATTRFQSNDKVPTADSPSSLVSNRATTYASSAENISRLLQAWMRSSPEESRRKMSGENSIAAATQQQQQPKAEPDGGELVSGEEFDSILSFENMKSVNSWGKSSLSYKGKEEVNVGEKQSSENDDATAENATAPPLSFLEKWLFEEGAAGQVEEMMELSPVF

SEQ ID NO: 15779 - protein, 356 aa, Oryza sativa
MAAQRLAALHAAAPSAFSSTSSASHGRPAARSSTTALLPVALPRAAATLRAAPSRLLPQEAKAAGSGRSVMCMASASASAAVASGAAELKAAREDIRELLKTTHCHPILVRLGWHDSGTYDKNIKEWPQRGGANGSLRFDVELKHGANAGLVNALKLVQPIKDKYPNISYADLFQLASATAIEEAGGPKIPMTYGRIDVTGPEQCPPEGKLPDAGPSAPADHLRKVFYRMGLDDKEIVVLSGAHTLGRSRPERSGWGKPETKYTKNGPGAPGGQSWTAEWLKFDNSYFKEIKEKRDQDLLVLPTDAALFEDPTFKVYAEKYAEDQEAFFKDYAGAHAKLSNLGAKFNPPEGFTLDG

SEQ ID NO: 15780 - protein, 324 aa, Clostridium thermocellum
MSSVRTIGVLTSGGDAPGMNAAIRSVVRTGLYYGFKVLGIRKGFNGLINGDIEELTARSVGDIIHRGGTILQTARSPQFKTEEGLKKAMSMAKVFGIDALVVIGGDGSYRGARDISKLGLNVIGIPGTIDNDIGCTDYTIGFDTAMNTVQDAIDKIRDTAYSHERCSVLEVMGRHAGYIAVNVSISGGAEAVVLPEKPFDMDTDVIKPIIEGRNRGKKHYLVIVAEGGEGKAIEIAKEITEKTGIEARATILGHIQRGGSPTVYDRVMASQMGAKAVEVLMENKRNRVIVFKDNQIGDMDLEEALQVKKTISEDLIQLSKILAL

SEQ ID NO: 15781 - protein, 204 aa, Sorghum bicolor
MGRQPCCDKVGLKKGPWTAEEDQKLVTFLLANGHCCWRAVPKLAGLLRCGKSCRLRWTNYLRPDVKRGLLSSEEERTVIDLHEQLGNRWSKIASQLPGRTDNEIKNHWNTHIKKKLRKMGIYPVTHKPLHQARFPPPLTRQEQDTGGGSPEKEEKEKEKAVVAIPQTWAQDVCADKVLWTPLYTSSCTAGDHYSGLPTTPRLFS

SEQ ID NO: 15782 - protein, 319 aa, Alkaliphilus metalliredigenes
MKTIGVLTSGGDSPGMNAAIRAVVRSGIYNGCKIMGIKQGYSGLINAKIEEMNLSSVADIIHRGGTILRTARCEEFRTEEGRKKALNVLKVLKIDGVVVIGGDGSFQGAKKLSELGIPTVAVPGTIDNDLGYSDYTIGFDTAMNTVLDAISKIRDTSTSHGRANIIEVMGRHCGDIALYTGLAGGAESIIIPEVGLDIDEICRKLLQGKNRGKLHSLIVLAEGVGGAIDLGKIIEEKTGIETRSTVFGHIQRGGSPTAFDRILASKMGARAVDLLIEEKGNRAVGIKGNQIFDMDIEEALNIENKFDQETFELAKILSI

SEQ ID NO: 15783 - protein, 141 aa, Arabidopsis thaliana
  misc_feature (42)..(42): Xaa can be any naturally occurring amino acid
PSVRGKEEEITRRGKCASYMHSSAVVVTSPTQATMVAPFTGXKSSAAFPVTRMTNKDIASIAIIGGRVSRTKGRPPNEKNKEETVSYLPDLSDAELTKEVDYLVRNKWIPCVEYELEHGSVSREHGNTPGYYEGRNWTMGK

SEQ ID NO: 15784 - protein, 353 aa, Solanum carolinense
DAWDTSVAIEVKVGDSIEIVRFFHCYKRGVDRVFVDHPMFLEKVWGKTGSKIYGPKVGQDYLDNELRFSLLCQAALEAPRVLNLNCSKYFSGPYGEDVLFIANDWHTALIPCYLKSMYQSRGIYLNAKVAFCIHNIAYQGRFGFSDFPLLNLPDEFRGSFDFIDGYEKPVKGRKINWMKAGILESDRVVTVSPYYAQELVSAVDKGVELDNVLRKTSITGIVNGMDTQEWNPATDKYTDAKYDITTVMDAKPLLKEALQAAVGLPVDRKTPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15785 - protein, 109 aa, Zea mays
  misc_feature (18)..(18): Xaa can be any naturally occurring amino acid
  misc_feature (23)..(23): Xaa can be any naturally occurring amino acid
  misc_feature (40)..(40): Xaa can be any naturally occurring amino acid
  misc_feature (58)..(58): Xaa can be any naturally occurring amino acid
  misc_feature (66)..(66): Xaa can be any naturally occurring amino acid
  misc_feature (72)..(73): Xaa can be any naturally occurring amino acid
  misc_feature (77)..(77): Xaa can be any naturally occurring amino acid
  misc_feature (80)..(80): Xaa can be any naturally occurring amino acid
  misc_feature (87)..(87): Xaa can be any naturally occurring amino acid
  misc_feature (89)..(90): Xaa can be any naturally occurring amino acid
  misc_feature (92)..(92): Xaa can be any naturally occurring amino acid
  misc_feature (94)..(96): Xaa can be any naturally occurring amino acid
  misc_feature (101)..(101): Xaa can be any naturally occurring amino acid
  misc_feature (103)..(103): Xaa can be any naturally occurring amino acid
MDARRAAGGGRVRSRPHXTGWTXKFTPLRGGRSEIVFVSXTGEEIKNKRQLSQYLKAXPGGPAVSXFDWGTXXTPKXSAXISEKVKXFXXPXGXXXIPKRXRXSSGREG

SEQ ID NO: 15786 - protein, 350 aa, Solanum chenopodinum
  misc_feature (140)..(140): Xaa can be any naturally occurring amino acid
DTSVAIEVKVGDSIEIVRFFHCYKRGVDRVFVDHPMFLEKVWGKTGSKIYGPKAGQDYWDNELRFSLLCQAALEAPRVLNLNCSKYFSGPYGEDVLFIANDWHTALIPCYLKSMYQSRGIYLNAKVAFCIHNIAYQGRFXFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15787 - protein, 258 aa, Prochlorococcus marinus
MQIIRNNSQDPISISNWRWACFLDETIKAFSTFQTRPYQIDNDFLFRESFFGSSSNPKKVILETWGLKMEKIRQARCACLQAGEITSVMNLVISPLNNYDLPFFGADFVTLPNGHLIALDLQPALKDDINHTQHVWNKLKPIHAHWQSKIPSGGDIPSDARQYFSPAFLWSRIPLGEEGDNLITQTIKPAFDEYLNCFFDLLRDAKITSKERSFQLLNGQKKYMRYRAEKDPARGMLRSFFGEVWTESYINNILFDLK

SEQ ID NO: 15788 - protein, 353 aa, Solanum cinereum
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCLHNIAYQGRFAFSDFLLLNLPDEFRGSFDFIDGHEKPVKGRKMNWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLHPNKAKGVAKFNVPLAHMITAGADFMLVPSR

SEQ ID NO: 15789 - protein, 783 aa, Arabidopsis thaliana
MDAIKCSSSFLHHTKLNTLFSNHTFPKISAPNFKPLFRPISISAKDRRSNEAENIAVVEKPLKSDRFFISDGLPSPFGPTVRDDGVNFSVYSTNSVSATICLISLSDLRQNKVTEEIQLDPSRNRTGHVWHVFLRGDFKDMLYGYRFDGKFSPEEGHYYDSSNILLDPYAKAIISRDEFGVLGPDDNCWPQMACMVPTREEEFDWEGDMHLKLPQKDLVIYEMHVRGFTRHESSKIEFPGTYQGVAEKLDHLKELGINCIELMPCHEFNELEYYSYNTILGDHRVNFWGYSTIGFFSPMIRYASASSNNFAGRAINEFKILVKEAHKRGIEVIMDVVLNHTAEGNEKGPIFSFRGVDNSVYYMLAPKGEFYNYSGCGNTFNCNHPVVRQFILDCLRYWVTEMHVDGFRFDLGSIMSRSSSLWDAANVYGADVEGDLLTTGTPISCPPVIDMISNDPILRGVKLIAEAWDAGGLYQVGMFPHWGIWSEWNGKFRDVVRQFIKGTDGFSGAFAECLCGSPNLYQGGRKPWHSINFICAHDGFTLADLVTYNNKNNLANGEENNDGENHNYSWNCGEEGDFASISVKRLRKRQMRNFFVSLMVSQGVPMIYMGDEYGHTKGGNNNTYCHDNYMNYFRWDKKEEAHSDFFRFCRILIKFRDECESLGLNDFPTAKRLQWHGLAPEIPNWSETSRFVAFSLVDSVKKEIYVAFNTSHLATLVSLPNRPGYRWEPFVDTSKPSPYDCITPDLPERETAMKQYRHFLDANVYPMLSYSSIILLLSPIKDP

SEQ ID NO: 15790 - protein, 139 aa, Solanum lycopersicum
APKAEKKPAEKKPAEEKKAEKTPKAGKKLPKESGSSGADKKKKKSKKSIETYKIYIFKVLKQVHPDIGISSKSMGIMNSFINDIFEKLAQESSRLARINKKPTITSREIQTAVRLVLPGELAKHAVSEGTKAVTKFTSS

SEQ ID NO: 15791 - protein, 353 aa, Solanum citrullifolium
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKLNWMKAGILESDRVVTVSPYYAQELVSAVDKGVELDNVLRKTSITGIVNGMDTQEWNPATDKYTDVKYDITTVIDAKPLLKEALQAAVGLPVDRKIPLIGFIGRLEEQKGSDILVAAIHKFIGLDVQIVVLGTGKKKFEQEIEQLEVLYPDKAKGVAKFNVPLAHMITAGADFMLVPSR

SEQ ID NO: 15792 - protein, 540 aa, Neotyphodium uncinatum
MTLTNLDAIVVGAGFSGILAVYRLRKLGFRVQGFERQERLGGVWRENAYPGAAVDSLFPFYQFYDAELLQDWEWGEQFPTRAEMLRYFDHVDKRWEISASFEFGVSVSAARYSETTQRWTVTLEDGRRAEARWFIPAVGFSSVLNIPRIPGMSRFRGAIYHTAKWPHDAVSMRGKRVAVIGTGPSGVQIIQSVGKIAKAMTIFQQSPCLTLRKYGSPNQTATALCMRPDDHREALRLGLQTSNGFGYVPRDQDTLDVPIEERNHFYQQRYLAGGWAFWMAGFRDLCQNIQANRDAYDFWARRTRARIGDVTKRELLVPQIPSFAFGIKRPCLEEDLYEIMDQPHVKIIDISNQQIELITETSIRVHGQTVECEAIIFATGFGDEASGLRSLHIRGRNGIRLEDAWSDGVESHLGMAIHSFPNMFFLYGPQCPTLLVNSPAVITVQVEWLCEIISKCQQAGICQLEATSKSHCQWEKKMSLLWDKTLYHTHARKSKKTAEANKEEKTWVGGLILYRRELENCLANNLEGFQAWYVEETALL

SEQ ID NO: 15793 - protein, 382 aa, Unknown
  Mycobacterium sp. MCS
MRDHQVVVIGAGPSGVAAALSLRDRGLRPVLIDRADHVGSSWKARYDRLKLNTGRRTSHMPNRPFPDGTGVFPTRDQVVAHLDRHAHEDGIELLLETTVTRIDRHPAGWCLSTSTGDLTARQVVVATGYEHSPRIPEWPGMRSYPGEVSHSAQYRNPRPYTGRRVLVVGAGSSAMEIVHDVATGGAESAWLAVRTVPHIMIRSLPGGFPSDYLATPLFDAPTWLADAVSRVGQRIDVGDLAEYGLPTPSEGVFARGKRLGRAPVIVDREVVRAIRARVFEVVPTIARFDGATVELVDGRRLQPDAVICATGYTRGLDAMVGHLGVLDDKGLPRSCGVAAAAPGLRFVGFLSRPGLISYVAKQSQHVARHIADELDRTPTLIR

SEQ ID NO: 15794 - protein, 540 aa, Neotyphodium uncinatum
MTLTNLDVIVVGAGFSGILAVYRLRKLGFRVQGFERQERLGGVWRENAYPGAAVDSLFPFYQFYDAELLQDWEWVEQFPTRAEMLRYFDHVDKRWEISASFEFGVSVSAARYSETTQRWTVSLEDGRRAEARWFIPAVGFSSVLNIPRIPGMSRFRGPIYHTAKWPHDAVSMRGKRVAVIGTGPSGVQIIQSVGKIAKAMTIFQQSPCLTLRKYGSPSQTATALCMRPDDHREALRLGLQTSNGFGYVPRDQDTLDVPIEERNHFYQQRYLAGGWAFWMAGFRDLCQNIQANRDAYDFWARRTRARISDVAKRELLVPQIPSFAFGIKRPCLEEDLYEVMDQPHVKVIDISNQQIELITETGIRVHGQTVECEAIILATGFGDEASGLRSLHIRGRNGIRLEDAWSDGVESHLGMAIHSFPNMVILYGPQCPTLLVNSPAVITVQVEWLCEIIARCQQAGICQLEATSKSHCQWERKMSLLWDKTLYHTHARKSKKTAEANKEEKTWVGGLILYRRELENCLANNLEGFQAWHVEETGLL

SEQ ID NO: 15795 - protein, 234 aa, Unknown
  Candidatus Kuenenia stuttgartiensis
MSIVNIQELVEAGFHFGHRTSRWNPKMKPFIFGKQNLIHIINLRETVKGLITACRFVTNLVQTKKDILFVGTKWQAQDITAREAKRCGMHYVSERWLGGALTNFDTIRSRLERLEELEKMKDTGEINQYSKKMISSLNREYKKILTNLEGIRNMTKLPGALVVVDPRYEHNAIKEAKKLGIPTVCLADTDCDPDMVDICVPGNDDAIRSINLFLSKTADAVLAGKEQLVTLTKD

SEQ ID NO: 15796 - protein, 336 aa, Leuconostoc mesenteroides
MTKIAVLGGGSWGTALANVAAENNNDVRLWTRTATQADEINSQHTNQKYLPDAKLSSELMATSNMALAVMDAEIVLTVVPTKVVREVARQLADVLNKQDHQVILAHATKGLEQVTYKRVSEMLAEEVPAKYRSTLAMISGPSHAEDVIKHDLTSVSIASENEEAAKLLQQVFANSSFRPYTNHDLLGSELAAALKNIIAIGSGALIGLGYGANAQAALLTRGLSEMRALGQAMGAQPETFLGLAGIGDLIVTGMSPNSRNYRAGKQLGEGKSLQEIQDDMGMVIEGVSTTKAVYEFSQHHHVEMPITAGIYRILYENEPLRDVISDLMSRPLRSED

SEQ ID NO: 15797 - protein, 336 aa, Deinococcus radiodurans
MARRRLPSMTHGNSSQSDRPRIISPLAPRADAAEVVRGVDLKGKTAVVTGGASGLGTETARALLLAGAHVILPVRDRAKGERVAAELRQSTGGTVELVDLDLGSLASVRRGAAEIRQLAPRIHILINNAGVMATPQSRTVDGFETQFGTNHLGHFLLTRELLPALMAAAPARVVALTSSGHRRSDIVWDDLNFERRPYDPWDAYGQSKTANALFAVGLTQRYADQGLTANAVHPGGIMTGLQKFVPLEDQRRMGWQDEHGTLNPVFKTPAEGASTSVWAATSPQLYGVGGLFLEDLQHSTPLDESAPNPLFGYKPYALDHESARRLWALSEALVGE

SEQ ID NO: 15798 - protein, 317 aa, Leuconostoc mesenteroides
MSEELKEYDVVVIGAGPAGMTAATYASRANLSVLMLDRGIYGGQMNNTAEVENYPGFDSILGPDLAEKMYSSSTQFGAEYGFGSVESIEVEDYRKIIHTDMGTYAAKAIIIATGSEHIHLDVTGEDKYQGRGVSYCAVCDGAFFRDEDVLVIGGGDSAIEEGLYLTNLAKSVTVLHRRDKLRAQQIIQNRAFDNSKMKFEWHTEVVAITGDDDKVTGVDVINNQTNEKRHIDASGVFIYVGLKANTQGFENLNITDPEGWIVTDDKMQTSIPGVFAVGDVRVKDLRQITTAVGDGSLAGQGVYDYISSLPATEKIAE

SEQ ID NO: 15799 - protein, 423 aa, Prochlorococcus marinus
MNILQNLKESDPVISNFINSEKNRQETHLELIASENFASIAVMQAQGSVLTNKYAEGLPQKRYYGGCEFVDEIEELAIQRAKKLFNANWANVQPHSGAQANAAVFLSLLKPGDTIMGMDLSHGGHLTHGSPVNMSGKWFNAVHYGVNKETSELNFDEIREIALEKKPKLIICGYSAYPRTIDFESFRNIADEVGAFLMADIAHIAGLVASKLHPNPIPHCDVVTTTTHKTLRGPRGGLILCKDAEFGKKFDKSVFPGTQGGPLEHIIAAKAVAFREALQPDFVNYSQQVIKNAKVLASTLINRGINIVSGGTDNHIVLLDLRSINMTGKIADLLVSEVNITANKNTVPFDPESPFVTSGLRLGTAALTTRGFNENAFAEVGEIIADRLLNPDNSLIESQCKERVLTLCNRFPLYEGKLEASIK

SEQ ID NO: 15800 - protein, 661 aa, Medicago truncatula
MTCTTRFLSFILLHHFLFMTLTNAQSPFYMYSYCQNSTEKTVNTSYQSNVNNFLSWTTSDSAKGTVSNHNTIGSNNSNYNDTVYGFYDCLGPNTRSFCQFCINTAFREIAKYCPNSVSAIIWYDVCIMGYTNQNPSGRVFLEPSWNVTGSKNVKDSTELGKAENSMTSLIRKVTTVASLNWATDEFNWSDTDKRYGLVQCNTELSKDGCRQCLEAMLERVPQCCGTKVGWVVLCPSCGLKIDDYNFYEQQTGSPSPLPNPGKQEGASHTKTLIIIVVSVLVAVALLSCYGYYYWKKKGLSEGGLLLRTVTPMSFRDHVQRDDSLHGDLPIIPLSVIQQATDNFSESSKLGEGGFGPVYKGTLPDGTEVAVKRLAEMSGQGSEEFENEVIFIANLQHRNLVKLLGCCMEENEKILVYEYLQNSSLDFHLFDKEKHKHIDWRLRRSIINGIAKGLLYLHEDSRLRVIHRDLKASNVLLDDEMNPKISDFGLARRFEKDQCPTKTERVFGTYGYMAPEYAMAGLFSVKSDVFSFGVLVLEIIYGKRNGEFFLSEHMQSLLLYTWKLWCEGKSLELIDPFHQKMYIESEVLKCIHIGLLCVQEDAADRPTMSTVVSMLGSETVDLPKPTQPAFSVGRKPKNEDQSSKNYKDNSVDEETITIVSPR

SEQ ID NO: 15801 - protein, 220 aa, Coccidioides immitis
MDTLKDADLCAIAVIPGLYISDRFGARSQFLLRSHNIKYVLSATCEQDVPRWDETTLTKISTMHLDIDDHPMQDILCYLKQACDWIHAALEEKPDGTDPQKPVGVLVHCVQGISRSGAIVVAYLMRYHSLSYSDALSVARKHRPLIAPNPGFEQQLRLWELCNYDVYAAGSDILRPEYEFWKAQCRKAFQGPEAGSKKVIHETMNNIEAEMMKWGTMIEN

SEQ ID NO: 15802 - protein, 1315 aa, Botryotinia fuckeliana
MEDSTIAHTTAILQTLALSSIDLPLTNVYGNKGIRLPGADTAEKLALERELAALVSRVQRLEARAITVNNQTLPDTPNELGAPSAFADVLTGAPSRASKSTTSRQQLVNSLLAAREAPTGGERPPKFTKLSDEELEALREHVDHQSKQLDSQKSELAGVHAQLFEQKQRQEQALNVLEVERVAALERELKKHQQANEAFQKALREIGEIVTAVARGDLSKKVQIHSVEMDPEITTFKRVINTMMDQLQIFSSEVSRVAREVGTEGILGGQAKISGVDGTWKELTDNVNVMAQNLTDQVREIASVTTAVAHGDLTQKIERPAQGEILQLQQTINTMVDQLRTFAAEVTRVARDVGTEGILGGQAEIEGVQGMWNTLIVNVNAMANNLTTQVRDIAIVTTAVAKGDLTQKVQAECKGEIKQLKETINSMVDQLQQFAREVTKIAREVGTEGRLGGQATVHDVEGTWRDLTENVNGMAMNLTTQVREIAKVTTAVARGDLTKKIEVEVQGEIASLKDTINTMVDRLSTFAFEVSKVAREVGTDGTLGGQAQVDNVEGKWKDLTENVNTMARNLTTQVRGISTVTQAIANGDMSQKIEVAAAGEILILKETINNMVDRLSIFSNEVQRVAKDVGVDGKMGGQADVAGIGGRWKEITTDVNTMANNLTTQVRAFGDITNAATDGDFTKLITVEASGEMDELKRKINQMVYNLRDSIQRNTLAREAAEFANRTKSEFLANMSHEIRTPMNGIIGMTQLTLDTDLTQYQREMLNIVHNLANSLLTIIDDILDLSKIEANRMIMEEIPYTLRGTVFNALKTLAVKANEKFLDLTYRVDSSVPDHVVGDSFRLRQVILNLVGNAIKFTEHGEVSLTIQKAEQDHCAPNEYAVEFCVSDTGIGIQADKLNLIFDTFQQADGSMTRKFGGTGLGLSISKRLVNLMRGDVWVKSQYGKGSSFYFTCTVRLATSDISFIQKQLKPYQGHNVLFIDKGQTGHGKEIITMLTQLGLVPVVVDSEQHTILLGNGRTKEKIASTYDVIVVDSIESARKLRSIDEFKYIPIVLLAPVIHVSLKSALDLGITSYMTTPCLTIDLGNGMIPALENRAAPSLADNTKSFDILLAEDNIVNQRLAVKILEKYHHVVTVVGNGQEALDAIKEKRYDVILMDVQMPIMGGFEATAKIREYERSLGTQRTPIIALTAHAMLGDREKCIQAQMDEYLSKPLKQNHLIQTILKCATLGGALLEKGREVRQSANEESPNSQNGPRGTQHPASSPTPAHMRPAIEPRAYTTTGPINHGSAESPSLVTADAEDPLARLLMRAHSS

SEQ ID NO: 15803 - protein, 160 aa, Glycine max
MIISKKNRNEICKYLFQEGVLYAKKDYNLAKHPQIDVPNLQVIKLMQSFKSKEYVRETFSWQHYYWYLTNDGIEFLRNFLNLPSEIVPATLKKSARPPGRPLGSGPPGDRPRGPPRFEGDRPRYGDRDGYRGGPRGAPGDFGGEKGGAPAEFQPSFRSSG

SEQ ID NO: 15804 - protein, 208 aa, Brassica napus
  misc_feature (13)..(13): Xaa can be any naturally occurring amino acid
  misc_feature (15)..(16): Xaa can be any naturally occurring amino acid
GIVVLVALFIWEXKXXEEQMVQITRDETLSRLPLRLSTNRVVELVQLRDTVRPVILAGKKETVALAMQKADGFRTELLRRGVLLVPVVWGERKTPEVEKKRGFGASSKTAATSLPSIGEDFDTRTQSVVAQSKLKSEIRFKSEVVSPGEWERWIRDQQIAEGVVPGEDVYIILRLDGRVRRSGKGMPDWAEISKELPPMDDVLSKLER

SEQ ID NO: 15805 - protein, 122 aa, Brassica napus
  misc_feature (118)..(118): Xaa can be any naturally occurring amino acid
MAQGTLEVLLVGAKGLENTDYLCNMDPYAVLKCTSQEQKSTVASGKGSDPEWNETFVFTVSENATELVIKLLDSDGGTDDDSVGEATIPLDGVYTEGSIPPTVYNVVKDEEYRGEIKXGLTF

SEQ ID NO: 15806 - protein, 376 aa, Nerium oleander
MAIDCMFKSKSTVPEMCKDEKKPLVFDASLLQHQTHIPTEFIWPEHEKPCPNPREHPVPLIDLGGFLSGNPVAAMEASRLVGEACQEHGFFLVVNHGVDADLIADAHRYMDYFFELPLCDKQRAQRKLGEHCGYASSFTGKISTKLPWKETLSFRFSAEKRSSHMVEEYFEKTLGDEFAHLGNVYQEYCNAMSTLSLGIMELLGMSLGISRESFKDFFQDNESIMRLNYYPPCQKPELTLGTGPHCDPTSLTILHQDTVGGLQVFVDGEWRSISPNVSAFVVNIGDTFVALSNGRYKSCLHRAVVNNKTPRKSLAFFLCPKEDKVVSPPSELVDSNNPRIYPDFTWAKLLEFTQKHYRADMNTLQIFSNWLQQKNS

SEQ ID NO: 15807 - protein, 328 aa, Burkholderia thailandensis
MHAWSAQHVPPQGGKVAVVTGANSGLGWQIAQTLAAKGAQVVMGCRDTAKGELAAHAIRTRYPRARIEVEALDLADLASVCRFADAVADRHGRVDILCNNAGVMFLPLRRTRDGFEMQMGTNHLGHFALTGLLLPALRASHRARVVTMSSGFNRLGKIRLDNMLAERGYNKYRAYCDSKLANLMFTLELQRRFDHAGLSMRSIAAHPGYAATNLQFAGPVMENSSLGSFAMRLSNRLVAQPADVGALPAIHAATAVDIEGGAYIGPAHLCETRGYPANARIPHQARDVRMGKRLWEKSEQLTGVRYLDTPPPGSRRGASRYDATFRAL

SEQ ID NO: 15808 - protein, 160 aa, Brassica napus
MLRYSCCISNRSYEAKHPPFLRAQRRVSSGRITLCSGGGGGGATAVVSSSRLRDLVFVVNPQGANGRTAKEWKKLLPYLRSRLGEDCNICESLTSVPSHAIDITREAIRDGADAVIAVGGDGTLHEVVNGFFWEGKLVGNLNSETSHSAALGLIPLGTGF

SEQ ID NO: 15809 - protein, 540 aa, Zea mays
MGLGVDAETVRLGVLSSTSDHASVVSNNFFVALLCACIVLGHLLEENRMVNESITALLVGLGTGTVILMISRGVSIHVLVFSEDLFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDATSIVVFNALQNFDITHINAEVVFHLLGNFLYLFLLSTVLGVATGLISALVIKKIYFGRHSTDREVALMMLMAYLSYMLAELFALSGILTVFFGCIVMSHYTWHNVTESSRITTKHAFATLSFLAETFIFLYVGMDALDIEKWRSVSDTPGKSIAISSILMGLVMLGRAAFVFPLSFLSNLAKKNEHEKISWKQQVVIWWSGLMRGAVSMALAYNKFTRAGHTEVRGNEIMITSTITVVLFSTVVFGLLTKPLIRLLMPHRHLTMLSDDSTPKSLHSPLLTSQLGSSIEEPTQIPRPTNIRGEFTTMTRTVHRYWRKFDDKFMRPMFGGRGFVPFVPGSPTERNPHDLSKP

SEQ ID NO: 15810 - protein, 358 aa, Nerium oleander
MKNEILDFDMAALQKQSKLPTQFLWPYEDLVHTQDELREPVVNLEGFFRGDKEGTRNAAELIRTACLNHGIFQVINHGVDKDLIHDAYEHMDAFFKLPVGKKLSARREPGTLCGYSGAHAHRYSSKLPWKETLSFTYNHGSNFHVLNYFTSVLGNEFQETGLVYEKYCKAMENLCLVVMELLAISLGIEGLHYRKFFEDGCSLMRYNYYPPCKEFGLTFGTGPHCDPTSITILHQDQVGGLEVFANNKWKAVRPRSDAFVINIGGTFTALSNGRYKSCLHRAVVNKEKVRRSLVFFVCPKEDKVVRPPQDLIDREGPRKYPDFTWSDLLEFTQKHYRADVTTLQSFIHWFLPAKHDQN

SEQ ID NO: 15811 - protein, 261 aa, Brassica napus
MHLLTVTSSSGSNAEKPPQKKKKVHGPRPLSLLLLPDELSLNCLARVPRCYHPSVSMVSTALRRLIASPAIYVERSLLRRTEHVLYVALRSCVTETPRWYTLNLKPFGQAYGVNHSLVPVPSFPPVPSWGMSIFTVGSEIYVIGGCVNEKMVSTVFVIDCPSYTCRFLPNMKQARACAAAGIVGGKLYVIGGCKPRSSNWVEAFDLKTQTWETVTGLNKVEMYEKMIRSFLIDDKIYLMDRKSSFVYDPKEGRLERDPLLN

SEQ ID NO: 15812 - protein, 353 aa, Solanum cleistogamum
DAWDTSVAIEVKVGDSIEIVRFFHCYKRGVDRVFVDHPMFLEKVWGKTGSKIYGPKAGQDYLDNELRFSLLCQAALEAPRVLNLHCSKYFSGPYGEDVLFIANDWHTALIPCYLKSMYQSRGIYLNAKVAFCMHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAACGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15813 - protein, 261 aa, Prochlorococcus marinus
MNDDKPGTVYLVGAGPGDPDLLTVKARRLLSQCNALVYDALIPDEVLGFVRDKCECIFVGKRRGHHSTSQVKTNLVLLELAKRHECVVRLKGGDPFVFGRGGEEAIFLEKNGISVQVVPGVTAGIAVPSYFGIPLTHRLAGSSVTFVTGHEGISKTRPSVNWQALAQSTNTLVIYMGVHNLAYIVKELLAGGLDLKTPSAVIQQGTVVGQRLLKTTLENLAKDVKDQNFISPSIVIIGDVVDFQVESCAPFPANVTMPIML

SEQ ID NO: 15814 - protein, 165 aa, Triticum aestivum
MAAFTTTAAPSAYAAAAVARSPAPSPSQWAPPHRSPPAVGLRREAAPPRRGAALLVKAKKETFSTFEELLEKSEKPLLVDFYATWCGPCQYMVPILQEVHEKMSDKINIVKIDTEKYTSIANKYKIEALPTFIIFKDGEPCYRFEGALPADQLILQIESALEAPK

SEQ ID NO: 15815 - protein, 539 aa, Yarrowia lipolytica
MTPSSNLSLATNLRNASVLFSDLCLYQSAKWCIEALDGLQLDPQNPDSLAQARMDFYSQLGTETDKYLLGKMYFDTKEYDRCAYHLKDCKGSIPNFLRLYAQYMAGEKRREEEGQGVLASTDGVTTNNQLVSIIQECTKLLARFPQDPYLLYLYGVVMSKQNNYKEAIEVLVRSLVIQPYNWSCWMEILTCMSHIDGLDSIVKRLPKQLVTTKMFIVVCHQVFCQPLDLVQNFIEELETIFPQFHYLTIQKALLNYHNLGYAEAEQIFDHVINLDPHRLDDMDAYSNILYVMEKRSKLSFLAQLASCTDKFRPETCCIIANYYSLRTDHEKAITYYRRALTLNRNCLSAWTLMGHEFVELKNSHAAIESYRRAVDTNQNDYRAWYGLGQAYEVLDMHYYSLYYYQRATALKPMDPRMWQALSNCFEKLKRYDEAIKGYKRSLAVQDNDPTVFYRIAALYEKTGDQRMASKYMEACLGTELAEGVTDETAKARIWLARYEFDQGNFSSALRYAMEYTHGSPQDLEEARAIVKTIQEREAA

SEQ ID NO: 15816 - protein, 464 aa, Pseudomonas syringae
MEFLPLFHNLRGSRVLVVGGGEIALRKSRLIADAGAVLRVVAPEIEAQLSELVVQSGGEMILRGYSECDLDGCVLIIAATDDEPLNAQVSRDARLRCVPVNVVDAPALCTVIFPAIVDRSPLVIAVSSGGDAPVLARLIRAKLETWIPSSYGQLAGLAARFRNQVKGLFPNVQQRRAFWEEVFQGAIADRQLAGQGAEAERMLIAKIAGEPPPETGEVYLVGAGPGDPDLLTFRALRLMQQADVVLYDRLVAPTILDLCRRDAERVYVGKRRAEHAVPQEQINQQLVALAKQGKRVVRLKGGDPFIFGRGGEEIEELAAHGIPFQVVPGITAASGCAAYAGIPLTHRDHAQSVRFITGHLKNGTTDLPWSDLVAPAQTLVFYMGLIGLPVICEQLIRHGRSADTPAALVEQGTTVNQRVFTGTLANLPQLVAEHDVHAPTLVIIGEVVKLREKLAWFEGAQATL

SEQ ID NO: 15817 - protein, 353 aa, Solanum conditum
DAWDTSVAIEVKVGDGIEIVRFFHCYKRGVDRVFVDHPMFLEKVWGKTGSKIYGPKTGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLRDEFRGSFDFIDGYEKPVKGRKINWMKAGILESDRVVTVSPYYAQELVSSVDKGVELDNVLRKTSITGIVNGMDTQEWNPATDKYTDAKYDITTVMDAKPLLKEALQAAVGLPVDRKTPLIGFIGRLEEQKGSDILVAAIHKFIGLDVQIVVLGTGKKKFEQEIEQLEVLYPNKAKGVAKFNVPLAHMITAGADFMLIPSR

SEQ ID NO: 15818 - protein, 238 aa, Chlamydomonas reinhardtii
MLLSRLAHSALPASLRASAASSASSQLHAVPRVASAAPRAPSHVAQYSNGSAAPVPPNFAAPNDRAATSSSDRVYTNYYVYKTRAAMCLRLLPPTFAKAQAGKVLERDGTMLLEFATANAAAPGAGNGPAGNVNRTYNWGNKVTFALSPVELGNILAGDAVASDKGLVLWHDPAKLGKTGEPIKKLSLKQLPDGNISFNLTAGPENFSVPVTKGEFEVIKSVAQFAIPRLLGFDAVFE

SEQ ID NO: 15819 - protein, 355 aa, Thermus thermophilus
MRWLLVVAGLLAAGGLAQTPPPPAAQTAEQNPLRLGVQLYALGRYDAALTLFERALKENPQDPEALYWLARTQLKLGLVNPALENGKTLVARTPRYLGGYMVLSEAYVALYRQAEDRERGKGYLEQALSVLKDAERVNPRYAPLHLQRGLVYALLGERDKAEASLKQALALEDTPEIRSALAELYLSMGRLDEALAQYAKALEQAPKDLDLRVRYASALLLKGKAEEAARVLEEGHRIKPLNAEGWYTLGQAYLALGRTKEAGVALENAVALAPLRFPAAYYYLGQVYLALGDYPKAKSRLTVAVRLEPKRAEYRYSLCLANEKLGDKEGARYQCQEALKLKPDYKEAEEVLKRL

SEQ ID NO: 15820 - protein, 45 aa, Triticum aestivum
ETATGDKKDCLCFIEVVAHKDDTSKELLEWGSRVSAANSRPPNPQ

SEQ ID NO: 15821 - protein, 417 aa, Nicotiana tabacum
AADGYARARGVGACVVTFTVGGLSVLNAIAGAYSENLPLICIVGGPNSNDYGTNRILHHTIGLQDFSQEPRCFQTVTCYRAVVNNLEDAHELIDTAVSTALKESKPVYISIGCNLPGIPHPTFSREPVPFALSPRLSNMMGLEAAVEAAAEFLNKAVKPVLVGGPKMRVAKASDAFVELSDACGYAVAVMPSAKGLFPEHHSHFIGTYWGAVSTAFCAEIVESADAYLFAGPIFNDYSSVGYSLLLKKEKAIIVQPDRVTIGNGPAFGCVLMRDFLAALAKRLKHNPTAFENYHRIYVPEGHPLKCEPKEALRVNVLFQHIQNMLSGDSVVIAETGDSWFNCQKLKLPKGCGYEFQMQYGSIGWSVGATLGYAQAAPEKRVIACIGDGSFQVTAQDISTMLRCGQRTIIFLINNGGY

SEQ ID NO: 15822 - protein, 531 aa, Mycobacterium avium
MTETVGPARAKPVMSRKAKWLYAIGRVRAATRRRRGPKVAIIGAGFGGLGAAVALRRAGIDDLVIIEAADGVGGTWRRNTYPGAACDIQSHLYSFSFAPNASWSRTYARQPEILAYLESVADAFDLRRHLMLDTTVRSLRWNPHTAAWDCRIDRGGHPATLSADVVVCAVGLFGAAKLPDIDGLAGFAGPVLHTAQWDHDLDLAGRTVAVIGTGASGVQLVPELAGTAGHVTVFQRTPPWMVPKDDRPYSATELARFKRNPLALRRTRWQIWKFQHDNTATFADDPVVTARSRIATSFLDRTVADESLRRALTPDYPFRCKRVLLGDDYYRALQRDNVELVTDPIARIGRMSVITASGAEIEADVIVLATGFETSRYLSGIEVVGAGGRRLHEHWGEEPSAYLGVAVSGFPNFFMLYGPNTNQGGNSIVYILEAGARLVASAVSRLARRGGFLEVRPEAEKRFNDRLSADLERTIWTRCDSYFRSPTGRIVTQWPYTELDYARWTWRLRRRDWIHHRCAPGAATVGAAQEF

SEQ ID NO: 15823 - protein, 372 aa, Unknown
  Iris x hollandica
MAPGASTPPFLPTSSNETTLPVTFVRRRGGEARRVAYNAFSDEIPVGIAGRGSTMPETAGGREEIRRKIVAACEPWGIFQVVDHGVDAGLVVDMARLAREFFALPPEEKLRFDMTGGKKGGFIVSSHLQGEVVQDWREIVTYFTYPIISRNFSRWPDKPKEWRSVTEKYSEKLMELACKLLGVLSEAMGLEKEALDQACVDMDQKVVVNLYPKCPQPDLTLGLKRHTDPGTITLLLQDQVGGLQATKDGGKTWFTVQPIQGSLVVNLGDHAHFLSNGRFKNADHQAVVNSNSSRLSIATFQNPAPDADVYPLAIREGEMPVLDEPIKFTEMYRRKMSRDLELASSRSSPRLHENAKVEEAVAQPKGLNGIFA

SEQ ID NO: 15824 - protein, 425 aa, Methanothermobacter thermautotrophicus
MKGLEFSEFDISGDINRALDDMGFESTTPIQALTLPVTLDGMDVVGEAQTGTGKTAAFAIPVLENLEAERVPQALIICPTRELCLQVSEEIKRIGKYMKVKVLAVYGGQSIGNQIAQLRRGVHVIVATPGRLIDHIERGTVDLGGISTVVLDEADEMLNMGFIDDIERILSHVPERRQTMLFSATVSKPILRIARKYMRNPQVMRVEKKHSPKIDEFYFKTREEDKVELLDWILSSNNIRMGLIFCNTKRRVQRLRRQLNRMGYSADEIHGDLSQSKRERVMERFRRGDFSLLVATDVAARGIHVPDVEAVVNYDLPFENEYYVHRIGRTGRAGSSGKSFTLVVGSEVHRLRRIQSFTGKRIKQSNMPSPEEIRRGYEMDLREILRRNLESKTYSDSEILESLAGEGYSFRDISHALLDVLESSK

SEQ ID NO: 15825 - protein, 370 aa, Unknown
  Iris x hollandica
MAPGASTPPFLPTSSNETTLPATFVRDEEERPKVAYNVFSDEIPVISLEGIDEAIVGGRREEIRRKIAASCEDWGIFQVVDHGVDAGLVVDMTRLAREFFALPPEEKLRFDMTGGKKGGFIVSSHLQGEVVQDWREIVTYFTYPIISRDFSRWPGKPGEWRSVTEKYSEKLMQLACKLLGVLSEAMGLETEALTKACVDMDQKVVVNFYPKCPQPDLTLGLKRHTDPGTITLLLQDQVGGLQATKDGGKTWITVQPIQGSFVVNLGDHAHFLSNGRFKNADHQAVVNSNSNRLSIATFQNPAPDADVYPLAIREGETPVLDEPIKFTEMYRRKMRRDLELAKLKKLAKVVENAKVEEAVAQPKGLNGIFA

SEQ ID NO: 15826 - protein, 750 aa, Phaseolus vulgaris
MECEVKLKGGDLHAEGVTETNAVGFDAMEDEQTLTVAEREMWLNSDQDEFLGVNEASMFYANFPPLPDFPCTSSSSSSSSAAPLPLKTTTCSTTTTATTATSSSSSSSSWAVLKSDVEEEDVEKNHCNGSMQDQFDATALSSTASMEISQQQNPDPGLGGSVGECMEDVMDTFGYMELLEANDFFDPASIFQNEESEDPLIEFGVLEEQVSLQEEQHEMVHQQENTEEDRKVPVCEVIKGEEEGGGGGGGRVVDDEMSNVFLEWSKSNKDSVSANDLRNVKLKKATIESAAKRLGGGKEAMKQLLKLILEWVQTSHLQNKRRKENGSNALQATFQDPSAQTKENAHTSGSFAPESNSCFNNQTPWLNPQTFGTDQAPVMVPSQPYSQPVAGYVGDPYTSGSAPNNITVNHNHNNNPYQPGTDQYHMLESAHSWPHSQFNVASHYSQSYGENGLFTHGGFGGYAITRYPYQFFHGPGDRLMRLGPSATKEARKKRMARQRKFLSHHRNQNGNHLQNQGSDPHARLGNDNCTTGLVAPHQPNSAAANWMYWQAMTGGPAGPLAPVVPADPLAGQTVVDRTTMHTQNSHQNRAASDRRQGWKPEKNVRFLGQKVLKQSDVGKLGRIVLPKKEAETHLPELEARDGISITMEDIGTSRVWNMRYRYWPNNKSRMYMLENTGDFVRANGLQEGDFIVIYSDVKCGKYMIRGVKVRQQGVKPETKPAGKSQKTTTGTNASYTAGTAANNGMSSHRN

SEQ ID NO: 15827 - protein, 304 aa, Leuconostoc mesenteroides
MLIKNIHQLIGQTPLIELQIPVPNQSRIFAKLEMFNPGGSIKDRLGQFLISDAWQRNLINQNSTIIEPTAGNTGIGLALAAQQYKLPTILVVPEKFSAEKQQLMKALGATIINTPSNEGIKGAISKAKSIAAEIENSYLPMQFANPANPETYYKTLAPEIVTDLKNEKIDAFVAGAGSGGTFAGIAKYLSEYDATIKNIVVEPEGSILNGGPAHAHRTEGIGVEFVPPFFESIHIDKTLTISDDNAFQQVRYAAENLGLFIGSSSGAALAASLQMAETLPPQSNIVTIFPDSSERYMSTNIYGN

SEQ ID NO: 15828 - protein, 165 aa, Unknown
  Cichorium intybus x Cichorium endivia
MSFSEEQEALVKEAWEIMKEDIPALSLYFFTQVLEIAPAAKGLFSFLKDAEEIPQDNPKLKSHAVKVFKMTCEAIQLREKGEVVVSGSTLKYLGSVHLQKGVIDAHFAVVKEGVLRTVEKGVGEKWSEEMKGAWSEAYDQLAAAIITEMKKEATEMDEEAEETQT

SEQ ID NO: 15829 - protein, 471 aa, Lactobacillus plantarum
MLSEIKWKGFLLPLIFGIGLWLVTPLRPVAISIMAWHLFAIFVATIIACITKPLPMMAVTLIGIVVATLTGVFTMDEVATGFGNSTAWMVAMCMFMAAGFIKSGLGKRIAYLFVSLFGKRTLSLAYALSFVDAVLAIGIPSNNARVNGIMYPIIDNLSREMGSDPKQGTQRKLGSFLVFNEYEVNNITSGLFLTGLAGNMVAIGLAKMQGITVTWMQWFMAACVPGILSLLIIPWVLYKVYPPEVKQTPDAHRWATTRLAALGKMTASEKIMSITFILAIVLWLIGTKIGIDATEVSFIAVVILLITGVLTTNDLLNEHFAWNILVWLSIIMMMSKKLMTLGFFPWFSKTLGHLLNGMNWISVLIILFLAYFYLHYMFPSVSTQISALYAGFLSIAIGAGVPHVLAALLLAFAGSINLSTTPYSAGPAALLSSTGYVTSAEWWRLSAIIGVIFNVIWLGGGLLWTKLLGFW

SEQ ID NO: 15830 - protein, 459 aa, Erwinia carotovora
MDYLPIFCQLHDKPCLLVGGGEIAERKARLLLDAGAVITVNALDFNDQFRAWEKDAQLTLVHSTFDPALLNEVWLVIAATDNQDVNNHVYASASERRIFCNVVDSPERASFIMPSIIDRSPLMVAVSSGGTAPVLARLLREKLESILPQNLGKLAAFAGELRSRVKIRFCKMSARRRFWEKLFVHDRLAQALASEDRERVQQLTELLFSAPLDDRGEVTLVGAGPGDAGLLTLKGLQHLQQADIVVYDRLVSKEILNLSRRDAERIFVGKASGYHSVPQDQINQLLEEKARAGHRVVRLKGGDPFIFGRGAEELEYLQQAGVPFSVVPGITAASGCSAYSGIPLTHRDHSQGVRLITGHVKHDTDLDWSSLAAEKQTLVFYMGLQQAEHIQNKLIEQQLPETVPVAIIENGTSTKQRVLSGQLSQLGELAQQASSPSLIIIGNVVGLREKLSWFSDQTA

SEQ ID NO: 15831 - protein, 465 aa, Xanthomonas campestris
MPESSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVVTILVFIVLGGAAVIGLLPLADGSPAPGLRHLRAEGWFAHGALPILMTMVAVNFAFSGTELIGVAAGETAQPARAIPLAIRTTLVRLVVLFVGTVLVLAALLPAKQAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQLLRDGAALETLAYRAPWYPWTPILGFSLCLLACIGLAFDPQQRIALWCGVPFVALCYGAYALTQWLAARRLHA

SEQ ID NO: 15832 - protein, 98 aa, Glycine max
  misc_feature (39)..(39): Xaa can be any naturally occurring amino acid
  misc_feature (53)..(53): Xaa can be any naturally occurring amino acid
  misc_feature (74)..(74): Xaa can be any naturally occurring amino acid
CLHHGLVDTDTSMVLAAYEYYRHDGVVRNVIDMYVGELXMIRFKHVLKVDQAXLDTVTPDIIGRVKIVISAYPXSFATLLRVDTFTFCANVQIDNRAY

SEQ ID NO: 15833 - protein, 474 aa, Propionibacterium acnes
MDGELKRGLSSRHMNMIAIGGAIGTGLFVASGATISQAGPGGALVAYFAMGLMVFLLMQSLGEMSSYLPVPGAFETYATRFVSPSFGFALGWNYWFNWAITVAAELAAASIVMAYWWPGVPAWMWSVGFLALLFLLNVLSARAYGESEFWFAIIKVTAVIVFLVLGILMIAGVMGTSPGLSHWRRGDAPFVHGFGGILTVFLIAGFSFQGTELIGIAAGESKDPRMTIPKATRQIFWRIMIFYIGAIAVIGLLLPYTDPHLLAGEVTDVAVSPFTLVLKRAGVAAAAAVMNAVILTSVLSAGNSGLYASTRMLYALAREGKAPRILGRTSRRGVPVPALIVTTLVGAACFATSLVGSGQAYTWLVNISGLCGFIAWIGIAICHIQFRRAFQAQGHDLSELPYRARWYPAGPIVAGVLCVIVTLGQGRDAVLSGDVTDMIVAYISIPVFLALWVGHKIVTKAPHADLSTADLHHD

SEQ ID NO: 15834 - protein, 377 aa, Arabidopsis thaliana
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFGENDSIMRLNYYPPCIKPDLTLGTGPHCDPTSLTILHQDHVNGLQVFVENQWRSIRPNPKAFVVNIGDTFMALSNDRYKSCLHRAVVNSESERKSLAFFLCPKKDRVVTPPRELLDSITSRRYPDFTWSMFLEFTQKHYRADMNTLQAFSDWLTKPI

SEQ ID NO: 15835 - protein, 608 aa, Pisum sativum
MAPSSLALNSNTWATTTNKPQFPQSFSISSSSSTSFNDKSTLKLKKPNRKMLLLQCAVHSPSVLDYPKQSYKQPLINKENDTETIIHKPKESSQWNPLQKAAAIALNMFESALLSRELQYPLPKTSDPRIQIAGNFAPVPEQPVVHSLPVTGKIPRCVNGVYVRNGANPMFEPVSGHHLFDGDGMVHAVTMNDGVASYACRFTETERLVQERELGRAMFPKAIGELHGHSGIARLMLFYARSLCGIVDHRRGSGVANAGLVYFDGKLLAMSEDDLPYELQITPYGDLKTVGRYSFLDQLHSTMIAHPKIDPISGELFALSYEVARPYLKYFRFSPDGKKSPDVEIRLSVPTMIHDFAITENYVVIPDHQVVFKLEEMIKGCSPVIFDGAKKSRFGVLPKYAKDASSIIWVDSPDTFCFHLWNAWEEPEADEIVVIGSCMTPPDSIFNESDENLKSVLSEIRLNLKTGKSTRRSIVPQMNLEAGMVNRNRLGRKTRFAYLAVAEPWPKVSGFAKVDLESGEVKKHSYGDGRFGGEPFFLPTRRSGRCEYENEEDGGYIMALVHDERRCKSELQIVNAVNLEVEATVKLPSRVPYGFHGTFVEAKDLTFQ

SEQ ID NO: 15836 - protein, 242 aa, Zea mays
  misc_feature (226)..(226): Xaa can be any naturally occurring amino acid
MSEAAVRVIGLWPSPFVIRVLIALKLKHVEYEFVEEVVGSKSELLLASNPVHKKIPVLLHHGKPLSESLIIVQYIDEVWSSGAPAAILPADPYARAVQRFWAQYVDDKMHPAIRVLKGTYDGDKEQAAGQLSAALQLLEEAFAQLGQGKRYFGGDSVGYLDIALVSHVGWVKAVEKIAGVTLLDEAKVPNLVAWADRLCAHPAVVDAIPDADKFVEFSVTYGSFSXPINAPKVSKMAPHCAL

SEQ ID NO: 15837 - protein, 543 aa, Bacteroides fragilis
MSMFCFQCQETAKGTGCILSGVCGKTPEVANMQDLLLFVVRGIAVYNQALRKDGRSSARADKFIFDALFTTITNANFDKHSIIEKIKKGLELKKDLSNQVTIEHAPDECTWYGDETEFEEKAQTVGVLRTSDEDIRSLKELVHYGIKGMAAYVEHAYNLGYENPEIFAFMQYALAELTREDITVDELITLTLATGNHGVQAMAQLDTANTSHYGNPEISEVNIGVRNNPGILVSGHDLKDIEELLQQTEGTGIDIYTHSEMLPAHYYPQLKKYKHLAGNYGNAWWKQKEEFESFNGPILFTTNCIVPPRPNATYKDRIYTTGATGLEGATYIPERKDGKQKDFSVIIEHARRCQPPVAIESGKIVGGFAHAQVIALADKVVEAVKSGAIRKFFVMAGCDGRMKSRSYYTEFAEKLPADTVILTAGCAKYRYNKLPLGDINGIPRVLDAGQCNDSYSLAIIAMKLQEVFGLKDINDLPIVYNIAWYEQKAVIVLLALLALGVKKIHLGPTLPAFLSPNVKQVLIDNFGIGGISTADEDIAKFLA

SEQ ID NO: 15838 - protein, 353 aa, Solanum cordovense
DAWDTSVAVEVKVGDTIEIVRFFHCYKRGVDRVFVDHPMFLEKVWGKTGSKIYGPKAGKDYLDNELRFSLLCQAALEAPRVLNLNCSKYFSGPYGENVLFVANDWHTALIPCYLKSMYQSRGIYLNAKVAFCIHNIVYQGRFAFSDFPLLNLPDEFRGSFDFIDGHEKPVKGRKINWMKAGILESHRVVTVSPYYAQELVSAVDKGVELDNVLRKTSITGIVNGMDTQEWNPATDKYTDVKYDITTVMDAKPLLKESLQAAVGLPVDRKIPLIGFIGRLEEQKGSDILVAAIHKFIGLDVQIVVLGTGKKKFEQEIEQLEVLYPNKAKGVAKFNVPLAHLITAGADFMLVPSR

SEQ ID NO: 15839 - protein, 1032 aa, Oryza sativa
  misc_feature (267)..(267): Xaa can be any naturally occurring amino acid
  misc_feature (335)..(335): Xaa can be any naturally occurring amino acid
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLDVVVADAKDFDYXAGDVCGVLVQYPGTEGEVLDYAEFVRDAHAHGVKVVMATDLLALTSLRPPGEIGADIAVGSAQRFGVXPMGYGGPHAAFLATSQEYKRLMPGRIIGVSVDSSGKPALRMAMQTREQHIRRDKATSNICTAQALLANMAAMYAVYHGPEGLKAIADRVHGLAGTFAQGLKKLGTVTVQELPFFDTVKVKVADANAIAQEACKNEMNLRVVDATTITVAFDETTTLEDVDKLFKVFNGGKPVNFTAESLAPEVSSSIPSSLVRKSPYLTHPIFNMYHTEHELLRYLYKLQSKDLSLCHSMIPLGSCTMKLNATVEMMPVTYPNFANMHPFAPTDQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICMIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMTKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 15840 - protein, 353 aa, Solanum crinitipes
DAWDTSVAIEVRVGDNIEIVRFFHCYKRGVDRVFVDHPMFLEKVWGKTGSKIYGPKAGKDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15841 - protein, 290 aa, Prochlorococcus marinus
MLKHRLLSKIFSTWIDEYQEDARFGLKGKIIIDEESEFQKITLIESKRYGKALLLNNCWMTAEHQEKQYHECLVHPALSSAEKIYKILIIGGGDGGTARECLKYREVQQIDLIEIDRRVVELSQKHLPEIGGNAWKDERLNLQIANGINWVAQSQDNSYDVVIIDGADPEGPSEGLFNKAFFEDCRRILKDGGIFSTQSESAEAFHAIHIDMVKIIREVFDYASPLYGNVPIYPSGWWSWTFASMKKPRYLKPIPNRVNEILQSCEIWSPRWQSGAFNSIPAFLERALNQ

SEQ ID NO: 15842 - protein, 353 aa, Solanum crinitum
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 15843 - protein, 1174 aa, Arabidopsis thaliana
MASSSSNSWRYDVFPSFRGEDVRNNFLSHLLKEFESKGIVTFRDDHIKRSHTIGHELRAAIRESKISVVLFSENYASSSWCLDELIEIMKCKEEQGLKVMPVFYKVDPSDIRKQTGKFGMSFLETCCGKTEERQHNWRRALTDAANILGDHPQNWDNEAYKITTISKDVLEKLNATPSRDFNDLVGMEAHIAKMESLLCLESQGVRIVGIWGPAGVGKTTIARALYNQYHENFNLSIFMENVRESYGEAGLDDYGLKLHLQQRFLSKLLDQKDLRVRHLGAIEERLKSQKVLIILDDVDNIEQLKALAKENQWFGNKSRIVVTTQNKQLLVSHDINHMYQVAYPSKQEALTIFCQHAFKQSSPSDDLKHLAIEFTTLAGHLPLALRVLGSFMRGKGKEEWEFSLPTLKSRLDGEVEKVLKVGYDGLHDHEKDLFLHIACIFSGQHENYLKQMIIANNDTYVSFGLQVLADKSLIQKFENGRIEMHSLLRQLGKEVVRKQSIYEPGKRQFLMNAKETCGVLSNNTGTGTVLGISLDMCEIKEELYISEKTFEEMRNLVYLKFYMSSPIDDKMKVKLQLPEEGLSYLPQLRLLHWDAYPLEFFPSSFRPECLVELNMSHSKLKKLWSGVQPLRNLRTMNLNSSRNLEILPNLMEATKLNRLDLGWCESLVELPSSIKNLQHLILLEMSCCKKLEIIPTNINLPSLEVLHFRYCTRLQTFPEISTNIRLLNLIGTAITEVPPSVKYWSKIDEICMERAKVKRLVHVPYVLEKLCLRENKELETIPRYLKYLPRLQMIDISYCINIISLPKLPGSVSALTAVNCESLQILHGHFRNKSIHLNFINCLKLGQRAQEKIHRSVYIHQSSYIADVLPGEHVPAYFSYRSTGSSIMIHSNKVDLSKFNRFKVCLVLGAGKRFEGCDIKFYKQFFCKPREYYVPKHLDSPLLKSDHLCMCEFELMPPHPPTEWELLHPNEFLEVSFESRGGLYKCEVKECGLQFLEPHETSEFRYLSPHLYLGGSWIGNSSSSIEEIIHVDQEESSSDSEEIIYADQEESSSEFPNSDCQINYVASNSVVNIRPMIRCQRASGGRGGANRSKPAKPQVKEGSNKTVIEGLVTESLPNGMFRVDLENGDNILGYICGKIRKNFIRILPGDKVKVEMSVYDSTKGRIIFRMSSRD

SEQ ID NO: 15844 - protein, 309 aa, Prunus persica
MESKGGKKKSSSSKSLFYEAPLGYSIEDVRPHGGIKKFRSAAYSNCVRKPSMAVPVSAIGFEGYEKRLEVSFFEPGLFADPAGMGLRSLSKDQLDEILKPAECTIVSSLSNDDLDSYVLSESSLFVYPYKVIIKTCGTTKLLRSIPAILKLAETLSLAVKSVRYSRGSFIFPGAQPSPHRSFSEEVAVLDGHFGKLGLVSRAYVMGSSDKTQKWHIYSASAELASLLWGARQSGPTYTLEMCMTGLNRKKASVFYKSKASSAAGMTEESGIRKILPQSEICDFEFDPCGYSMNSIEGNAISTIHVTPEE

SEQ ID NO: 15845 - protein, 410 aa, Yarrowia lipolytica
MSEANDTDTVTAGEFLERQAQLERDAKEAMPYDPSECTFYTQPARQLLFTCLTCSKKSGAPSVICYGCSIQCHSSHDLVELFTKRNMTCDCGTDRMKSFGGCNLRKNFANLDEACDTNKYNHNFDGRFCFCDKPYNEETDIMYQCLMPGCGEDWYHDVCIGVPSKRTHPEGVNVFDSLTEIEHHEEVLPDDHEFVCYKCVEEVPRLKAIWDLPGVVKMRLEPRLEPKATSGAKVSDTADLETKSSETCVVKTESASTAVAGSESTSDETDNVKKEKRNADEANALASHPSSKKLFSSDKPCNMFLSSNFRKIVCECKDPKIFGLTLTYPFLAEEEQVYEPPPDDDAGSSLLDAGTSALHNIPRQQAIDGMAAYNQIKDKLSAFFKPFAEGGKVVTDRDVTGFFEEMKKKS

SEQ ID NO: 15846 - protein, 461 aa, Unknown
  Magnetococcus sp. MC-1
MPFIPHTEDDVRLMLDTIGVESIDALFDEIPAELNTHPILESVPKPQSEAATLRLQSARAREGDGRLNFIGAGAYEHHIPAAVWELVTRGEFYSAYTPYQAEASQGILQTIYEFQSMMAGLMGMDLSNASLYDGATALAEAVLMAVRANPAPRGSTPRVIMPATVHPAYREVVQTMVRHQGIELVEPSFCAKRGGVAVSALNLYADEPVQALVIAQPNFFGQLEDVDFLTNWAHKRGALVIGVVNPVAMALLKPPAAWGEKGADIACGEGQPLGVPLSFGGPYLGFLSCRQALARQMPGRIVGRTLDQEGKEGFVLTLQAREQHIRRAKATSNICTNQGLLSIAATIHMAMLGPEGLKNVALTCHRRTQQLWQRLALLEGVERCFEGPFFHEVAIKLSKPAEEVLTCLSGVNIAGGYAVGRRYPGMENVLLVCCTETKERSDLDHYADALGLIMSEQGSAA

SEQ ID NO: 15847 - protein, 211 aa, Unknown
  Marinobacter sp. ELB17
MTVPRSRFPDPEQDLPADQDSGQIVLAGGCFWCVEAVIIAMNGVHSVESGYAGGSADSANYKAVCTGTTGHAEVIKIEYDPTQVSLGSLLKVFFSVAHDPTQRNRQGNDIGTQYRSAIFYQSAQQRQVAQAYIEQLNQAGVFHSAVVTELEPLEAFYVAEADHQNFAARNPGQPYIMAVAAPKVQKLVDQYSDRLKPGVTSRSTDDHSNKA

SEQ ID NO: 15848 - protein, 491 aa, Unknown
  Magnetococcus sp. MC-1
MSVIFESSTPGRINPQHATPLEADEQQAALADLPEALLRQSPTGLPEVSELEVVRHYTKLSQKNYSIDTHFYPLGSCTMKYNPRAANKVAMLPGFLGRHPLDDPHYATGLLHTLFELQEMLREITGMAAISLAPMAGAQGEFAGVAMIRAYHDARGDSARREILVPDASHGTNPATATMCGYVTREVPTNAQGDVDIEALKSMVGPQTAGLMLTNPSTLGVFERSVGLIARIIHDAGGLLYYDGANLNAIAGRVRPGEMGFDAIHINVHKTFATPHGGGGPGAGPVGVSARLQPFLPIPRIVKQGASYALLESADCPQSIGRMGAFGGNIGVLLRAHAYLCMIGRQGVRRVGEYATLNANYLLARLTAAGFKPAYAERRATHEFIITLKAEADAYGLTALNMAKRLLDYGFYAPTIYFPLLVPECLLIEPTETESPEQLDAFVAAMVAIRKEAQESPEFVKNAPYTTPVRRLDETRAARKPDLIWRGPLEQ

SEQ ID NO: 15849 - protein, 866 aa, Klebsiella oxytoca
MTETRTTCPYCGVGCGVIASRAPHGQVSVRGDEQHPANFGRLCVKGAALGETVGLEGRMLFPEVDGERATWPQALAAAGSRLREIIDRHGPQAVAFYASGQLLTEDYYAANKLMKGFIGAANIDTNSRLCMSSAVTGYKRALGADVVPCSYEDVENSDLVVLVGSNAAWAHPVLYQRLAQAKRDNPQMRVVVIDPRRTATCDIADRHLALAPGSDGGLFVGLLNAIAASGAISDDFNDAQRALTIAQDWDLDKVAQFCGLPRQQIADFYREFIAAPRAITLYTMGINQSASGSDKCNAIINVHLACGKYGRPGCGPFSLTGQPNAMGGREVGGLATMLAAHMNFEPDDLRRLARFWGSERLAQTPGLTGVELFAAIGRGEVKAVWIMGTNPVVSLPDSHAVSEALARCPLVIISDVVADTDTGRFAHIRFPALAWGEKSGTVTNSERRISRQRAFMPPPGEARADWWIVARVAEALGFGSAFAWQHPHEVFSEHAALSGYENDGQRAFDIGGLADLSREAWDALEPVRWPVSRSEAAWSVHKGWHRDGKLRMVPVAPQPTRATTDAFYPLILNSGRIRDQWHTMTRTGAVPRLMQHINEPVVEVAPADAQRYHLLEGELARVRSPKGVMVAKVTIGDGQRPGSLFVPMHWNNQFARQGRVNNLLAAVTDPHSGQPESKQTAVAIATWLPAWKGELFSRQPVPLPASLHWRRRAAQGIIHLSLAGDTRSRDWLVEWCQRQGWQMQVAEGGKVWNLLAWRAGELMLGWWSDASEPAIDADWIHAAFRVPPQNAARRHALLSGRKGGVEMPRGRIICSCFSVGERAIGEAIAGGCRTPGALGGKLKCGTNCGSCIPELKALLAAKLAQA

SEQ ID NO: 15850 - protein, 440 aa, Unknown
  Nostoc sp. PCC 7119
MSNQGAFDGAANVESGSRVFVYEVVGMRQNEETDQTNYPIRKSGSVFIRVPYNRMNQEMQRITRLGGKIVTIQTVSALQQLNGRTTIATVTDASSEIAKSEGNGKATPVKTDSGAKAFAKPPAEEQLKKKDNKGNTMTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNQKTHTYICGLRGMEEGIDAALSAAAAKEGVTWSDYQKDLKKAGRWHVETY

SEQ ID NO: 15851 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGVRCTVVCMPVPIEEASAFGVMAVDENDKTIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPKLDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 15852 - protein, 396 aa, Leuconostoc mesenteroides
MSETNNELLAALESADQIKVGDVVTGEVLAVDNDNQAVIGLHTGEEGVVPAREYSDDRNINLADELKVGDSVEAVVISNVTSDKEGVSYLLSKKRLEARKAWENLSFGEGDTVDAKVINAVRGGLVVDVNGVRGFVPASMVADRFVSDLNQFKNKDIKAQVIEIDAAKARLILSRKAVAAQERAAQLAEAFEKLSVGEVVEGKVARLTDFGAFVDLGGVDGLVHVSEISHDRVKNPADVLTKGETVNVKILALDAEKGRISLSIKATQPGPWDKVAEEAPAGTVLEGTVKRVKDFGAFVEIFPGIEGLVHVSQISHKRIENPSEVLKSGDKVQVQVLDVKPAEERISLSMKALEEKPEREDRGNSKDSSASRADIAAYKQQDDSAATLGDLFDGKF

SEQ ID NO: 15853 - protein, 636 aa, Neisseria polysaccharea
MLTPTQQVGLILQHLKTRILDIYTPEQRAGIEKSEDWRQFSRRMDTHFPKLMNELDSVYGNNEALLPMLEMLLAQAWQSYSQRSASLKNIDIERENNPDWILSNKQVGGVCYVDLFAGDLKGLKDKIPYFQELGLTYLHLMPLFKCPEGKSDGGYAVSSYRDVNPALGTIDDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSEAIVHPDQVVQYIGQDECQIGYNPLQMALLWNTLATREVNLLHQALTYRHNLPEHTSWVNYVRSHDDIGWTFADEDAAYLGISGYDHRQFLNRFFVNRFDGSFARGVPFQYNPNTGDCRVSGTSAALAGLAQNDPHAVSRIKLLYSIALSTGGLPLIYLGDEVGTPNDDGWAQDGNKSDDSRWAHRPRYNEALYAQRNDPSTAAGQIYQGLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 15854 - protein, 319 aa, Solibacter usitatus
MRVYDDNSLSIGRTPLVRLNRVIDGGKAIVLAKIEGRNPAYSVKCRIGAAMVWDAEKRGVLHAGKELVEPTSGNTGIALAFVAAARGYPIHLTMPETMSVERRKVLKALGANLILTPGSDGMAGSIAKAEEMVAGDPRRYILLQQFKNPANPEIHFRTTGPEIWEDTEGTIDVLVSGIGTGGTISGVSRYIKKDRGRKILSVGVEPFSSQVLTQHMAGKPLKPGPHKIQGIGAGFIPDTLDLTMVDRVELISNEESIEMARRLAKEEGILSGISCGAAAAVAVRLGKLPEFAGKVIVTVLPDAAERYLSTTLFEGMFDE

SEQ ID NO: 15855 - protein, 186 aa, Amaranthus hypochondriacus
DTAGLSADPETFAKNRELEVIHCRWAMLGALGCVFPELLARNGVKFGEAVWFKAGSQIFSEGGLDYLGNPSLIHAQSILAIWACQVILMGAVEGYRIAGGPLGEVVDPLYPGGSFDPLGLADDPDAFAELKVKEIKNGMLAMFSMFGFFVQAIVTGKGPLENLADHLADPVNNNAWAYATNFVPGK

SEQ ID NO: 15856 - protein, 124 aa, Prochlorococcus marinus
MKKTFTVTIKNKETGKVYQEQVNSDEYILKEFEKKGFKLAFSCRNGCCTSCAVKIKSGTLHQPEAMGVSQALKDKGYALLCVAKATSDLEVETTYEDEVYDLQFGQYFGRGNTRVAPPWEFEED

SEQ ID NO: 15857 - protein, 204 aa, Nostoc punctiforme
MVLQEKGIDFDLIEIDLQNKPEGFTKVSPYGKVPALTHDDNRVWESAVINEYLDEVFPNPPLLPNSSIARAQARIWIDFANTRFVPAFSTLLRSSDPQKQEEAKQELYKHLEFIENEGLAKLSGEGPYWFGESISLVDFTYFPWFERWAALKQYRGFGIPEEFTRVRQWKHALKERESVKVIAHSKEFYIERYAKFAAPTLAAV

SEQ ID NO: 15858 - protein, 793 aa, Solanum tuberosum
MELLHCPSISTYKPKLSFHNHLFSRRSSNGVDFESIWRKSRSSVVNAAVDSGRGGVVKTAATAVVVEKPTTERCRFEVLSGKPLPFGATATDGGVNFAVFSRNATAATLCLITLSDLPEKRVTEQIFLDPLANKTGDVWHVFLKGDFENMLYGYKFDGKFCPEEGHYFDSSQIVLDPYAKAIVSRGEYGVLGPEDDCWPPMAGMVPSASDQFDWEGDLPLKFPQRDLVIYEMHVRGFTNHESSETKYPGTYLGVVEKLDHLKELGVNCIELMPCHEFNELEYYSYNSVLGDYKFNFWGYSTVNFFSPMGRYSSAGLSNCGLGAINEFKYLVKEAHKRGIEVIMDVVFNHTAEGNENGPILSFRGIDNSVFYTLAPKGEFYNYSGCGNTFNCNNPIVRQFIVDCLRYWVTEMHVDGFRFDLASILTRSSSSWNAVNVYGNSIDGDVITTGTPLTSPPLIDMISNDPILRGVKLIAEAWDCGGLYQVGMFPHWGIWSEWNGKYRDMVRQFIKGTDGFSGAFAECLCGSPNLYQKGGRKPWNSINFVCAHDGFTLADLVTYNNKHNLANGEDNKDGENHNNSWNCGEEGEFASIFVKKLRKRQMRNFFLCLMVSQGVPMIYMGDEYGHTKGGNNNTYCHDNYINYFRWDKKDESSSDFLRFCGLMTKFRHECESLGLDGFPTAERLQWHGHTPRTPDWSETSRFVAFTLVDKVKGELYIAFNASHLPVTITLPDRPGYRWQPFVDTGKPAPFDFLTDDVPERETAAKQYSHFLDANQYPMLSYSSIILLLSSADDA

SEQ ID NO: 15859 - protein, 436 aa, Dioscorea quinquelobata
QKIDRMYNGEKINCTENRSVLHIALRAARDKVIESDGKNVVPDVWHVLDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLKGAASIDDHFHSTPFEKNIPVLLGLLSVWNVSFLGYPARAILPYSQALEKFAPHIQQVSMESNGKGVSIDGIPLPFETGEIDFGEPGTNGQHSFYQLIHQGRVIPCDFIGVMRSQQPIYLKGEVVSNHDELMSNFFAQPDALAYGKVADQLLNEKVPDHLIPHKTFPGNRPSLSLLLPSLNAYNVGQLLAIYEHRIAVEGFVWGINSFDHWG

SEQ ID NO: 15860 - protein, 878 aa, Solanum tuberosum
MATSPIQLAVHSRLLSYGSTESTKLVPSSSGNRGKIVCSLRKLELEDMNFSGIGRNNDQEAPRRAHRRKALSASRISLVPSAKRVPTYLFRTDIGGQVKVLVERTNGKYKVLVEVLPLELSYAHSELVMVWGLFRSDASCFMPLDLNRRGADGKSSTVETPFVQGPSGKVTVELDFEASLAPFYISFYMKSQLVSDMENSEIRSHRNTNFVVPVGLSSGHPAPLGISFQPDGSVNFALFSRSARSVVLCLYDDISVEKPSLEIDLDPYINRSGDIWHAALDCSLPFKTYGYRCKATTSGKGELVLLDPYAKVIRRVIPRQGGSEIRPKYLGELCLEPGYDWSGDVPPSLPMEKLIIYRLNVTQFTKDKSSKLPDDLAGTFSGISEKWHHFKDLGVNAMLLEPIFPFDEQKGPYFPWHFFSPGNMYGPSGDPLSAIKSMKDMVKKLHANGIEVFLEVVFTHTAEDAPLMNVDNFSYCIKGGQYLNIQNALNCNYPIVQQMILDCLRHWVIEFHIDGFVFVNASSLLRGFNGEILSRPPLVEAIAFDPILSKVKMIADNWNPLTNDSKENLFPHWRRWAEINMRFCDDIRDFLRGEGLLSNLATRLCGSGDIFAGGRGPAFSFNYIARNSGLTLVDLVSFSSNEVASELSWNCGQEGATTNNIVLERRLKQVRNFLFILFISLGVPVLNMGDECGQSSGGPPAYDARKSLGWNTLKTGFGTQIAQFISFLSNLRMRRSDLLQKRTFLKEENIQWHGSDQSPPKWDGPSSKFLAMTLKADAEVSQTLVSDIVGDLFVAFNGAGDSEIVILPPPPTDMVWHRLVDTALPFPGFFDEKGTPVEDELVAYEMKSHSCLLFEAQRLAEIDSSKRKKQIRLSSKRQ

SEQ ID NO: 15861 - protein, 410 aa, Methanothermobacter thermautotrophicus
MVFNMKADAVKIADGVYWVGVMDWDIRSYHGYTLGGTTYNTYLIFGDERVALVDNTYPGTSSQMFGRITDAFEREGRDEKIDLIIQNHIERDHSGSITEVLKRYGSEIICTAKAAEGLRQHYSIPQDTPMQTVKTGDSTDLGGKTLTFLEAPMLHWPDSMFTLLEEEGILFSNDAFGQHLCISKRFDKDVPEAVLMDAAMKFYANLLTPLSPLVLRKFSEVKELGLLEKIGMIAPSHGQIWTEPLKIIAAYTDWATGKCRDKATIIYDTMHYSTRMLAHAMAEGLMAADVDVSMHFLHEDERSEIVKNILESKAVFIGSPTMFNGPFPSLGDLIYYLKGLTFDRTGFKRLAVVFGSKGWGGGAVRTLQEELSGAGFEVAETFEVNYVPTSGDLDECYSIGKSVGERIKKM

SEQ ID NO: 15862 - protein, 766 aa, Solanum tuberosum
MIRGPPQIVQKCPTDIVTVNRTNIVPRTHRHALQDLRQLRRRDSLRLFSSDHRILKFCTSEEAFQPRLVAAAKLQEEAPQMLDTFPSFKVSPGLAHPLGVSETESGINFAIFSQHASAVTLCIILPKSVHDGMIELALDPQKNRTGDIWHICIKELPQGGVLYGYRIDGPRNWHEGHRFDDSIILVDPYAKLIEGRRVFGDESNKMCRFFGTYDFNSLPFDWGENYKLPNIPEKDLVIYEMNVRAFTADETSSLDQDQRGSYLGLIEKIPHLLELGVNAVELLPVFEFDELELQRRPNPRDHMINTWGYSTINFFAPMSRYASCGGGPVRASWEFKEMVKALHGAGIEVILDVVYNHTNEADDENPYTTSFRGIDNKVYYMVDLNNNAQLLNFAGCGNTFNCNHPTVMELILESLRHWVTEYHVDGFRFDLASVLCRGTDGTPINAPPLVKAISKDSVLSRCKIIAEPWDCGGLYLVGKFPNWDRWAEWNGKYRDDIRRFIKGDAGMKGNFATRIAGSADLYRVNKRKPYHSVNFVIAHDGFTLYDLVSYNNKHNDANGEGGNDGCNDNFSWNCGIEGETSDANINALRSRQMKNFHLALMVSQGTPMMLMGDEYGHTRYGNNNSYGHDTAINNFQWGQLEARKNDHFRFFSKMIKFRLSHNVLRKENFIEKNDITWLEDNWYNEESRFLAFMLHDGNGGDIYLAFNAHHFSIKTAIPSPPRNRSWYRVVDTNLKSPDDFVTEGVSGISKTYDVAPYSAILLEAKQ

SEQ ID NO: 15863 - protein, 730 aa, Pisum sativum
MECVLDLHAKMVNEREEDGFGSLGEDEKLVAVSEREIWLDDATNHQDDDDLLASCSSSSSASSSSCSTPLKTIACTTSTTTTTATSSSSSASSSSAASWAVLKSEVEEDHHHGEKMKSCDNNHGFLNMHDPLDHHHHHHHGQHATTASIEIPQQQQELGVGDCMEDVMMDDTFGYMELLEANDFFDPASIFQTEGETPLVDDFTQEQEQVLVQHQQVPIVVHDDSETKLDLNFDGVGVNDGACDGVNDEMSNVFLEWLKSNKDSVSANDLRNVKLKKSTIESAARRLGGGKEGMKQLLKLILEWVQTSHLQNKRLKENNNNTTTSNVVPQQPLPQFKDLCPNQNTTNTCFNQTSWMDQTQTPLVVPPQQFSQAMVGVGYVGDIHYTNGSVSNSLYQQGSTNEYHQFNVVPNYNQPSFVDSNNNVVQPHGLSFGGYGNQYGSYQFFHGGGGDRLMRLGPSATKEARKKRMARQRRFVSHHRNHHQGSDSVARLGGGGGGGDNCTNGVGVGSHANQANWMYWQSMAGGKEASLAPVVRDEQTQPPVERDRTNNQTPNSHQGRNASDKKQGWKPEKNLKFLLQKVLKQSDVGSLGRIVLPKKEAETHLPELEARDGISITMEDIGTSRVWNMRYRYWPNNKSRMYLLENTGDFVKANGLQEGDFIVMYSDVKCGKFMIRGVKVRQQGAKPEAKKTGKAQKNQQQQQHGNNNSNTAGNDAVDNNDTPSSPKRKK

SEQ ID NO: 15864 - protein, 229 aa, Bacillus cereus
  misc_feature (22)..(22): Xaa can be any naturally occurring amino acid
  misc_feature (115)..(115): Xaa can be any naturally occurring amino acid
MNFFESNIFTLIYTCLVIGLIXLFFISFTLFIRRVLQSSAAKKHHAINMNQKLDRIIELLEKDRNSDKRSMKRGKRMANYIKELREKVGHDYVFLNFAGGCVFNKEGEVLLQKRXDFNAWGFPGGAMEIGESAAETAIREIKEETGYDVEINELIGVYTKYFQSYPNGDKAQSIVIVFSCSIVGGEKRTDGDETLDLQFFPLDKMPPLFCKQHEDCLQDVLEKRVGVYR

SEQ ID NO: 15865 - protein, 418 aa, Chlorobium tepidum
MAGLTKENPFDIARRQLDAAAGIIGLDAEVLELLRWPMREMHVTIPVKMDDGAVRAFHGFRVQYNDARGPNKGGIRFHPDETIDTVRALAAWMTWKTAVMDIPLGGAKGGVICNPKTMSPGELERLSRSYIRQVGRLLDLEKDVPAPDVYTTPQIMAWMADEYSFMQGHNDFGVITGKPLALGGSLGRGDATARGGIICIREAAKMLGINLRGKPAAINGFGNAGAFAHKLAVELLGMKVVAVSDSKGSIYNPDGFDHQALMEYKKQHGSVADFPGSTPLTDAGLLELDVTVLIPAALEDEISCRNARNIQAKIVAELANGPTTPEADKILHERGVYLIPDLLCNAGGVTVSYFEMVQNASGWYWEEEVVHRQLEKKMAAAIKAVHQAAVQYSVDNRTAAMIVAIRRVAEAMKLRGWV

SEQ ID NO: 15866 - protein, 234 aa, Zea mays
MEFCARQQPQHHRHQQLFNLPLPPPSKRRPAPSTARAAACWQHNPAAGRLLCGPSRRRPRLAALQATVPTTTNAARRPSEVVCPKNIVRDTKLPRAGKFFELEMTVRDCDLDVYGVVNNAVYAGYIEIARQEMLASLGVCTASIVRTDRAMALSELNVKYFAPLKQRGAKFVVMVRVVQIKGVRMLMEHLIATLPDRKLVLEATATVVCLNQEYRPTRMFPEMAKLLPFFSHPN

SEQ ID NO: 15867 - protein, 326 aa, Thermoplasma volcanium
MNLYRGMEFNLRSVSTEAKERDFDVIIIGAGAAGFSAAVYASRSGLSAVILDKNVAGGLTAEAPLVENYLGFKSIVGSDLAKNFAEHASEYASIREGVEVKSVKKGDGGFIVDTSDGEYHSKYIIITTGTTHKHLGVKGEAEYFGKGVSYCSTCDGYLFKNKNVVTIGGGNSGAIAAISMSEYVKNATIVEYMPRYMCENAYIEEIKKRKIPYIMNAQVTEIVGDGKKVTGVKYKDRSSGEEKTLPADGVFVYVGLIPQTSFLKDSGVKLDERGYIIVDGRQRTNVPGIYAAGDVTSGSFAQIASAVGDGCKAALSLYSDTISSKK

SEQ ID NO: 15868 - protein, 436 aa, Schizosaccharomyces pombe
TESLREAVKEFDELRQKGLQKNGEVLAMAPAFISTLPTGAETGDFLALDFGGTNLRVCWIQLLGDGKYEMKHSKSVLPRECVRNESVKPIIDFMSDHVELFIKEHFPSKFGCPEEEYLPMGFTFSYPANQVSITESYLLRWTKGLNIPEAINKDFAQFLTEGFKARNLPIRIEAVINDTVGTLVTRAYTSKESDTFMGIIFGTGTNGAYVEQMNQIPKLAGKCTGDHMLINMEWGATDFSCLHSTRYDLLLDHDTPNAGRQIFEKRVGGMYLGELSRRVLFHLIKVYNFNEGIFPPSITDAWSLETSVLSRMMVERSAENVRNVLSTFKFRFRSDEEALYLWDAAHAIGRRAARMSAVPIASLYLSTGRAGKKSDVGVDGSLVEHYPHFVDMLREALRELIGDNEKLISIGIAKDGSGIGAALCALQAVKEKKGLA

SEQ ID NO: 15869 - protein, 904 aa, Unknown
  Erythrobacter sp. NAP1
MATRMLIDARHSEETRVAVLKGNRIEEFDFESAEHKQIKGNIYLAKVTRVEPSLQAAFVDFGGNRHGFLAFNEIHPDYYQIPQSDREALLAEEAEAAEEEARLRDEEEEEGITPGEEYDAEDESAEALAEDLAEDGLEEIDTSDKDKVSTIEDGASDDDDDDDQDEDDSEDEGEESSEDGEDGDDGEKKPRRGRRGRGRRRQGGKKGQQKGRSRAKEVDEVRAKRMALRRRYKIQDVIQRRQVLLVQVVKEERGNKGAALTTYLSLAGRYTVLMPNSSHGGGISRKINSASDRKRLKQVVSDLSLPKSMGLIVRTAGLSRTKTEIKRDFDYLARLWDDIRQTTLASTAPSLIHSDSDLIKRAIRDIYNREIEEVVVEGEEGYKSAKAFMKMLMPSHARRVKAYSDPVPLFQRYGAEDQLRAMYDPMVQLKSGGYLIINPTEALVSIDINSGRSTKEHGIEQTALHTNLEAAREIARQLRLRDMAGLVVIDFIDMEYNSNVRKVEKAMKEALKNDRARIQVGRISGFGLMEMSRQRLRTGVLEATTRECPHCDGTGLVRTASSAGLSALRLIEDEAAKGKGSKICLEASTEAAVYLLNEKRHELVEIEQRYGVIVEVMPEGEDEGAKMKVSSQGPRPTEAPKFEPIVDDDEDEDDIPEDDGSEEDDDAPKKKKRRRRRGGRGRGKKRQDTGSSEDGEDNSDDSDDSDASDGDEASEETSDDGEEKPKRRRRRGGRGRRKKTDETVTSEDAENLEEVSEQVKEDMTVVAGPDDAPETAGAMAAETDAKADGETEEAPKEEKPKRKRAPRKKKVEEAPAEEAAPAEEAKVEEAPTEEEPKKKPARKRAPRKKKVEEAPAEEAPTEEAKTEDAAPAETAEEPASDDKADEQADGGKKRGGWWQRTFGE

SEQ ID NO: 15870 - protein, 446 aa, Tropheryma whipplei
MCDREIVNSSWSSEMPSVLIAHLSQYQSSQAVQVRGWVEAVRDQKNIQFVIIRDESGAPLQLLYVRSGKSDCIAEKISSLSIGSFVRASGVLKHNERVKLRGLEVEINNLDVVSTALPSPIAHDSSIDKRLDWRFLDLRNERNNLIFRIQTYFLHALRTWWVRNGFIEINTPKLMASSSESRAELFSLKYFDRIGYLAQSPQFFKQMSQAAGFGKVFEIAPVYRADPSFTSRHATEYTSIDSELSWIESHEDVMNMQEELLTYSICDVLERHSEEIRGVFGLNLCPPKRPFVRVTLEQALNISARSGHISQRHDLDPEAERRVGKWALDNHASDFVFVTNYPVSVRPFYHMRENENITKSYDLLFRGIEIATGAQREHRYDVLVDQAREKGLDLSELGYYLDFFRYGMPPHGGFGAGLARIIMALLRLGSIKESTFLFRGPNRLLP

SEQ ID NO: 15871 - protein, 130 aa, Triticum aestivum
MASSVAAAASTFLGTRLADPAPQNGRIVARFGFGLGGKAKPAPKKVAKTSTFSDRPLWFPGAVAPDYLDGSLVGDYGFDPFGLGKPVEYLQFELDSLDQNLAKNEAGGIIGTRFESSEVKSTPLQPYSEV

SEQ ID NO: 15872 - protein, 568 aa, Sinorhizobium meliloti
MSATNPTRDDFAALLEESFAKTDLAEGYVAKGIVTAIEKDVAIVDVGLKVEGRVPLKEFGAKAKDGTLKVGDEVEVYVERIENALGEAVLSREKARREESWQRLEVKFEAGERVEGIIFNQVKGGFTVDLDGAVAFLPRSQVDIRPIRDVTPLMHNPQPFEILKMDKRRGNIVVSRRTVLEESRAEQRSEIVQNLEEGQVVEGVVKNITDYGAFVDLGGIDGLLHVTDMAWRRVNHPSEILNIGQQVKVQIIRINQETHRISLGMKQLESDPWDGIGAKYPVGKKISGTVTNITDYGAFVELEPGIEGLIHISEMSWTKKNVHPGKILSTSQEVDVVVLEVDPTKRRISLGLKQTLENPWQAFAHSHPAGTEVEGEVKNKTEFGLFIGLDGDVDGMVHLSDLDWNRPGEQVIEEFNKGDVVRAVVLDVDVDKERISLGIKQLGRDAVGEAAASGELRKNAVVSAEVIGVNDGGIEVRLVNHEDVTAFIRRADLSRDRDEQRPERFSVGQTVDARVTNFSKKDRKIQLSIKALEIAEEKEAVAQFGSSDSGASLGDILGAALKNRQNNE

SEQ ID NO: 15873 - protein, 447 aa, Unknown
  Candidatus Kuenenia stuttgartiensis
MDYISNTESDKKKMLEDMGISSLDALLGEIPEALRNFSLSLPPGLSEPEVLHAIKKLSKKNKTTDDYSSFLGAGAYDHFIPSVVNHLASRSEFYTCYTPYQPEVSQGTLQVMYEFQTLMCELTAMDVANASMYDGSTALAEAALLSIRHKEKNKIVCSSAIHPEYRQVMKTYLKGFNTEIVEINCPEGTTDMHQLEASLADNTAAVLVQSPNFFGCVEDMQEISAIAHKHDALFVACVNPISLGILMPPGEYNADIAVGEGQVLGNYLNYGGPYLGFFTVKNELLRKMPGRIAGETVDKAGRRCIVLTLQPREQHIRREKATSNICTNQALLALRACIYLCALGKKGIAEIGNLNIQKSHYAFERLCNLDIFEPVFHNPFFNEFVLKAKNDFRIASIIRRMQEKGIHCGIDISQYYPGMVNCMLLCVTETKTKESIDHLVNEFTKCT

SEQ ID NO: 15874 - protein, 121 aa, Arabidopsis thaliana
  misc_feature (24)..(24): Xaa can be any naturally occurring amino acid
  misc_feature (60)..(60): Xaa can be any naturally occurring amino acid
  misc_feature (92)..(92): Xaa can be any naturally occurring amino acid
TRPPTVQLANIEQAVIPAGGAWLXSQRFSVRNVRRPGHLFLDEIGVAYDEQHTYVVVKHXSLFTSSIMIRLLARPSVKLFSAVCAEDLIVNXRNILGGVVINWAHVAQMYDTQSCQQSNVT

SEQ ID NO: 15875 - protein, 537 aa, Capsicum annuum
MGNACRGSFRAKTFQGSYPQNHSTSKHSKVEEEQQPDPAPLVVKDHSTSTKNMNHRSSANQSCCVLGHKTPNIRDLYALGRKLGQGQFGTTYLCTELSTCIDYACKSIAKRKLISKEDVEDVRREIQIMHHLAGHKNIVSIKGAYEDPLYVHIVMELCGGGELFDRIIQRGHYTERKAADLTKIIVGVVEACHFMHRDLKPENFLLVNKDDDFSLKAIDFGLSVFFKPGQIFTDVVGSPYYVAPEVLLKNYGPEADVWTAGVILYILLSGVPPFWAETQQGIFDAVLKGHIDFDSDPWPLISESAKDLIRKMLCMRPSERLTAHEVLCHPWICENGVAPDRALDPAVLSRLKHFSAMNKLKKMALRVIAESLSEEEIAGLKEMFKAMDTDNSGAITFDELKAGLRKYGSTLKDIEIRELMDAADVDNSGTIDYGEFIAATIHLNKLDREEHLMAAFQYFDKDGSGYITVDELQQACADHNITDVLFEDIIREVDQDTDGRIDYGEFVAMMQKGNPCIGRRTMRNSLNFSMRDAPGAH

SEQ ID NO: 15876 - protein, 53 aa, Glycine max
MGRRPARCYRQIKNKPYPKSRFCRGVPDPKIRIYDVGMKKKGVDEFPFCVHPG

SEQ ID NO: 15877 - protein, 273 aa, Glycine max
  misc_feature (17)..(17): Xaa can be any naturally occurring amino acid
  misc_feature (25)..(25): Xaa can be any naturally occurring amino acid
RPSVRSVVDLSESMRRXRVCDPSHXSPATTSLLSILQTLTLIADQTPPVPQSARYGNVAYRTWHEKMSNSAESLILTLLPENLHPATVELVPYFTDSFGNSSRIDYGTGHETNFAAWLYCLARLGVIGVEDYPAVVARVFVKYLDLMRKLQLQYCLEPAGSHGVWGLDDYHFLPFIFGSSQLIDHKYMKPKSIHNEDILENFSNEYLYLACIAFVKKVKKGVFAEHSPMLDDISGVPNWNKVNTGLLKMYKAEVLEKVPIMQHFLFGSIIKWE

SEQ ID NO: 15878 - protein, 436 aa, Haemophilus somnus
MSNSITKNLSKHKLVKDTLVLILAGGRGSRLHELTDKRAKPALYFGGNRRIIDFALSNCINSGLNRIGVVTQYAAHSLLRHLQKGWSFLPQERGEFIDMLPARQQIDDSTWYRGTADAVYQNMAIIRDHYRPKYILILAGDHIYKQDYSQMLLDHVSSNAKCTVGCIEVPREQASEFGVMAVDENLKVKAFVEKPKDPPAIPNKPDTSLASMGIYVFDADYLYDVLMREVNTPYTSHDFGKDILPKSLEEEVLYAHPFSRSCMGRNTDGEIYWRDVGTLDSFWQSNIDLVSEHPQLDIYDQRWPIRGNPTQTYPSKFFYNKQDIKPVDNSLISGGCVITDAEISYSVLFDQVKVKADSKVEYSVVLPQVTIGKNCILRNCIIDRQVVIPDNTVIGVNIEEDRKRFRVSSTGKVILVTESMMKKLNGEKVVSEIHLD

SEQ ID NO: 15879 - protein, 201 aa, Prochlorococcus marinus
MSSLRQSEIKRKTNETDISVFINLDGSGISEIDTGIPFLDHMLHQISSHGLFDLQIKAIGDTHIDDHHTNEDVGIALGKAFSKALGERKGISRFGHFFAPLDEALVQVTLDCSGRPHLSYDLQLKAPRIGNYDTELVREFFIAFVNNSGITLHINQIRGSNSHHIVEACFKAFSRAMRMATEIDPRRSDSIPSSKGMLEKQ

SEQ ID NO: 15880 - protein, 72 aa, Enterococcus faecalis
MAKEDMIEVEGTVVETLPNAMFKVELENGHQVLATVSGKIRMHYIRILPGDKVTVELSPYDLTRGRITYRFK

SEQ ID NO: 15881 - protein, 638 aa, Candida glabrata
MNYTEEYGLPSQISISEYLFHRLNQLKIWTIFGLPGDFNMPLLDKLYSIPTMRWAGNTNELNAAYAADGYSRLKHLGCLITTFGVGELSAINGVAGSYAEHVGILHIVGMPPTSAQTKQLLLHHTLGNGDYSVFYRIANDIACHTAIINDTDLCADEVDNCIRAAWGYQKPVYLGVPVNQVDIPVDSSRLNNPIDLSILKKTKETDAQVIDLLLKQMYSASKPIIVVDACVRRHDALKETHALCELTNFPVFVTPMGKGTIDESYKNFGGVYSGSLSSPEVREVTDFADFVLFIGAILPEFSTSTFHFGFKKKNCCILFPTSVKIKKATFPDMLLKGTLQSLVDTIEPSKITYKHQAKVDIIAPKMEPSDSNLLRQEWVWNEISHWFKENDIIITETGSSAFGINQTRFPTNTIGINQALWGSVGFALCSCLGALFAVEEKTVVKHNLEIKLRNYNRNIFTENRTILFVGDGAFQLTVQELSTIIRWKLKPYIFIMNNNGYSVDRFLHHRSDASYYDVQPWNYLYLLELFGCTSFETRKIVTVSDFKELLADESFAKPDKIRMIEIMLPQSDVPKTLIARWQAEKELSNKRAGDFSENSSENSSPTIDPHWVKKQYLGPVTPTSSLSTELHSRSQMYL

SEQ ID NO: 15882 - protein, 550 aa, Unknown
  delta proteobacterium MLMS-1
MSKCKSLLTAVAAFAVAGGISLFGATSVEAKPDFQPVDIDTCYNCHDTTGPGSDIKAFHVRGSHAGINCGYCHTETDPHVRNFNTKPVTSVDQRTCGQCHAEQFNSMLQTNWDRPAKEEKATPTGRSPMYDKLMRPHGFTREHAEPRSHVFMLIDHLVVDRGYGGRFDFKSWELIGDAAAAQRGAWEVLYDKEPETNDHKAFREQTANAANPVCMFCKSQDNILSWAYMGDPHPKAEWDRTSNVVDFARSLNHGLNCFTCHDPHSTEPRITRDAQIQAIVDRGEGTYPYDEAKSERITMEKVEFRDGFRAIGLLSEPDSNMMCAQCHVTYNCNPGTDAKTGERVTMADQRTNLMPWVNVWDIEEAMFDKFAFYDFRDAVTGAKKIKFQHPEMEVFWGSTHERAGVQCQDCHMPRMVSEAGVEYTSHFQTSPRYNLESTCLQCHSDWSAEQAMYTINSVKNYVRGRIAKTEFWLSEFIDTFVRAQDLGVPESVLEEARGYHTSANTHWEWWVAENSDGFHNPQQARESLARSMTLSQEGIALLNKAIEERR

SEQ ID NO: 15883 - protein, 479 aa, Mycobacterium avium
MANRYLQGPFAPMHHEYTLTGLEVVGTIPDYLDGRYLRNGANPIGDVDPERYHWFLGDGMVHGIRIRDGKAEWYRNRWVRSPATSKALGQPAPPGHFGFFPIGANTNVIGHAGKTLALIEGGIANYELTEELDTVGVCDFAGTLTGGYAAHPHRDPETGELHAVSYNPYRGNRVQYSVIDVEGRARRTVDVTVGGSPMMHDFSLTERYVVFYDLPVTFDAAVGAAMTAPRGLRPIARLMLSALIGRVAIPDPIAARLPAATTDRRMPYSWNPNYPARVGVMPRDGEDADVRWFDVEPCYVFHPMNAYEEDGTIVLDVVRNPKMFDRDRTGPNEGPPTLDRWVIDLAAGKVRESRIDDRGQEFPRIDERLVGKRHRYGYTPTVLEGIEGGDCLLKHDLIGGSTQSRSLGPQKALGEFVFHPSSPTAAEDEGVLMGYVYDRATNRSELAILDAQTLEDVASIKLPHRVPAGFHGNWVPSTN

SEQ ID NO: 15884 - protein, 373 aa, Schizosaccharomyces pombe
MTVAALNKLSALSGSIQKSFSPKLISVGIIGSGNWGTAIAKICGENAKAHPDIFHPQVHMWMYEEKIQHEGKECNLTEVFNTTHENVKYLKGIKCPSNVFANPDIRDVGSRSDILVWVLPHQFVVRICNQLKGCLKKDAVAISCIKGVSVTKDRVRLFSDIIEENTGMYCGVLSGANIASEVAQEKFCETTIGYLPNSSVNPRYTPKTIQALFNRPYFRVNIVEDVPGVALGGALKNIVAVAAGIIDGLELGDNTKSAVMRIGLLEMQKFGRMFFDCKPLTMSEESCGIADLITTCLGGRNHKCAVAFVKTGKPMHVVEQELLDGQKLQGAATAKEVYEFLDNQNKVSEFPLFTAVYRIVYEGLPPNKLLEAI

SEQ ID NO: 15885 - protein, 540 aa, Mycobacterium avium
MTEADTPFDVLVIGAGFSGLYMLHRLRQLGIPARVLEMAENVGGTWLFNRYPGARCDIESIEYSYSFSEEIQQEWVWTESMPAQPEILAYLNYVADRLDLRRDIQFGAEVVAMTFDEDAARWSVRTRSGDTFRVPFVVAASGILSVPLQPDIPGMDTFAGTSLFTSRWPAAGVDLTGKRVGVIGTGSTGVQLIPVVAREALHLSVFQRSPAYTLPWRVHRFQPGELDEMKARYGEIRAAQRAHPIGAARLSAFSVLLEMLGRPPLKSATREEQLRAIEEHGVLGALNWGDVFFDIEANRMAAELYGEAVARIVKDPETAASLVPVHPFACKRPIIDQGYYETFNRDNVTLVDLRKAPIREVTPAGIRTDDRFHELDVIVYATGFDAMTGALSRIDIRGRGGIGLAEFWATQGPLSYLGLAVAGFPNLFTVQGPGSPSAATNFVAALEQHVEWIGDCIAYLRANHIRTIEALSTAQQEWIEHTTALVAPTVLVHPSCNSWYNGGNVPGKKRMYMGYTGGIPEYRRRCDEIAAGGYTGFKLA

SEQ ID NO: 15886 - protein, 477 aa, Prochlorococcus marinus
MNKPRILFWHRKDLRIFDNQALIKAFSLSNAITSTYIFDKNYSHDFNASSRAWFLGNSLQELGNNWKKMGSRLVMEEGDPVLIIPKLAKKINAKFVFWNRSIEPYEINRDLQIKKNLKEQNIQVIETWDHLLVEPLKIFSGNNNPYSVYGPFYKNLKSKMNLLGLYEQDKVGFQFKDIDNKLKDKTINSSDSVLEKFIKNIKFPGSNICPCKPGENAAETLLENFINEKKIYSYNSARDFPSHNGTSFLSASLRFGTISIRKVWNATLNLNSDLENQGNYLSIETWQKELVWREFYQHCLFHFPELEKGPYRKKWDHFRWQNNNEWFQHWSNGETGVPIVDAAMRQLNSTGWMHNRCRMIVASFLVKDLICNWQMGEKKFMETLVDGDLAANNGGWQWSASSGMDPKPLRIFNPYTQAKKFDPICEYIKYWIPELSKVSNSELLNGDISNLEKNDYSSPIVNHKIQQRLFKSLYAEI

SEQ ID NO: 15887 - protein, 527 aa, Oryza sativa
  misc_feature (88)..(88): Xaa can be any naturally occurring amino acid
MMGGGLVMDQGMMFPGVHNFVDLLQQNGGDKNLGFGALVPQTSSGEQCVMGEGDLVDPPPESFPDAGEDDSDDDVEDIEELERRMWRXMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQFFIRDDTPFGNQMGDINGASEFRFGSGFNMSGAVEYPGAMQGQQKNDGSNWYY

SEQ ID NO: 15888 - protein, 488 aa, Archaeoglobus fulgidus
MSPHPFHTFNFQQVLFTARVSDDVVVVVKNLVHLLANFLQLLQGFLPLKMVDPNFEVHGCPKPHSFKSFRFFLRLILHSELKNSKIERKFYRRGNEVNHMKPVELKDGVFWVGAIDWDERDFHNFVTARGLTYNSYLIVDDKVVLVDTVKHKFVKESMERIRKLVDPSQIDYVIVNHIEPDHSSGLPDTMRIAKDATVVCTQRAKDGICKYYDCDGWNIQVVKGGDTLKIGKRTLTFIDMTMLHWPDSMATYINEDKILLSNDAFGQHVASEYRFDEEIGVEEALKWAKVYYANILMPLGGLIQKKLKEIKESGLEIDIIAPSHGVVWKNPGRIIEAYDRWSRFEPTNKVVIVFDSMWHSTEKLAMAIAEGAGSEGADVRVMHIRKDYWTDIVTEILDAKAIAVGSPTIHNGLFPTVAGFLTYLKGLKPQNKKALAFGSYGWNGNAVKEVQKVLEELKFETLEPFMVKFKPSEEELQKAFELGRELAR

SEQ ID NO: 15889 - protein, 875 aa, Chlamydomonas reinhardtii
MLLQAPGLAPGSARRQAACSVAREATNVRIVTAPALTPGRAGVSGRRILPPSRVVSVELEAPTLSSSPATVSTKKLFCEPSGQPASTAYGPALTGRPAPLGASIDADTGAINFSVFSSSAESVSLVLFTEADLNAGRATFEIPLDPYVNRTGDVWHIMLPDLRDDLLYGYRVEGVHQEEDKDYPGMRHDKRRVVLDPYAVAVLNRRRWGQMGPNLPYGEEGVLGVMPTWPQAAAALPAARGSAFDWEGDTPLNLPMESLVIYEAHVRGFTAHASSGVAAPGTYAGMVERLDYLKSLGVNAIELLPVFEFNELEYYSQIPGSDQYRFNFWGYSTVNYFSPMGRFSAAVGQGAPARASCDEFKQLVKECHRRGIEVILDVVFNHTAEGNERGPTISFRGLDNRVYYMLAPGGEYYNYSGCGNTLNCNQPVVRQFILDCLKHWVTEYHVDGFRFDLASILTRAHSAWHPQQYDQETGQRVAMSSGGAIVTAEGIMTDGAGVPTGYPLADPPLVESISEDPVLRNTKMIAEAWDCDGLNQVGAFPHYGGRWSEWNGKFRDVVRNFIKGTDGPWAGDFASAICGSPNIYANNTPHETDWWANNGGRQWKGGRGPHASINFVAAHDGFTLADMVAYNNKHNEANGENNRDGEQHNNSWNCGEEGPTTKWEVNRLRQRQMRNLTGALLLSCGVPMINMGDEYGHSKNGNNNTYCHDSELNYLRWDQLAEDPHGFNRFVRLLIHFRRATPALQRTTFVNDKDIQWHGELPNTPDWTDTSRLVAFTLHDGKGGGLYVAFNTSHLPKLLQLPKWGGRVWQPLVDTSKVAPYDFLAVDGVLSAEDVAAARRQMAMWTADHTYPVLPWSCIVLQSAPEDPAATSMIK

SEQ ID NO: 15890 - protein, 281 aa, Kluyveromyces lactis
MVPGKFIFTATFVLLCTIIAVVLEYQSKKDKPVLDKEKLQEFPLVAKTVLTHNTAIYRFGLPKSTQVLGLPIGQHISVQANINGKDILRSYTPTSLDSDAVGHFELLIKSYEKGNISKHFAQLNIGDKIKVRGPKGFYHYQPNMNEEIGMIAGGTGIAPMYQIMKSIFANDSDKTKVSLVYGNQTEEDILLKKELDAFVERKPDQFKVYYLLDKAPEAWTGGVGYITVDTMKERLPAPAEGVQLLVCGPPPMVSSIKRNAVTLGYEKAKPISKMGDQIFVF

SEQ ID NO: 15891 - protein, 337 aa, Glycine max
YIDLFLKNNTAMSAIFLLVGMLSSITVAQSIGVCYGVIGDNLPSRQEVVDLYKTNGIGRMRIYYPDEEALQALRGSGIELIMDVAKETLQSLTDSNAATDWVNKYVTPYSQDVNFKYIAVGNEIHPNTNVAQYILSAMTNIQNAISSRKFTIKVSTAIDSTLITNSYPPNDGVFTSDAEPYIKPIINFLVSNGAPLLANVYPYFAYANDQSIPLAYALFTQQGNNDVGYQNLFDAMLDSIYAALENVGASNLQIVVSESGWPSEGGAGASIDNAGTYYANLIRHASSGNGTPKRPGESIETYLFAMFDENQKQGADTERHFGLFNPDKSPKYQLSFN

SEQ ID NO: 15892 - protein, 413 aa, Unknown
  Synechocystis sp. PCC 6803
MYSPGYVATSSRQSDAGNRLFVYEVIGLSQSTMTDGLDYPIRRSGSTFITVPLKRMNQEMRRITRMGGKIVSIKPLEGDSPLPHTEGIAKPSQSEGSGSEAVANPAPESNKTMTTTPKEKKADDIPVNIYRPKTPYIGKVLENYPLVREGAIGTVQHLTFDLSAGDLRYLEGQSIGIIPPGKDDKGKPHKLRLYSIASTRHGDFGDDKTVSLCVRQLEYQNEAGETVQGVCSTYLCNIKEGDSIAITGPVGKEMLLPPDEDANIVMLATGTGIAPFRAFLWRMFKEQHEDYKFKGLAWLIFGIPKSENILYKDDLEKMAAEFPDNFRLTYAISREQQNAEGGRMYISTGLAENAEELWNLMQNPKTHTYMCGLKGMEPGIDEAFTALAEQNGKEWTTFQREMKKEHRWHVETY

SEQ ID NO: 15893 - protein, 314 aa, Candida maltosa
MSATTPAVYEDSLFESQDLFAAPAPRQTEASLAEKDVELELISALPAMEKSINRAPSPFQIHSSVLDSVFSSNMDGSNEVDHTPMFDELDFIMDGAKVNSKEDWISLFGVEETGATTTGDASDPILCLDDDDALVPKDEPCLGALLIEPSPNGLSSNDETISAPTTTASSPDMCSTVATSVTSGAVKRKFSEVAYGSSKEQSQLFTPNPSSTLPTPMLDAKPRKRSKVDHLGCVTYSKKQRSQPLQPIVVSGIEDPVALKRAKNTEAARRSRARKMERMNQLEDKVEDLVGEKQALQDEVDRLKSLLTSHGISF

SEQ ID NO: 15894 - protein, 1432 aa, Unknown
  Shewanella sp. MR-7
MIELRIDNQIVTAEPNDNLLRAASKAGIAIPSLCDPTDATRQLGAAPHADKQDCNLCLVQIENTDASLRCVKACETPAEAGMKVITQSAYLTKQRQAALSTILSDHFADCEAPCQQACPAGVDVQSYLYHIAQGDHSQAIKVIKDTLPLPLSIGRVCPAFCETECRRGLVDDPIAIRQLKRHAADLDLADDEQGGSYQPPRLADTGKKIAIIGAGPAGLSAGYYLSNQGHSVEIFEAMPKAGGWLRYGIPEYRLPKAILDKEIELLCRNGLTIHTDTRLGHEIHLAQLVADFDAVCLAIGAQKAVPMNYKGSELAGCYLGVDFLKEHCLDKQLKLGKKVAVIGGGNTAIDCARTAVREGCDVTLIYRRTRAEMPAEAYEVHEAEVEGVKFHFLTNPIENHSDANGQVEAVTFSKMALGDADASGRRAPVDTGETFTEAFDTVIAAVSQAPDLSFMQDPMGQLSHGELALSRWNTLIGCEQTMSSGVEKLFVMGDARRGPATAVAAIGDGRKAAIAIDKMLKIGLSCDLHAHEFNSVKTIPSALIPNALKQTETSSKAGSTLYPHTPRQPRLKMPELTALQRLLNYSEVELGFPADAAMQEAARCLECACQANTDCKLRDYATDYGVEAKSLATENARHFSVDKSAPFIQFDANRCISCGKCVDVCQLQSGHCAIQFSQDSYQALPQEMTQHMERRAPRVGFSASMADSHCVQCGNCVQVCPTGALADARDKRQGDSTELKTASTICTYCGVGCRLDLKIDPKANRIRHIEGNKDSVVNQGMLCVKGRFGFDFIHSDKRLTTPLIRKNGELQPSSWPEAIAYVAKRLTEIKQKDGSNALASLASAKATNEDNFVLQKFVRSVLGTNNIDHCARLCHSSTVTGLQQSIGSGAMTNDIPSIKDSDVIFILGSDTTCAHPIIASKIQQAVMQHGARLLVADPKRVGIAEKAELYVAHRPGTDVMLLNAIMAEIIRHDWQDKAYIAQRTEGIEALYAELAKEDYSLENAALITGVKAEDIARLARTIGTAQKTAVYYAMGITQHTTGHDNVTAISNLQLLCGNIGVSGAGINPLRGQSNVQGACDMGALPNYFTGYQKVTDIHARMRFEDHWQTPLSGEIGVTATHMMHDIAKGKIKALYVMGENPVLSDPDQAHVLNALSKIDFLVVQDIFLTETAELAHVVLPAAAFVEKRGHFTNTERRVQRLEQALASPGEALPDWQIVQAVANAMGANWDYANEEAIWREINELTPQYRGIRWDRLSANAEGQISQGIQWPCPDETHPGTPIMHQSQFTRGLGLFTPVSYRLPAEMPCNEYPLTLSTGRLLEQFHTGTLTRKTPGLDLLGSPKVMISVYDAEQLGIHNGDKLRLTTRRGEIEIDAFVTKRAQAGVLFLPFHFVEAAANKLTINALDPVAYIPEYKVCAVRAEKVTTNVSETA

SEQ ID NO: 15895 - protein, 388 aa, Mesembryanthemum crystallinum
MFATLRQPTQSHSLITLSLQKPSIPKTEQLSFPNLPSSKHEEISHLSVTKPLHVASLLKPRKHLVECNAYEANRSQPLDINIELPSVKSETAKRVKIGIYFATWWALNVVFNIYNKKVLNAFPYPWLTSTLSLAAGSLMMLISWASRVAHPPKTDLQFWKSLLPVAVAHTIGHVAATVSMSKVAVSFTHIIKSGEPAFTVLVSRFLLGDTFPMPVYMSLIPIIGGCALAAVTELNFNMIGFMGAMISNVAFVFRNIFSKKGMNGQSVSGMNYYACLSMLSLLLLTPFAIAVEGPQVWAAGWQKAVSQIGPNFVWWVAAQSIFYHLYNQVSYMSLDQISPLTFSVGNTMKRISVIVSSIIIFHTPIQPVNALGAAIAILGTFIYSQAKV

SEQ ID NO: 15896 - protein, 468 aa, Glycine max
MPLLDRGDVWKSKARSLQLQLRDRFRVAVDRHWRRRHNHHTFIPSADGYFSSTIQRWLSRFRDFRRDSLPSSTSFYRKRVIKDFSSEEDSTLVRMMQAVAVPVLGNVCHVFMNGLNSVQVYGLEKLHSALLQRPKGKPLLTVSNHVASMDDPLVIASLLPPSVLLDARNLRWTLCATDRCFKNPVTSAFFRSVKVLPVSRGDGIYQEGMDLAISKLNHGGWVHIFPEGSRSRDGGKTMGSSKRGVGRLVLDGDSMPLVVPFVHTGMQEIMPVGANFPRIGKMVTVLIGDPINFDDIIEFDKDKGSNVPRRRLYDAVASRIGDRLHEMKVQVDTIAIDQEMQLQDKSSHSTERTSKILQQVDWELFGMDSFMSVEDDSKQRQETVALSNVSVSQHHQQSHSDQSWRAGFSYRMRGYIDQMELVSFAARGIFLNNDTKNSARPSREMGPLKAWKQFLEANLLRQWNYVHY

SEQ ID NO: 15897 - protein, 316 aa, Haemophilus somnus
MTIYADNSYSIGNTPLVRLKNFGNNGNIIAKIEGRNPSFSVKCRIGANMVWQAEKDGILTKDKEIIDATSGNTGIALAYVAAARGYKITLTMPETMSSERKRLLRGLGVNLVLTEGVNGMKGAIAKAEEIVASNPNHYVMLKQFENPANPAIHQQTTGPEIWSGTEGKIDVLVAGVGTGGTISGISRYIKQDQGKKIITVAVEPEESPVITQTLAGEETKPGPHKIQGIGAGFIPKNLDLSLVDQVEKVSSETAIITARRLMAEEGILGGISSGAALAVADRIAQRPEFSDKLIVVILPSASERYLSTALFDGFEG

SEQ ID NO: 15898 - protein, 328 aa, Unknown
  Burkholderia sp. 383
MHAWSARHVPAQGGKVAVVTGANSGLGWQLAETLAAKGATVVMGCRDAARAAQAADAIRRLHPDARVEVDPLDLADLASIARFAADVAERHGRVDILCNNAGVMFLPLRHTHDGFEMQFGTNHLGHFALTGHLLPALRAARRARVVTMSSGLNRGGRIRVDDLRAEHRYNRYLAYCDSKLANLVFAIELQRRFERAAFAGISVAAHPGYAATNLQFAGPAMDSSPARAALMRAANRYLAQPADQGALPAIHAATSPDLAGGAYIGPSGLFESRGLPAPASVPRAARDVASAALLWEASEAATGVRFLSSGAPAGRSPGRPFDTAAEVR

SEQ ID NO: 15899 - protein, 632 aa, Unknown
  Erythrobacter sp. NAP1
MCGIAGIFHAETPKPVDPRRIERMCDAMAHRGPDGAGVWTEQGVGLGHRRLSIIDLEGSPQPMLSADGRAVIAFNGEIYNFRELRRELESQGAKFRTSGDTEVILAAWQRWGVDCLEKLHGMFAFALYDLDKRQLFLARDRFGVKPLFMTRLADGGLAFSSELKGLLAHPQMRRRVNPQAVDAYLTWGYVPDTHSILSGVEKLQAGHFLLLEQGRPIPAQRRWWDISFADRAKGSEADLSAELVHLMREAVQSRMVSDVPLGAFLSGGVDSSSVVALMSEASAEPVRTCSIGFDVAALDETNYASRIAQRFSTDHDSRIVASDDFEAVDQISAMFDEPFADASALPTWRVCQLAREKVTVALSGDGADEAFAGYRRQVFHHNEEKVRSLLPAGLRQPLFGALGRFWPKADWAPRPLRAKATLLALAESGESGYARALSVATHDQRASLYDPEFTRKLSGFRAEDELISLMKSAPARSGLDRAQYADLTFWLPGDILTKVDRTSMAVSLEAREPLLDHRLVEFAARLPEGMRVKGTTGKHLLKKCMERYLPNDILYRPKQGLVTPIAQWLREPLNSETRMIASSSTLSGLGWFKPNEIRRLADDHISGRSDHSRVLWQLLMLERSLKHLNVSG

SEQ ID NO: 15900 - protein, 312 aa, Streptomyces coelicolor
MPRRPIDITIPDLRDTRAVVTGASDGMGLGMAIRLASAGAQVVLPVRNPRKGEAALTKIRQHAPDADVSLRSLDLSSLASVAALGKTLLEEGQPIHLLLNNAGVMTPPERQATVDGFELQFGTNHLGHFALAAHLLPLLRAGQARVTSQVSIAANQHAINWDDLNWECSYNGRKAYSQSKIALGLFALELNRRSEAGGWGITSNLSHPGVAPTSLLAARPEVGRDKDTVLVRMIRAMSARGVIVGTVETAQLPALMAATSAAAKPGGFYGPSGPGHLGGPPGEQELYSRLRSADEAQRVWRTSEELTGTHLR

SEQ ID NO: 15901 - protein, 467 aa, Burkholderia pseudomallei
MEGSQTGLGTGLKQRHVTMLSIAGVIGAGLFVGSGHAIAEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGVGAVLAAMLTTMFSFLGTEIVTIAAAESEHPERQIVRATNSVIWRISLFYLGSIFVVAALVPWNDALLPVHGSYQRAMELIGVPHAKGIIDVIVLVSVASCLNSALYTASRMIFSLSTRGDAPAFLRRTDASGTPRAAVLASTAFGFLTVIANYVMPEQVFGFLLATSGAIALLVYLVIAISQLRMRSTLDATGERLPLRMWCFPWLTWAVIVFICGVLVVMLLREDHRMEVGATAVLALAVVVASRMNRRARGGDEPTPAASRVSANLR

SEQ ID NO: 15902 - protein, 886 aa, Glycine max
MAASVDNRQYGTHINAVVRACGPDFNTPLPSDFDLDSSSDDEDQNDDASFLKELIQKANAETEASLLDPRDEGTADQWIPRNASMVRFTGKHPFNGEGPLPRLMHHGFITPSPLRYVRNHGPVPKIKWDEWTVEVTGLVKRSTHFTMEKLMREFPHREFPATLVCAGNRRKEHNMVKQSIGFNWGAAGGSTSVWRGVPLRHVLKRCGILARMKGAMYVSFEGAEDLPGGGGSKYGTSVKREMAMDPSRDIILAFMQNGEPLAPDHGFPVRMIIPGFIGGRMVKWLKRIVVTEHECDSHYHYKDNRVLPSHVDAELANDEGWWYKPEYIINELNINSVITTPCHEEILPINSWTTQMPYFIRGYAYSGGGRKVTRVEVTLDGGGTWQVCTLDCPEKPNKYGKYWCWCFWSVEVEVLDLLGAREIAVRAWDEALNTQPEKLIWNVMGMMNNCWFRVKTNVCRPHKGEIGIVFEHPTQPGNQSGGWMAKEKHLEKSSESNPTLKKSVSSPFMNTTSKTYTMSEVRRHNNADSAWIIVHGHVYDWTRFLKDHPGGTDRILINAGTDCTEEFEAIHSDKAKQMLEDYRIGELTTTCYNSDSSSSNPSVHGRSDTIPLTPIKEVITPMRSVALIPREKIPCKLISKTSISHDVRLFRFGLPSDGLLMGLAVGKHIFLCVTVDEKLCMRAYTPTSSVHEVGYFDLVVKVYFKGVHPKFPNGGIMSQHLDSLPIGSVLDVKGPLGHIEYTGRGNFLVHGKPRFATRLAMLAGGTGITPIYQVVQAILKDPEDCTEMHVVYANRTEDDILLKEELDEWAKKYDRLKVWYVIQESIREGWEYSVGFITESILTEHIPNASPDTLALTCGPPPMIQFAVQPNLEKLGYDTQNNLLVF

SEQ ID NO: 15903 - protein, 396 aa, Mycoplasma gallisepticum
MNKYYMSSKRDYYEILEVSRSATQQDIKKAFRKLAMKYHPDRNKDSDAEEKFKEVNEAYEVLSDEEKRKLYDTYGHEGLNASGFHQGGFNPYDVFNSVFSGFDFEGGFGDVFSQFFGGGGSGFHNQEYIEEVDVNLVHEIKINFLEAANGCIKNVKYTRQVTCPDCNGSGSADGDVITCSDCNGEGFLVEQRRTLLGMFQTKKTCPSCKGEGQTIKNKCKKCKSRRMVDEVVERKVSIDSNVFYQDVVIVRGEGHIYKNLVGDLFLRVKIEPSRVFELRDNHVVVNVLVDPLVAITGGTILIPTLKEIKEINLKAGTKNGDIITIANGGINLKLDSRVYGANYNQKGDLIVVINYARPSEYSKQEITKLKEFIKPNKEVNLYETLMKKELNNKDSQ

SEQ ID NO: 15904 - protein, 656 aa, Vibrio cholerae
MKMNLSTPFPLGATLDAEGCNFAIYAPANRDILLALFHADGSYETHQLEHEYAGVKHTHISGIHAGQKYGYLIQLNDELHYISDPYARALEGPLHYAPPFDSHKSFDLPKCVVTDTHFDWQNVAKPRIARDEMVLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVTEYQIDGFRFDLAATLGRRGDEFSKEAAFFKAVAQDPVLREVKLIAEPWDIGPNGYQVGNFPFGWNETNDKLRDITRSFWRGDLGFLKEFATRLMGSRDLYSAANWPYKLTVNYITYHDGFTLQDLVSYKHKHNEANGEQNRDGHGDNRSDNYGFEGDTDSIVIRATRERQKRNFMASLLFAFGIPHILTADVLSHTQKGNNNAYCQDNDISWLNWENNETKQDFREWLAGMVAARQTYMVPFIRAFSGENRNNNRIAWRRVDGKPMEMDDWNRLSSVALHIGIGSDGPEMLYLINQTNAPARFVLPKDRQQDWRLICDTNMRHAQHGHAEGEVLQLPVSMSILHYQPKKKSA

SEQ ID NO: 15905 - protein, 158 aa, Prochlorococcus marinus
MSVNISKVEVFSFKNQKITFDHYKGNVLLIVNVASKCGFTKQYKALQYLQDKYESKGFKVLGFPCNDFGNQEPGQLEEIKEFCSTTYGVNFQLFQKVHAKGKTTEPFTTLNQVSPSGDVEWNFEKFLINTEGDAVARFKSSIEPDSPEVTQAIEKLLD

SEQ ID NO: 15906 - protein, 565 aa, Mesorhizobium loti
MSAANPTRDDFASLLEESFTTGHSGEGQVVKGTITAIEKDMAIIDVGLKVEGRVPLKEFGVKGKDTTLKVGDTVEVYVERIENALGEAMLSREKARREESWVRLEEKFTKGERVEGVIFNQVKGGFTVDLDGAVAFLPRSQVDIRPIRDVSPLMHNPQPFEILKMDRRRGNIVVSRRTVLEESRAEQRSEIVQNLEEGQVVEGVVKNITDYGAFVDLGGIDGLLHVTDMAWRRVNHPTEILNIGQTVKVQIIRINQETHRISLGMKQLESDPWSEIGTKFPIGKKIKGTVTNITDYGAFVELEPGIEGLIHVSEMSWTKKNVHPGKILSTTQEVDVVVLEVDPAKRRISLGLKQTLENPWEAFARNHPVGSQVEGEVKNKTEFGLFIGLEGDVDGMVHLSDLDWTRPGEQVIEEYNRGDMVKAQVLDVDIEKERISLGIKQLARDTVGEAATSGELRKNAVVTCEVIGVKDGGLEVRLVDSGIETFIKRSDLSRDRDEQRPERFTVGQKVDARVIAFDKKTRKLQVSIKALEIAEEKEAVAQYGSTDSGASLGDILGAALKKQGN

SEQ ID NO: 15907 - protein, 400 aa, Arabidopsis thaliana
  misc_feature (265)..(265): Xaa can be any naturally occurring amino acid
MADSQRLSTASGVKDGQPPWKKKKLSNDTTSNPSLPYDVILIILARVSRSYYTNLSLVSKSFRSILTSPELYKTRTLLGKTENFLYVCLRFPDEANPRWFTLYRKPNQTLTDHTTKKKKKKKKKEEKSSVNLLAPISILNSHPVEWSAIISVDHYLYAISADIEKAPYSNVPYLDCRTHTWNEAPRMRLAHTNSEFEGIVYLPGSFESPDSLNCVEVYNTMTQTWKPVPPEKRMFKLENLEKKIYYKSFHLDSRAGKGLSLSYKXSKHLTCGLVVLDTVDSYLRSSCMIENIAYFYRKGNFIWRGLDGKILVYGKIEGLEGLPKFSRYSSVQLAEYGGKLVVLWDKYVPASGYKEKMIWCAEISLEKRNGKEIWGNVEWFDAVLTVPKSYKILCATAATL

SEQ ID NO: 15908 - protein, 419 aa, Geobacillus stearothermophilus
MKYLPQQDPQVFAAIEQERKRQHAKIELIASENFVSRAVMEAQGSVLTNKYAEGYPGRRYYGGCEYVDIVEELARERAKQLFGAEHANVQPHSGAQANMAVYFTVLEHGDTVLGMNLSHGGHLTHGSPVNFSGVQYNFVAYGVDPETHVIDYDDVREKARLHRPKLIVAAASAYPRIIDFAKFREIADEVGAYLMVDMAHIAGLVAAGLHPNPVPYAHFVTTTTHKTLRGPRGGMILCQEQFAKQIDKAIFPGIQGGPLMHVIAAKAVAFGEALQDDFKAYAKRVVDNAKRLASALQNEGFTLVSGGTDNHLLLVDLRPQQLTGKTAEKVLDEVGITVNKNTIPYDPESPFVTSGIRIGTAAVTTRGFGLEEMDEIAAIIGLVLKNVGSEQALEEARQRVAALTDPTSRSAAGTMEFEA

SEQ ID NO: 15909 - protein, 295 aa, Synechococcus elongatus
MASTLRVALAQLAFSDQPVIDRDRVTAAIREAAAAGAELIVLPEIHGGYYFCQTEDPAQFDRAESIPGPSTDYYSAIARELSVVLILSLFERRAAGLYHNTAVVIERDGTIAGRYRKMHIPDDPAYYEKFYFTPGDLGFEPIQTSVGKLGVLVCWDQWYPEAARLMALAGAELLIYPTAIGWDPQDVPEEQQRQLEAWQTVQRGHAIANGIPVLSVNRVGFEPSPDPAAAGSQFWGSSFIAGPQGEWLAKAGDREPELLIADLDRDRSEQVRRIWPFLRDRRIDAYGDLVRRYRD

SEQ ID NO: 15910 - protein, 244 aa, Zea mays
EAGSHPAIRYSASAAARRRNHARRPPSPPPPSLRSPACVRSTRNRRLPHAPTRCCATSRRPGGSSGAARAFHPSPAAVPRPAHLLCSPLPTVSDILILRPCGRVVGRRRMGFEKEDAYFWKQMGKAMLCTYTLFGVVWLWNETSPLGWWTLKPRPKEEREMAHLYERRKFPYPGDDEAVEEFVKSGGALGTTIGPRGFADANMDSENMQKQLQSKKFEQEAQKLWIRMRNEVVQELQEKGFDIE

SEQ ID NO: 15911 - protein, 561 aa, Mycobacterium avium
MTDAATEPAYTVGDYLLDRLAELGVSEIFGVPGDYNLEFLDHIVAHPRLRWVGNANELNAGYAADGYGRLRGMSALVTTFGVGELSAANAVAGSYAEQVPVVHIVGGPSKDAQGTRRALHHSLGDGDFEHFFRVSREITCAQANLMPATARREIDRVLSEVREQKRPGYILLSTDVARFPTEPPEAALPRYTGGTSPRALAMFTEAAAALIGEHRITVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGEALQALAAILTRRGVSSPPVASPPAEPLPPPPPREQPLTQKMVWDRVCTALTPGNVVLADQGTSFYGMADHRLPQGVTFIGQPLWGSIGYTLPAALGAAVAHPDRRTVLLIGDGAAQLTVQELGTFAREGLSPVIVVVNNDGYTVERAIHGETAPYNDIVGWKWTEVPNSLGVTDHLAFRVQTYGELDDALTAAARHQDRMVLVEVVLPRLEIPRLLVELVRPTSPDGSPRR

SEQ ID NO: 15912 - protein, 308 aa, Streptomyces avermitilis
MAVVTMRELLESGVHFGHQTRRWNPKMKRFIFTERNGIYIIDLLQSLSYIDRAYEFVKETVAHGGTVMFVGTKKQAQEAIAEQATRVGMPYVNQRWLGGMLTNFSTVYKRLQRLKELEQIDFEDVAASGLTKKELLVLSREKAKLEKTLGGIREMQKVPSAVWIVDTKKEHIAVGEARKLNIPVVAILDTNCDPDEVDYKIPGNDDAIRSVTLLTRVIADAVAEGLIARSGAGKAEGDKAAGEPLAAWERDLLEGEKKADEAEAPAAAEAEKPAEAAAEAPAAEAPAAEAPAAEAPAAEAPAADAEQA

SEQ ID NO: 15913 - protein, 115 aa, Blastopirellula marina
MKLIIALIQPTKLDSLRDALKEISVERFTVTDAEGYGRQRGHSATFRGVEYQTTLLRKISIELIVNDDFVEKALATIESVARTGQEGCIGDGKIFVLPVEQTIQIGGAARGPAAV

SEQ ID NO: 15914 - protein, 302 aa, Pseudomonas aeruginosa
MDKDKVLLVLHGKQAGNEEVRAAVAAQREAGRELAVRVTWEDGDARRIVEEALAAGYATLVAGGGDGTLREVAEALARGRGEASLAILPLGTANDFARAAGIPLEPAAALALLDQTARPIDLGEVNGKLFLNMATGGFGSKVTANTSEDLKKVLGGAAYLLTGLTRFSEVHAAQGRFSAPDFQWEGEFLALGIGNGRQAGGGHVLCPQARVDDGLLDVSILPTPQDMVGTLGTLLGGGNGVESLFVRARVPWLEVEAAEGLDVNLDGEPLEGRKLRFSVSPGALRVHLPAGSPLLREPPRED

SEQ ID NO: 15915 - protein, 319 aa, Symbiobacterium thermophilum
MDEKRLELATFAGGCFWCMVSPFEEQPGIYKVVSGYTGGHKENPTYEEVCSGTTGHFEAVQITFDPDVFPYERLLDLFWQQIDPTDPDGQFYDRGPQYRTAIFYHNEEQRRLAEKSKAELEASGRFDKPIATLILPAGPFYPAEEYHQGYHRKNPFHYQRYRAASGRDDFIRKHWRDPERDAELRRRLTPIQYEVTQLGATERPFTGEYWNHFEEGIYVDVVSGEPLFSSRDKFDAGCGWPSFTRPLVPENIVERLDLSHGMVRTEVRSRGADSHLGHVFPDGPAPTGLRYCINSAALRFIPKEDLEKEGYGEFRKLFE

SEQ ID NO: 15916 - protein, 554 aa, Shigella flexneri
MCSIFGVFDIKTDAVELRKKALELSRLMRHRGPDWSGIYASDNAILAHERLSIVDVNAGAQPLYNQQKNHVLAVNGEIYNHQALRAEYGDRYQFQTGSDCEVILALYQEKGPEFLDDLQGMFAFALYDSEKDAYLIGRDHLGIIPLYMGYDEHGQLYVASEMKSLVPVCRTIKEFPAGSYLWSQDGEIRSYYHRDWFDFDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNVKELHEETVRKLLALHMYDCARANKAMSAWGVEARVPFLDKKFLDVAMRINPQDKMCGNGKMEKHILRECFESYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 15917 - protein, 265 aa, Xanthomonas campestris
MPQVTMRQMLEAGVHFGHQTRYWNPKMAPYIFGARGKIHIINLEKTVPLFNDAMNFLSSVAQKRGTVLFLGTKRSARESIKEEAERCNMPFMTQRWLGGTLTNFRTVKQSVARLKELEAAETDGTFDKLVKHEVLGLRREREKLDASLGGIKEMNRLPDAIFVIDIGHEDIAIKEAKKLGIPVIAVVDTNYDPALVDYAIPGNDDAIRAVQLYARAAADAVLEGKAAAPNSASVREEEFSAESADEGKGRRAPAKKGDKKADAAE

SEQ ID NO: 15918 - protein, 426 aa, Mesembryanthemum crystallinum
IITQPLPLGAVALMGLGAAVLTKTLTFAAAFSAFGDPIPWLIALAFFFARGFIKTGLGNRIAYQFVKLFGASSLGLGYSLVFSEALLAPAIPSVSARAGGIFLPLVKSLCIACGSNVGDGTERKLGAWLMLTCFQTSVISSSMFLTAMAANPLSATLTLNTIGQTIGWMDWAKAAVVPGLVSLVVVPLLLYVIYPPEVKSSPDAPRLAAEKLEKMGPMSRNEIIMGVTLLLTVGLWVFGGVLNVDAVTAAILGLSILLITGVVTWKECLAESVAWDTLTWFAALIAMAGYLNKYGLIAWFSETVVKFVGGLGLSWQLSFGILVLLYFYSHYFFASGAAHIGAMFTAFLSVASALGAPPYFAAVVLAFLSNLMGGLTHYGIGSAPVFYGANYVPLAQWWGYGFVISVVNILIWLGVGGFWWKAIGLW

SEQ ID NO: 15919 - protein, 387 aa, Blastopirellula marina
MAVKADYYEVLGVSRTANGDEISKAYRKLAIKFHPDSHPDDENASLKFKQAAEAYEVLSDAEKRGRYDQYGHAGVEGGHRQFSDAEDIFEAFGDIFGGGVFGDLFGGRGRTRSGRRVSKGADIKAQVTLDLEEAARGVEKTITFDRREPCETCKGSGAAAGSQAERCTRCGGHGQVVQQAGILRVQTTCPSCAGAGVKITDPCRSCRGQGFQNRRVELDVNIPAGVDDQMRVRLSGEGQPSPNGGPAGDCYCFISLRRHKLFERDGEHLILKMPISYTQAVLGAQIEVPTLIDGAHMLTVPKGTASGEVFKVRGQGMPDPHGRGKGDLYVQTYIEVPKKLDTRQEELLRELAEFEHTNVSPHRKSFLESIRDYLFSSGDEDEAVKEK

SEQ ID NO: 15920 - protein, 162 aa, Zea mays
MAMRALPLTPSRSSSFGAHQTRPSGGGPRSVRAYAKGDEEGDKQSLFGSITEALDFSQVRSEKDAELLYEARESTKGGGRMTREQYGALRRKIGGTYQDFFKSYVEVDGQYVEEGWVDKTCKICKKDTRGEPRQVDKLGRYAHVACLENPKPTNFFAKIFAR

SEQ ID NO: 15921 - protein, 416 aa, Streptococcus thermophilus
MTYIDTLGQQAKVASRQIAKLSTAAKNDLLNQVAKALVAESDYIITENAKDMANASENGISKIMQDRLLLTEDRIAGIAEGVRQVADLQDPIGQVVRGYTNLDGLKIVQKRVPMGVIAMIFESRPNVSIDAFSLAFKTNNAIILRGGRDAINSNKALVTVARKALKNAGITADAVQFVEDTSHEVAEELMVATKYVDLLIPRGGARLIQTVKEKAKVPVIETGVGNCHIYVDKYANLDMATQIVINAKTQRPSVCNAAESLVVHADIVEEFLPNLEKAILKIQSVEFRADERALKLMEKAVPASPEDFATEFLDYIMSVKVVDSLDEAINWINTYTTSHSEAIVTQDISRAEQFQDDVDAAAVYVNASTRFTDGFVFGLGAEIGISTQKMHARGPMGLEALTSTKFYINGQGQIRE

SEQ ID NO: 15922 - protein, 267 aa, Streptococcus thermophilus
MKRNFDSVKRLVIKIGTSSLVLPSGKINLEKIDQLAFVISSLHNKGIEVVLVSSGAMGFGLNVLDLETRPAEVGKQQAVSSVGQVAMMSLYSQVFSHYQTKVSQLLLTRDVVEYPESLANAINAFESLFELGVVPIVNENDAVSVDEMDHATKFGDNDRLSAIVAKVVGADLLIMLSDIDGLFDKNPNVYEDATLRSYVPEITEEILASAGAAGSKFGTGGMMSKIKSAQMVFENQSQMVLMNGENPRDILRVLEGAKIGTLFKQED

SEQ ID NO: 15923 - protein, 434 aa, Salinibacter ruber
MPFNFDVYERSAYREPAPIDHDSPFQSMMERFDVAAEILELSPGFYEYLCRPARMHVTSIPVEMDSGRVKIFEGYRVIHNNVLGPSKGGIRFAPDVTLNEVKALAGWMTWKCSLVDLPFGGAKGGVACNPEEMSPGELERLTRRYTADLFDVFGPDKDIPAPDMNTNEQIMAWVLDTYSMHARQTENAVVTGKPVGLGGSKGRRQATGRGVMTVTLAAMEQIGLAPGDCTVAVQGFGNVGATAADLLGEQGCTVVAVSDITGGYYNENGLDLKAMKAYTQQNGGTLAGYEEAQHITNEELLTLDVDVLVPAAKEDQINREIAEDLRARIVAEGANGPTHPAADEVLAEKEVLVIPDILANAGGVTASYFEWVQNRQGFFWTEEEVNRRLDRMMGEAFDKVYTAADKYDVSLRIAAYVVGIRRVAEALRMRGIYA

SEQ ID NO: 15924 - protein, 662 aa, Chromobacterium violaceum
MCGIAGALLDRHAHDGDVAEARRMILRQTHRGPDGLAARRVGPALLASSRLAIVDVANGSQPFSDESRAIHAVFNGEIYNHLELRENLSRRGHSLSGGSDGEVIVHLYEEYGTDCFQWLDGQFAIAIFDSRDDSLHLARDRMGICPLHWARLDGALYFSSEIKGLLAVAGMPRRAEPRAMLQLAYFGAVCAPLTPFGGIHQLPAAHRLSFRAGRLEIGRYWSLDFPLAGEHARLSEAQAAEGLAARLERAVASHAQGEFEPTCFLSGGIDSAVIAALLQRRSQASIAAFCAASEHGRMDEGGAAARTAEWLGVDLKRVRIDEAGIADAFPRLIWHGETPVISTEASALMRLAGEAGKRSKIVLTGEGADEAFAGYLAFRQYRQLGALTGRGLSPLRTMVRPWLRGHYGSECLLPGEDRLGVLAEHFGCVPAQAYEWEFYREALTPLFSPELRAMAAAGGCWDGFEFDRGAVRGRHWLDRSLYVSYQVMLPNYLLGAHGDRIYAAHSVEGRYPFLDRALVEYAAALDPALKLRRGREKHILRVAAARWLPDEVAWRPKTRFVMPFGTPFVGPRAAPLYAELLSPGKLAEYGYFDPERVRSLFRALASPPSAGGKARRYLERLALGLGATFVVSAQLWHHLHLADGGSAVSGEAARRSAPATIA

SEQ ID NO: 15925 - protein, 631 aa, Oryza sativa
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRIGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQVDIQLLRYRTMTFFSMNAMTEERNILQGTRSALYSNDRESISVTVQEVTPRAVGALVALYERAVGIYASLVNINAYHQPGVEAGKKAAGEVLALQKRVLTVLNEARHIEMIYKIIQHMAANDRALIAEGSCGSPRSIKVYLGECNVDEDMLAA

SEQ ID NO: 15926 - protein, 178 aa, Erwinia pyrifoliae
  misc_feature (9)..(9): Xaa can be any naturally occurring amino acid
  misc_feature (29)..(29): Xaa can be any naturally occurring amino acid
MATEYAIIXGGCFWCTEAVFKQINGVESXESGYIGGHTENPTYKQVCHGDTGHAEAIRIGFDPEKVSFGDLLDISFATHDPTQLNRQGNDIGTQYRSAIFPTGAQQAEEAKAAISRAQSEHSDPIVTSIEADAVWYPAEDYHQDYWAGEGQENRYCLAVIPPKLQKLRKRFAAYAVSK

SEQ ID NO: 15927 - protein, 384 aa, Oryza sativa
MAAPEAPSCYVGIARQSAAFRLMKQMGWEEGEGLGKDKQGIKGHVRVKNKQDTLGVGVDSPHNKWVYDTTQFDNILKKLKVQSATPAIKEFEDDVSNSPDSTPKEAKPTNNEVTKVTRPQGRYKKRERGKSVSGYSAKDLEGILVRKSDDNCKVDQEVEPTCCDEPDPIICQDTVSQADDVNWWGHKFGFKSGGFLGAKSRKNKSSATKGTSNVRQTFGEEDQENLYNLVQDKATSGKQGLGIKGLPIKVAGHRWKGNKTSFGDSDEENSTQSNELSELEEDGDEEESANDNELIDANVNTVKEMCVDVKQKHKTKVKKLCKTILRQAPAQSMKLKELKVAVEAHSESMFSNFSCRREALLFLKRKLQGSRKFNIDGKRVQLVS

SEQ ID NO: 15928 - protein, 325 aa, Staphylococcus aureus
MSVEEYGKVYLIGAGPGNPNYLTKKAERLIREADVILYDRLVNPLILQYANLTTEIIDVGKKPYAKHIQQEKINDCIVEAARRYNKVVRLKGGDPAIFGRVQEEVDILNEHHIAFEIVPGVTSASAAVATMQTGLTMRTVAKSVTFSTGHFKDSEENEVDVNSLVNGGTLAIYMGVKRLGKIITQIQQYTDIDYPIAIVFQASCFNEFVVKGRLSNIISKLQHYSIEAKPGICIIGEVVDYTENTPKSYDPMKQFYVVSGSKHDALMLCEHLYDEGYGCLLNPNDTSNGTYHSSQYDYYDAFIKQQENVTYISTDRADANTVLCH

SEQ ID NO: 15929 - protein, 311 aa, Streptomyces coelicolor
MTTVNHWTPGDIPDQAGRTALITGGNSGIGLETARALARHGARVILAGRSRTRLDQAAEAVRAATPEARTDTLVLDLSDLSSVRDAATRIAETETVDLLFNNGGVMNLPERRTTHDGLEMTVGTNHLGHFAFNAQVWPAVRRSPAPRVVTVSAIAARWPMGRLEDLMSEKSYRAMGAYAKSKRANIVYTLELARRTASSPVEALVVHPGAAMTNLQQHGTGPLSRMVTPIAARLLMGSAEGAAWPSLYAATSPHVQSGWFIGPAGRDQTSGTPRPAKLPTGADDPAEGRRLWAASEQLTGVPFDIEAEAAV

SEQ ID NO: 15930 - protein, 970 aa, Brassica juncea
MPDSVRSMKMNMKSFLKKLHITPNQPDEAADGSSIPTNKSSDVSSSPHHQSPEVKPFSGLSNWLSSVGHRKSPSPPNSLNATNGGDDEQQQDSKEDPEVEEEYQIQLALELSAREDPEAAQIEAMKQFSLGSCAPDNSPAELVAYRYWNYNCLGYDDKILDGFYDLYGVLNASSAEKIPPLLDLQGTPVSDGVTWEAVLVNRSGDYNLLRVEQMGIDIAAKTESVSSSSFVNSELVRKLAVLVGDYMGGPVVDPDSMLRAWRSLSYSLKATLGSMVLPLGSLTIGLARHRALLFKVLCDSVGVPCRIVKGQQYTGSEDVAMNYIKTDDGREYIVDLMGDPGTLIPADAAGLQIDYDEPVCSTSPGDNDSFHDASSTNGIESSFQENIEFPPGEHSSSTKSSKEDVAKVEKAPPVQNLSSRPIHSFTHMRSPSWTEGVSSPAARRMKVKDVSQYMIDAAKENPRLAQKLHDVLLESGVVAPPNLFSEVYPQQLDATVEIKNLTEAKKEKETAQQGRHQNDLGPVRFLPPLPRLHSKADTHDQQHDHGKVVSQSDSSHSEASSTEYARTVPAAVAAAAVVASSMVAAAAAKTANTESSTLELPAAAAATATAAAVVATAAAVSRHLELGSNSDGDAGSGGHEPQGSGDSPHGPNSGGDRVSDRSTGDESSKSDGTLDDVSDCEILWEEITLGERIGLGSYGEVYRGDWHGTEVAAKKFLDQDLTGEALEEFRSEVQIMKKLRHPNIVLFMGAVTRPPNLSIITEFLPRGSLYRLIHRPNNQLDERRRLRMALDAARGMNYLHSCSPMIVHRDLKSPNLLVDKNWVVKVCDFGLSRMKNSTYLSSKSTAGTAEWMAPEVLRNEPADEKCDVYSYGVILWELFTLQQPWGRMNAMQVVGAVGFQHRRLDIPDFVDPAIAELISKCWQTDSKLRPSFAEIMVTLKKLQRPATGSNIPRPVPSSSSLSTEQEQKDC

SEQ ID NO: 15931 - protein, 173 aa, Schizosaccharomyces pombe
INKEDVVIDVGFAPGSWSQVAKKLVGNKGKVIGIDIQHIAPPEGVLPIYGDIRDPNTLTKLFEALRLLHEPNTNDSIDCRVVDAVISDMLHKATGIRIRDHALSMELCASALHVALTFLKSNGSFICKFYMGDEDADLQNLLKSHFRFVQVMKPKASLKESREAYFVCLERKP

SEQ ID NO: 15932 - protein, 414 aa, Rhizobium leguminosarum
MLDPKFVRRGLFLVFIILFLDIIGIAIIMPVLPAYLEQLTGGSVSDAAIDGGWLMLVYAGMQFLFAPLLGNLSDRFGRRPILLLSVLTFAIDNFICGIATSFWMLFVGRVLAGISGGSFATCSAYIADISTEENRAKNFGLIGIAFGVGFTIGPVVGGVLGEFGPRVPFLGAAALSLVNFIAACFLLPETLEPKNRRRFEWKRANPLGTLRQMRHYPGIGWVSLVMFLFFLAHAVYPSVWSFVSTYRYGWSEGQIGLSLGIYGIGAVIVMGLVLPRIVPVLGEWKTALLGLCFSAVGLTGYAFAWEGWVVYVVIVATVMENVADPPLRSIAAGMVPPSAQGELQGALTSLSSITTIAGPLIFTQMFGYFTRPEAPITFAGAPYLAAALFILVAAGVFLLRVRVRERAEALEAAG

SEQ ID NO: 15933 - protein, 534 aa, Unknown
  Synechococcus sp. PCC 7002
MLGEMWSFNGRYKILHMTWFAFFLSFVVWFNFPPFATTIAQDFGLDKAQLGTIGLCNVALTVPARIIIGMLLDKYGPRLTYSLLLIYAAVPCLIFATAQSFNQLVLGRLLMGIVGAGFVIGIRMVAEWFPPKDVGTAEGIYGGWGNFGSAFSAFTMVIFGIILAFLPGAFNFGQPESFKILFFPEFNTAILNWRAAIAGTGIIAALYGMLYYFSVSDTPPGKTYHRPKSARGMEVTTKKDFWFLLAMNLPLTLILMVLAWRLQKVNFLNGTGFAIAILALVGLYLFQTYNCWTVNKDLMTGKKRYAPEDRYEFSQVAILELTYIVNFGSELAVVTMLPAFFEGTFSLDKATAGIIASSYAFMNLMSRPGGGLISDKMGSRKWTMVVLTVGMGVGYLLMSSVAGTWPLAIAVLLTMACSFFVQAAEGSTFAIVPLVKRRITGQIAGNVGAYGNVGAVAYLTVLLLLTEASAGANGGEPVMATVNAGFFQVLGITGLIVAFLCAFFLKEPKGSFAEFHEGETEMTATPPIEEEATY

SEQ ID NO: 15934 - protein, 534 aa, Mesembryanthemum crystallinum
MGICASKNKATQPEDNGYTPANGVGSNNQSKPPAQQNYHQQPPQQPVAPPQPASHPPVRMPSPKPAPKVEPNTILGKPFEDVKVYYTLGRELGRGQFGVTYLCTDKKTGQQYACKSISKKKLVTKADKDDMRREIQIMQHMSGQPNIVEFKGAYEDKTSVNLVMELCAGGELFDRIIAKGHYSEKAAATMLRQIVNVVHVCHFMGVMHRDLKPENFLLSSKDENSLLKATDFGLSVFIEEGKVYRDIVGSAYYVAPEVLRRRYGKEIDVWSAGVMLYILLSGVPPFWAETEKGIFDAILQGHIDFESKPWPSISNGAKDLVRKMLTQDPKKRITAAQVLEHPWLRDGEASDKPIDSAVLLRMKQFRVMNKLKKLALKVIAENLPDEEIQGLKQMFANMDTDGSGSITYEELREGLARLGSKLTETEVKALMEAADQDGSGSIDYYEFITATMHRYRLERDEHLYKAFQYFDKDNSGFITTDELETAMKEYGIADENCIAEILLEVDTDNDGRINYDEFSAMMRSGTQNPVTKLI

SEQ ID NO: 15935 - protein, 538 aa, Arabidopsis thaliana
MLDSLVSKLPSLSTSDHASVVALNLFVALLCACIVLGHLLKENRWMNESITALLIGLGTGVTILLISKGKSSHLLVFSEDLFFIYLLPPIIFNAGFQVKKKQFFRNFVTIMLFGAVGTIISCTIISLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPQPDSIRGFLTRPTRTVHYYWRQFDDSFMRPVFGGRGFVPFVPGSPTERNPPDLSKA

SEQ ID NO: 15936 - protein, 410 aa, Oryza sativa
MNALAATSRNFRQAARLLGLDSKLQKSLLIPLREIKVECTIPKDDGTLATFVGFRVQHDNSRGPMKGGIRYHPEVDPDEVNALAQLMTWKTAVAAVPYGGAKGGIGCTPGELSRSELERLTRVFTQKIHDLIGINTDVPAPDMGTNAQTMAWILDEYSKFHGHSPAVVTGKPIDLGGSLGRDAATGRGVMYATEALLTEYSDHFRINLVIQGLGNVGSWAAKLIHQKGGKIVAVGDVTGAIRNKSGIDIPALLKHRSEGGSLEDFYGAEVMDAAELLVHECDVLVPCALGGVLNRENAAEVKARFIIEGANHPTDTEADEILAKKGVIVLPDIYANSGGVVVSYFEWVQNIQGFMWDEEKVNRELQKYMKNAFQNIKDMCKSQNCNLRMGAFTLGVNRVAKATLLRGWEA

SEQ ID NO: 15937 - protein, 355 aa, Campylobacter lari
MSAKILFIDRDGTLIDEPKNDFQIDSLEKLEFEKGAINALLKLKNFGFKFVMVSNQDGLGTNSFPRENFDKVHEKMLSVFQSCGIEFEDIFICPHFEHENCACRKPKTAMLENYIKNKLYDKNKSFVIGDRDSDMLLAQNLKIQGLKYDKNDFNWEQIADFILQNYRSAYIERNTKETQIQVKIAFNEKAKANIKTNIAFFDHMLEQIATHANISLEIKCKGDLEVDEHHSVEDVALALGEAIKSALDQKIGIARYGFVLPMDECLASCAIDFCNRPHLVYKAKFKKEKLGELSTEMIEHFFYSLSYAMGASLHLKVKGKNDHHKAEGLFKAFARALKMAIKIENENLASSKGVI

SEQ ID NO: 15938 - protein, 179 aa, Haemophilus influenzae
MKKHHVDVLISENDVHARIAELGAQITKFYQEKQIDSLVVVGLLRGSFMFMADIVRQINLPVEIEFMTTSSYGTGMTTNHDVRITKDLDGDIKGKHVLIVEDIIDTGYTLEKVRDILNLREPASLAICTLLDKPSRREVEVLVEWVGFEIPDEFVVGYGIDYAQRHRNLGYIGKVVLEE

SEQ ID NO: 15939 - protein, 170 aa, Schizosaccharomyces pombe
MQIAIIAAGCFWGVQEVYLRKFIPAAAILKTSVGYTGGITADPTYKEVCTNTTNHAEALKIEFDEKLTSYDKIIEFFFAMHDPTTSNQQGNDIGTQYRSAIFTTNPEQATIAKRVMNEVQAKHYPNKKIVTQILPAGKWWDAEDYHQLYLEKNPDGYRCSSHFLRWNVFE

SEQ ID NO: 15940 - protein, 88 aa, Paenibacillus polymyxa
AIIKPFKLDEVREALSEIGISGLTVTEVKGFGRQKGHTELYRGAEYVVDFLPKIKIEIVVNEEQVDPAIDAIIKAARTGKIGDGKIFV

SEQ ID NO: 15941 - protein, 504 aa, Pericallis cruenta
MSILTLICTFITGLMFYGLVNLLSRRASRLPPGPTPWPIIGNLMHLGKLPHHSLADLAKKYGPLIHVRLGSVDVVVASSASVAGQFLKVHDANFANRPPNSGAKHMAYNYHDMVFAPYGPRWRMLRKMCSMHLFSAKALTDFRQVRQEEVTILTRVLARTGQSAVKLDQQLNVCFANTLSRMMLDRRVFGDGDPKADDYKDMVVELMTLAGQFNIGDYIPWLDLLDLQGIVKRMKKVHSQFDSFLDTIIDEHTIGTGRHVDMLSTMISLKDNADGEGGKLSFIEIKALLLNLFSAGTDTSSSTVEWGIAELIRHPQLMKQAQEEMDIVVGKNRLVTEMDISQLTFLQAIVKETFRLHPATPLSLPRIASESCEVKGYHVPKGSILFVNVWAIARQSELWTDPLEFRPGRFLIPGEKPNVEVKPNDFEIVPFGGGRRICAGMSLGLRMVNLLIATLVQAFDWELANGLEPEKLNMEEVFGISLQRVQPLLVHPRPRLARHVYGTG

SEQ ID NO: 15942 - protein, 318 aa, Haemophilus influenzae
MSDIKHAKLLILGSGPAGYTAAIYAARANLKPVLVTGLQQGGQLTTTDEIENWPGDFEMTTGSGLMQRMLQHAEKFETEIVFDHINRVDLSSRPFKLFGDVQNFTCDALIIATGASARYIGLPSEENYKGRGVSACATCDGFFYRNKPVGVIGGGNTAVEEALYLANIASTVHLIHRRDSFRAEKILIDRLYKKVEEGKIVLHTDRTLDEVLGDNMGVTGLRLANTKTGEKEELKLDGLFVAIGHSPNTKIFQGQLELNNGYIVVKSGLEGNATATSVEGVFAAGDVMDHNYRQAITSAGTGCMAALDAERYLDAQEA

SEQ ID NO: 15943 - protein, 289 aa, Mycobacterium avium
MTGWTAADLPSFAQRTVVITGANSGLGAVTARELARRGATVIMAVRDTRKGEAAARTMAGQVEVRELDLQDLSSVRRFADGVSGADVLINNAGIMAVPYALTVDGFESQIGTNHLGHFALTNLLLPRLTDRVVTVSSMAHWPGRINLEDLNWRSRRYSPWLAYSQSKLANLLFTSELQRRLTAAGSPLRALAAHPGYSHTNLQGASGRKLGDALMSAATRVVATDADFGARQTLYAASQDLTGDTFVGPRFGYLGRTQPVGRSRRAKDAGMAAALWALSEQLTKTEFPL

SEQ ID NO: 15944 - protein, 686 aa, Dryopteris filix-mas
TPSEFQVQDLAEWLLGSSEEIASSGVTCTDSLAEAGYPGATALGDAVCGMAAARITPNSDFLFWFRSHTAKEVFWGGAEHDPQARDDDSRLLPRSSFKAFLEIVKRRSLPWEEVEVDAIRSLQLILREDLEEFCAAAAGADVEDVDSLVPLSIKLSLKESEEMGGAEDSKKLERATSAAAGGTGGGGWEKMSLPSSLAQEWMEAIRGTGDGGASGGVPFDWDAISVFQQTSFVVVDALKPDLPIIFASTGFFNLTGYTSREVIGGNCRFLQGPDTNPEDVASIRDAVVPRGTGTFCGRLLNYRKDGSNFWNLLTIAPIKDDTGTIVKLVGVQLEVSKYTEGSRANRLRPNGLPQSLIKYDVRHQDKVSALVAQIVAALTKPYKVEPPRPSYAMRASLTGQTIQPLSPGRAAAARPYSASDVPQTAAIPREGGGRRRHRSSTFLSLLGMEEKDSEEDQFPEPELIMMDNASVGRPGSLDDRERTRRGIDLATTLERIGHSFVITDPRLPDNPIIFASDQFLELTEYSREEVLGENCRFLQGRDTDLKAVQLIRDAVKEGRDITVQLLNYTRGGRPFWNLFHLQAMRDKKGNLQYFIGVQQETDTLDRVEQEKAEVVRATAQNVDVAARELPDANLTPDHLWERHSKVVTPLPHSKINSPCWYAIRKVQRRLRRGERLGLKHFRPIKP

SEQ ID NO: 15945 - protein, 410 aa, Lactuca sativa
MPGKGNAVLKGDCKGKCHLSTINDSFVETRTHHFMVNGKPLYFNGFNAYWLMCMASDPSTRVKVTDAFQESSKIGMNLVRTWAFSDGGNKPLQTSPGFYNEDMFKGLDFVISEAKKYGIHLILSLVNNWDDFGGKKQYVQWARDHGGQYLNSDDDFFTNVVVKGYYKNHLKTILTRRNSITGVDYKDDSTIFSWELMNEPRCQSDLSGKFLQEWIVEMAAEIKSIDKNHLLEIGLEGFYGESMPEKKQNNPGYEVGTDFITNNGVNNVDFATIHMYPDQWVPGASDEARAKFVEKWINAHIEDCDSILRKPLLIAEFGKSSWSSGYTVEARDEYFGGIFNTAYESARNRGSCSGTTFWQVMAEGMDNWGDGYQVVLDQNPSTAAIIAKQSQRISSLNSSTNLEFSPVAVD

SEQ ID NO: 15946 - protein, 290 aa, Pseudomonas putida
MTQDTPYIFDATDTNFQQLVIENSFHKPVLVDFWAEWCAPCKALMPLLAKIAEGYQGELLLAKINCDVEQQVVAQFGIRSLPTVVLFKDGQPVDGFAGAQPESAIRAMLEPHVQMPAAPTAAPLEQAKALFAESRFAETETLLQALLGEDNSNAEALILYARCLAERGELGEAQVVLDAVKTDEHKAALAGAKAQLTFLRQAASLPEVADLKSRLAQNPQDDEAAYQLSIQQLARQQYEAALEGLLKLFQRNRGYENGLPQKALLQVFELLGGDHPLVGVYRRKLSAAMF

SEQ ID NO: 15947 - protein, 657 aa, Hypolepis punctata
TPLEFQIQELAEWLLGSSEEIASTGVTCTDSLAEAGYPGAAALGDAVCGLAAARITPNSDFLFWFRSHTAKEVFWGGAEHDPEARDDDSRMLPRSSFKAFLEIVKKRSLPWEEVEVDAIRSLQLILREELEKFCAAAAAAATASASDRDDVDSLVPSSKKLSLKENEEMGTGGGWGKMSLPPSLVQEWMEAIRGGAGDGRASGGGGGDFNWDPTCMFQQTSFVVVDALKPDLPIIFASTGFFNLTGYTSTEVIGANCRLLQGPDTNPEDVASIREALAQDTGTFCRKLLNYRKDGSSFWNLLTIAPIKDDRGSIVKLIGVQLEVSKYTEGSRANRLRPNGLPQSLIKYDVRHRDKVSVFVAELVAALTKPDKVELTKPSSTMQFSLTGQTIKPLSKTAAMPREGGGRRRHGSNTFLSLLGVEKKDPVEDQFPEPRLIMVDDNSVGRPESLDDPERTRRGIDLATTLERIGQSFVITDPRLPNNPIIFASDQFLELTEYSREEVLGNNCSFLQGRDTDANTVQLIRDAVAEQRDVTVQLLNYTRGGRPFWNLFHLHAMRDEKGELQYFIGVQQETVAPRVPEDMPDRVKQVHTTAQNVDVAARELPDANLSPDHLWVRHSKVITPLPHSKMNNSSWYAIRRVQRRVRLGLKHFRPIKP

SEQ ID NO: 15948 - protein, 420 aa, Rhizobium tropici
MVEKRFPAAGRDAMAYVLAGGRGSRLKELTDRRAKPAVYFGGKTRIIDFALSNALNSGIRRIGVATQYKAHSLIRHMQRGWNFFRPERNESFDILPASQRVSETQWYEGTADAVYQNIDIIEPYGPEYMVILAGDHIYKMDYEWMLQQHVDSGADVTIGCLEVPRMEAVGFGVMHVDDKDRIIDFVEKPADPPGIPGNPDFALASMGIYVFHTKFLIECLKRDAADPNSSRDFGKDIIPHIVKNGKAVAHRFTQSCVRSDFEREAYWRDVGTIDAYWQANIDLTAVVPELDIYDKSWPIWTYAEISPPAKFVHDDEDRRGSAVSSVVAGDCIISGASLYNSLLFTGVRANSYSKLEGAVVLPSVKVGRRAQLKNVVIDHGVTIPEGLVVGEDPELDAKRWRRTESGICLITQSMIDKLDL

SEQ ID NO: 15949 - protein, 410 aa, Zea mays
MDGNFLQNALSKTRQVDDFTSRLLEIHRKMMEINKEENIRLGLHRSDYMLDSETSSLLQIELNTISASFPGLGSLVSDLHRSLIKQYGTSLSLEHKRVPANAASTQFSGALAQAWSEFNIDSAVIMMIVQPEERNMYDQYWLSKHLQDSHGITTIRKTLSQVEAEGQVLPDGTLLVVGQKVAVVYFRAGYTPNDYPSEAEWSARLMMEQSSAVKCPSISYHLVGTKKIQQELAKPNVLERFLKSEEEIEKVRKCFAGLWSLDDEDIIKTAVEKPELFVLKPQREGGGNNIYGLDLRETLVRLQKEGGDALAAYILMQRIFPKASPAYLVRGGVCHEGLAISELGIYGAYLRNKDKVVINEQCGYLMRTKVSSSDEGGVAAGFAVLDSLYLTGKVMFQSIDLFTHHFCLDR

SEQ ID NO: 15950 - protein, 692 aa, Onoclea sensibilis
TPSEFQIQDLVEWLLGSSEDIASSGVTCTDSLAEVGYPGAAALGDAVCGMAAARITPNSDFLFWFRSHTAKEVFWGGAEHDPQARDDDSRLLPRSSFKAFLEIVKRRSLPWEEVEVDAIRSLQLILREDLEEFCAAAAAGADGEDVDSLVPSSKKLSLKEREGSGAENSKKLERATSAAVGAAGGTGGRWEKMLLPSSLAQEWMEAIRGTGDGGASGGGGGVPFDWDAISVFQQTSFVVVDALKLDLPIIYASTGFFNLTGYTSREVIGGNCRFLQGPETNPAVIDSIREALVPQGTGTFCGRLLNYRKDGSSFWNLLTIAPIKDDSGTIVNLIGVQLEVSKYTEGSRENRLRPNGLPQSLIKYDVRHQDKVSALIAQLVAALTKPHKVEPPRPSYTMRFSLTGQTIEPLSPGQAAAAARPCSTSDVPQTTSIPREGRGRRRHRSSTFLSLLGMEEKDSEEDQFPEPELIMVADASVGRLRSSDDPERTRRGIDLATTLERIGHSFVITDPRLPGNPIIFASDQFLELTEYSREEVLGENCRFLQGRDTDRKAVQLIRDAVEEGRDVTVQLLNYTKGGRPFWNLFHLQAMRDKKGNLQYFIGVQQETDTPDRVEHEKAKVVRATAQNVDVAARELPDANLTLDHLWERHSKEVTPLPHSKINSPCWYAIRRVQRRLRRGERLGLKHFRPIKP

SEQ ID NO: 15951 - protein, 1242 aa, Oryza sativa
  misc_feature (191)..(191): Xaa can be any naturally occurring amino acid
MAPTAAAAGPSDDGLRKLEYLSLVSKVCSELETHIGVGDKVLAEFITELGRDSASVADFDTKLKANGADLPDYFVRTLLTIIHAILPPPSDSRNPSSASQPAAGGSKFPGPFPAPTTPHRARNLRLELERDAEEAAATAAPAPARDDRGHRRDERGRDRGRDDRGRDDGGRDRDYERGGRDHDRSHGRDRXDHGRDRDRDRACDGDRQRGRDYGRDRDQDRDHDRDREGEWRRDRDKDRGRDIDRDMDRHHRRGRRYDDEEEPEQFGGRKEGALVNSSGEPELYQVYRGRVTRVMDTGCFVRLEDVRGGREGLVHISQMATRRVANAKEMVKRDQEVYVKVVSVKGQKLSLSMRDVDQDKGRDLLPIQRGGDDAPRANPSGGSASGVGVGSGKRLGLSGIMIAEEDEVAPPSRRPLKRMSSPERWEAKQLIASGVLDVRDYPMFDEDGDGMLYQEEGAEEEQEIELNEDEPAFLQGQSRFSIDMSPVKIFKNPEGSLSRAAALQTALIKERREVREQEQRAMLDSIPKDLNRPWEDPMPDTGERHLAQELRGVGLSAYDMPEWKKEAYGKALTFGQRSKLSIQDQRQSLPIYKLKKELIQAVHDNQVLVVIGETGSGKTTQVTQYLAEAGYTTRGKIGCTQPRRVAAMSVAKRVAEEFGCRLGEEVGYAIRFEDCTGPDTVIKYMTDGMLLREILVDENLSQYSVIMLDEAHERTIHTDVLFGLLKQLIKRRSDMRLIVTSATLDAEKFSGYFFNCNIFTIPGRTFPVEILYTKQPESDYLDAALITVLQIHLTEPEGDILLFLTGQEEIDHACQCLYERMKGLGKDVPELIILPVYSALPSEMQSKIFDPAPPGKRKVVVATNIAEASLTIDGIYYVVDPGFAKINVYNSKQGLDSLVITPISQASAKQRAGRAGRTGPGKCYRLYTESAYRNEMSPTTIPEIQRINLGSTVLNMKAMGINDLLSFDFMDPPAPQALISAMEQLYSLGALDEEGLLTKLGRKMAEFPLDPPLSKMLLASVDLGCSDEILTIIAMIQTGNIFYRPREKQAQADQKRAKFFQPEGDHLTLLAVYEAWKAKNFSGPWCFENFVQSRSLRRAQDVRKQLLTIMDRYKLDVVSAGRNFTKIRKAITAGFFFHAARKDPQEGYRTLVENQPVYIHPSSALFQRQPDWVIYHELVMTTKEYMREVTVIDPKWLTELAPRFYKSADPTKMSKRKRQERIEPLYDRYHEPNSWRLSKRRA

SEQ ID NO: 15952 - protein, 161 aa, Xanthomonas axonopodis
MSDISTFAFTDLEGRTQSMRDYAGNVLLVVNVASKCGFTPQYAGLQALWQRYRERGLVVIGFPCDQFGHQEPGDAAQIRQFCSLDYAVDFPLAAKIDVNGNGAHPLWQWLKHEQRGVLGSEAIKWNFTKFLIGRDGRVLERYAPTTKPEALATEIERALDA

SEQ ID NO: 15953 - protein, 564 aa, Xanthomonas campestris
MCSIFGIFGLQPGDDLQALRRQALECSQRQRHRGPDWSGVYVDTGAILVHERLAIVDPAGGSQPLLSDDGQLALAVNGEIYNHRELKAELLQPYAFQTGSDCEVINALYREDTPASYLNRLNGIFAFALWDKTEGRVIIARDPIGVVPLYWGHDREGRLRVASELKSLVDDCADAAQFPPGHWYDSATGALSRYYERAWRHYDAVEGVQVQLQELREAFERAVHRQLMTDVPYGVLLSGGLDSSLVAAVAARYARHRIEENDTTEAWWPRLHSFAIGLKGSPDLAAAEVAAAALGTVHHGFEYTFDEGLDALPDVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDARFKMIDKTSGGAARMEKGVLREAFAGYLPESILWRQKEQFSDGVGYGWIDGLKAHAQAQVSDRELAAADRRYPVNPPQTKEAYFYRSLFEQFFPGQAAAETVPGGKSIACSSPTAIAWDASFAAMADPSGRAIAGVHAQALAS

SEQ ID NO: 15954 - protein, 321 aa, Trichoderma atroviride
  misc_feature (59)..(59): Xaa can be any naturally occurring amino acid
MLIFGIIQIVTSQIPNFHNMAWLSVVAALMSFCYSFIGLGLGFSKVIENRGYQGKHCGXTSAWTYSGNFKGPASTQQGRETFAKSSLELLKNLGFDGLDIDWEYPQNADEARNFVELLATVRRELDAYSATLQNYSHFELTVACPAGPTHFQKLDVPGMDQYLDFWNLMAYDYAGSWDQTSGHQANLHPSHDNPTSTPFSTDAAIDFYTRNGVAPSKIVLGMPIYGRAFENTDGPGRPYNGMVRGRGRMASSTTRFFLSRVLKRFMIKRLAPATAITHKQGSLCPTTPLMPAESRLGISKSGVLEVACGGRAAETKKAMTA

SEQ ID NO: 15955 - protein, 160 aa, Brassica napus
MATSASALLTPTTFSTVISQKNPNSISFHGLRPLRLGGSSSSLPKLSTTAGRRSSSAVVRAELSPSVVISLSTGLSLFLGRFVFFNFQRENVAKQVPEQNGKTHFEAGDDRAKEYVSLLKSNDPVGFNIVDVLAWGSIGHIVAYYVLATSSNGYDPSFFG

SEQ ID NO: 15956 - protein, 742 aa, Unknown
  Synechococcus sp. PCC 7002
MDQRKTKTLCPYCGVGCGLEVSEVIKNEQPTLKVMGDRQHPSSLGKVCVKGATIAESLDQDRLLYPMYRRSLQDQFQRISWDDAFELIVEQIKTVKATLGSEGIAMYGSGQLQTEDYYTAQKLLKGCLGTNNFDANSRLCMSSAVAGYIQSFGADGPPPCYEDLELTDCAFIIGSNTAECHPIVFNRLREHHKRSKAKLIVVDPRRTKTAEVADLHLAIKPGTDIDLLNGIAHLLLKWGKIDTLFIDECTKGFSKYAMLIQSYTPETVARRCGIRIDHLEQAAKYWANADNVLSLWSMGMNQSAEGTAKVRTLINLHLMTGEIGKPGAGPFSLTGQPNAMGGREAGGLAHLLPGYRLVKNPEHRATLEKAWQLPPGTISPLPGKDAWAMIEGLDMGTVGLLWVVATNPAVSMPDLERTKAALLKSPFTICQDAYYPTETSNYAHLLLPALQWGEKTGAMTNSERVVTYCPQFRDRPGEAWADWEIFAEVGRRLGFQQQFRAVSSAEVYAEFVQLTGDRPCDMTGLSHQRLATEGPIQWPCPANETKCDPETTADNRGLLQKLFHQDEPLKGKRLYTDRRFHTPDGRARFAAYHSRGLAEPPNTDYPFVLTIGRLYGHWHTMTRTGRIKKIQKMHPNPFLEIHPRDADRLSITDGEMVEVRSPRGMARFPALITKNITPGTVFAPMHWGALWGEDTEANALSHAEACPDSLQPELKACAVNVQKITGPVPQEKATAEPVLQQL

SEQ ID NO: 15957 - protein, 473 aa, Parvularcula bermudensis
MTEEMTRELTFRQNVNMMFDRATTYLDIDEGLKHKIKICNSVYTVRFGVKLRGSIHTFTGYRAVHSEHMEPVKGGIRYALSVNQDEVEALAALMTYKCALVRVPFGGSKGGLCIDPTQWDADELERITRRFTYELAKRDLIHPSQNVPAPDMGTGEREMAWMADAYKRMHPTDIDAMACVTGKPPHAGGIRGRVEATGRGCQYALQSFFSFPEDVAACGLDGGIEGKRVIVQGLGNVGYHAAKFLSEEDGAKIVGVIERDGAILHDDGIDIEEIKHFLTRNGGIKGYPHGKYIEDGLSALTADCDILVPAAIEGVINGANAADIKARIILEAANGPVTANADTILREKRVEVIPDLYTNAGGVTVSYFEWVKNLSHMRFGRMQRRAEEKRAMALITELERATGQPLNDQFKARFAQGDQEIDLVRSGLDDTMRTAYARMRQTRVTTKGIEDMRTAAYATALTDIAKSYESLGL

SEQ ID NO: 15958 - protein, 113 aa, Unknown
  Frankia sp. CcI3
MTKLVTAVIKPFKVDDVKAALETLGVHGLTISEVQGYGRQKGHTEVYRGAEYKVDFVPKIKIEVVVADGAVDDLVAAITSSAQTGKIGDGKIWVVPVESVVRVRTGERGADAL

SEQ ID NO: 15959 - protein, 379 aa, Nicotiana tabacum
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLVPKKDKVVSPPNELVDTNNPRIYPDFTWPTLLEFTQKHYRADMNTLQTFSNWLKQKTAQV

SEQ ID NO: 15960 - protein, 133 aa, Arabidopsis thaliana
MDTKKKSKEHGLYRIVNTIGYAFGAGAVGGSVYHFVRGAYNSPIGARYVGGTQAASMNAPRLGGTFAVFGGLLSTFDYSLVRIRKKEDPWNSIVAGAATGGVLSIRKGVVAASTSAVMFGFFLAVLNPPFGSK

SEQ ID NO: 15961 - protein, 236 aa, Chenopodium rubrum
MTRRYWNINLEEMMEAGVHFGHGTRKWNPRMSPYISAKCKGIHIINLTRTARFLSEACDLVFDASSRGKQFLIVGTKNKAADSVARAAIRARCHYVNKKWLGGMLTNWSTTETRLYKYRDLRMEQTAGRLARLPKRDAAVVKRQLSHLQTYLGGIKYMTGLPDIVIIVDQHEEYTALRECITLGIPTICLIDTNCDPDLADISIPANDDAIASIRLILTKLVFAICEGRSSYTRNP

SEQ ID NO: 15962 - protein, 136 aa, Bacillus anthracis
MSIEVGSKLQGKVTGITNFGAFVELPEGLTGLVHISEVADNYVKDINDHLKVGDQVEVKVINVEKDGKIGLSIKKAKEREKTEGDRPRGEYQRGGDQQRSGRPQRNRSFNRDNRGGGNDRAPKKHGAKNGTFLNDS

SEQ ID NO: 15963 - protein, 712 aa, Oryza sativa
MSGAGAGEAGVRTVVWFRRDLRVEDNPALAAAARAAGEVVPVYVWAPEEDGPYYPGRVSRWWLSQSLKHLDASLRRLGASRLVTRRSADAVVALIELVRSIGATHLFFNHLYGSIDPEFQIDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSL

SEQ ID NO: 15964 - protein, 385 aa, Tropheryma whipplei
MSIIRSERYSAIFLLCSAALAIIFANVLDPDTWHAVHSAVSEYHIFGLITPHDIVADFLLAVFFFAVAIELKHELVKGELSSFSKAIIPGVCAAGGILVPISIYLSVASVLPNGWPVPTATDVAFSLGILAIFGSSLPSKVRIFLLALAVLDDLAGIVIIATAFSVSISYWWIIVACITVGLFGFCSYRLARCKTSKTFLIIPAMLLCALAAWVSVYQSGIHATIAGVMLGIMLNRKQGAAIEHALEPYINGIILPAFAFLAAMVRVPHLPLDEISPALWGILLGLLFGKLLGISVFGIIALKFFRKKSISFFNLLVVSALGGIGFTVSLLMNELAFLGTPVHEQGVIAVLIGSLLSAILAIILMRCYKGRKSKSLPGTKGRVSH

SEQ ID NO: 15965 - protein, 362 aa, Lotus japonicus
MKNPKRHPSESSLRRVTSEETVTGLKNAHRRRLKIRRMKYSCQAKINAGDGDFPPSGKERREIHESVQISLSLANSSSSSSSEEDRERKRDDGVLPYGSVSVVGSRKEMEDAVSVETGCVTKCDYFAVFDGHGGAQVAEACRERLYRLVAEEVERCGNGVEEVDWEEVMEGCFRNMDGEVAGNAALRTVGSTAVVAVVAAAEVVIANCGDCRAVLGRGGEAVDLSSDHKPDRPDELMRIEEAGGKVINWNGQRVLGVLATSRSIGDQYLRPYVISKPEVTVTKRSSKDEFLILASDGLWDVISSEMACQVVRKCLNGQIRRICNENQSRASEAATLLAEIALAKGSRDNTSVIVIELRGTVT

SEQ ID NO: 15966 - protein, 441 aa, Salmonella typhimurium
MYHGQLKNILLLSLRFIMDKLSYASDSSTSAWNTYLQQIERVAPYLGELSPWVDTLRHPKRALIVDIPVQMDDGTIRHFEGYRVQHNLSRGPGKGGVRYHPDVDLNEVMALSAWMTIKCAALNLPYGGAKGGIRVDPFSLSEGELERLTRRYTSEIGIIIGPQKDIPAPDVGTNGKVMAWMMDTYSMNHGTTVTGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 15967 - protein, 92 aa, Triticum aestivum
  misc_feature (14)..(14): Xaa can be any naturally occurring amino acid
  misc_feature (73)..(73): Xaa can be any naturally occurring amino acid
MAFSMLSFGTMAAXSAAQATMVAHFNGLMSSAVFPATATANNDTTCMTSNGGRGNCMQVWPTIVKKKIETLSXLSDPTDSAWAYEVDYLIRN

SEQ ID NO: 15968 - protein, 609 aa, Arabidopsis thaliana
MDTPEKSETQIGTPVSKLKVEDSPVFSYICNLSPIKTIKPIPITCPLSSLNYASPPSVFTSPHAVSHKESRFRSQKDVSASKEVGEEEALVGSEPEQSYKNDCNTPRVLNDVKDNGCGKDLQVMMDNVKKKSDTPDWETLIAATTELIYGSPRESEAFSCLLKKTSNSEARLRGSITATSVAVTNTDVVNNESESVDALSILHRGVRRRCLDFEVKGNNQQTLGESSSSCVVPSIGLHLNTIAMSSKDKNVANEYSFSGNIKVGVQSSLTPVLHSQHDIVRENESGKDSGQIIEVVPKSLASVDLTPISPKKKRRKSEQSGEGDSSCKRCNCKKSKCLKLYCECFAAGFYCIEPCSCINCFNKPIHKDVVLATRKQIESRNPLAFAPKVIRNSDSIIEVGEDASKTPASARHKRGCNCKKSNCLKKYCECYQGGVGCSINCRCEGCKNAFGRKDGSLFEQDEENETSGTPGTKKTQQNVELFKPAAPPSTPIPFRQPLAQLPISSNNRLLPPQSHFHHGAIGSSSSGIYNIRKPDMSLLSHSRIETITEDIDDMSENLIHSPITTLSPNSKRVSLSHLDSPESTPWRRNGEGRNLIRSFPTFPSLTPHH

SEQ ID NO: 15969 - protein, 356 aa, Callistephus chinensis
MAAPISLKWEEHSLHENKFVRDEDERPKVPYNTFSNEIPVISLAGIDGCRRAEICDEIVKACEDWGIFQVVDHGVDTKLLSDMTGLARDFFHLPTQEKLRFDMTGGKKGGFIVSSHLQGEAVQDWREIVTYFSYPIKARDYSRWPDKPNEWRAVTEEYSKVLMGLACKLLEVLSEAMGLEKEALTKACVDMDQKVVVNYYPKCPQPDLTLGLKRHTDPGTITLLLQDQVGGLQATRDGGESWITVKPVEGAFVVNLGDHGHYLSNGRFKNADHQAVVNSSTSRLSIATFQNPAPEAIVYPLKINEGEKSIMEEPMTFMEMYKKKMSTDLELARLKKLAKDKQQDLEVVKPIQNIFA

SEQ ID NO: 15970 - protein, 451 aa, Neisseria meningitidis
MSEYTPQTAKQGLPALAKSTIWMLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 15971 - protein, 365 aa, Dianthus caryophyllus
MVAEKPKTLTSLEGDDKLNSNFVRDEDERPKVAYNEFSNDIPVISLAGIDGEKRGEICRKIVEACEDWGIFQVVDHGVGDDLIADMTRLAREFFALPAEEKLRFDMSGGKKGGFIVSSHLQGEVVQDWREIVTYFSYPTNSRDYTRWPDKPEGWIKVTEEYSNKLMTLACTLLGVLSEAMGLELEALTKACVDMDQKIVVNYYPKCPQPDLTLGLKRHTDPGTITLLLQDQVGGLQATRDGGKTWITVQPVPGAFVVNLGDHGHFLSNGRFKNADHQAVVNSECSRLSIATFQNPSPDATVYPLAIREGENSIMEEPITFADLYRRKMAKDLEIARHKRLAKEEMPFKELDEAKFESKSIDQILA

SEQ ID NO: 15972 - protein, 129 aa, Cucumis sativus
IYKAQASALEKHAAANCKVLVVANPANTNALILKEFAPSIPERNISCLTRLDHNRALGQISERLNVQVSEVKNVIIWGNHSSTQYPDVNHATVKLSSGEEKSVRELVADDAWLNGEFISTVQQRGAAII

SEQ ID NO: 15973 - protein, 357 aa, Matthiola incana
APGTLTELAGESKLNSKFVRDEDERPKVAYNEFSDEIPVISLAGIDDVDGKRGEICREIVEACENWGIFQVVDHGVDTSLVADMTRLARDFFALPPEEKLRFDMSGGKKGGFIVSSHLQGEAVQDWREIVTYFSYPVRNRDYSRWPDKPQGWAKVTEEYSEKLMGLACKLLEVLSEAMGLEKESLTNACVDMDQKIVVNYYPKCPQPDLTLGLKRHTDPGTITLLLQDQVGGLQATRDDGNTWITVQPVEGAFVVNLGDHGHFLSNGRFKNADHQAVVNSNSSRLSIATFQNPAPEATVYPLKVREGEKAIMEEPITFAEMYKRKMGRDLELARLKKLAKEEHNHKEAAKPLDQILA

SEQ ID NO: 15974 - protein, 313 aa, Bacillus anthracis
MLGVTGMRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSVERRNLLRAYGAELVLTPGPEGMGGAIRQATELAKEHGYFIPQQFKNQSNPEIHRLTTGPEIVEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 15975 - protein, 369 aa, Unknown
  Petunia x hybrida
IPRVTPSTLTALAEEKTLQTSFIRDEDERPKVAYNQFSNEIPIISLEGIDDETGKRAEICDKIVKACEDWGVFQVVDHGVDAEVISQMTTFAKEFFALPPEEKLRFDMSGGKKGGFIVSSHLQGEVVQDWREIVTYFSYPTRARDYSRWPDKPEGWIAVTQKYSEKLMELACKLLDVLSEAMGLEKEALTKACVDMDQKVVVNFYPKCPEPDLTLGLKRHTDPGTITLLLQDQVGGLQATKDNGKTWITVQPVEGAFVVNLGDHGHFLSNGRFKNADHQAVVNSNSSRLSIATFQNPAPEAIVYPLKIREGEKSIMDEPITFAEMYRRKMSKDLELARLKKQAKEQQLQAEVAAEKAKLESKPIEEILA

SEQ ID NO: 15976 - protein, 72 aa, Campylobacter lari
MAKDDIIEIDGNVIEALPNATFKVELDNKHVILCHIAGKMRMHYIRIMPGDRVKVELTPYSLDKGRITFRYK

SEQ ID NO: 15977 - protein, 178 aa, Unknown
  Rosa hybrid cultivar
ECALWMPTRTALEQQLSYTLHQQNPVGHTVPIHLPVINQVFSSNHAVKISPNSPVARLRPRAGNHMPGEVVAVRVPLLHLSNFQINDWPELSTKRYALMVLMLPSDSARQWHMHELELVEVVADQVAVALSHAAILEESRRARDLLMEQNIALDLARREAETAICARNDFLAVMNHEM

SEQ ID NO: 15978 - protein, 363 aa, Prochlorococcus marinus
MNENSSQTIKEISEDQEIKNSSELDNNSASQNEEDLSFEKSDIPQADSSSSRTNTDFDNAGFTQEEFASLLGKYDYNFKPGDLVKGTVFALEPKGAMIDIGAKTAAFMPVQEVSINRVEGLNDVLQPSESREFFIMSEENEDGQLALSIRRIEYQRAWERVRQLQKEDATIYSEVFATNRGGALVRVEGLRGFIPGSHISARRIKDDLEGEYLPLKFLEVDEERNRLVLSHRRALVEKKMNRLEVGEVVVGSVKGIKPYGAFIDIGGVSGLLHISEISHEHIETPHNVLNVSDQMKVMIIDLDSERGRISLSTKALEPEPGDMLTDPQKVFSKAEEMAAKYKQMLFEQTDENEEIATASAETL

SEQ ID NO: 15979 - protein, 179 aa, Unknown
  Rosa hybrid cultivar
ECALWMPCRSGMNLQLSHTLNYEAHIGSTVPFSLPIVSEVFKSSRAMRIPYTCPLVRIRPLVARYVQPEVVALRVPLLNLSNFQINDWPDVSAKSYAIMVLILPTDSTRKWRDHELELVDVVADQVAVALSHAAILEESMRASDQLVEQNGALDLARREAELAIHARNDFLAVMNHEMR

SEQ ID NO: 15980 - protein, 108 aa, Dechloromonas aromatica
MSEHIHYVTDDTFEAEVLQSQQPVLVDYWAEWCGPCKMIAPILDEVATEYAGKLKVAKVNIDDNQATPAKFGIRGIPTLMIFKNGNVEATKVGALSKSQLAAFIDSNL

SEQ ID NO: 15981 - protein, 92 aa, Arabidopsis thaliana
MASSMLSSATMVASPAQATMVAPFNGLKSSAAFPATRTANNDITSITINSGRVHCMHVWPPIGKKKFETLTHHPDLTDSDLAIEVNYIIRIN

SEQ ID NO: 15982 - protein, 604 aa, Zea mays
MQGLAPPTSVSIHRHLPARSRARASNSVRFSPRAVSSVPPAECLQAPFHKPVADLPAPSRKPAAIAVPGHAAAPRKAEGGKKQLNLFQRAAAAALDAFEEGFVANVLERPHGLPSTADPAVQIAGNFAPVGERPPVHELPVSGRIPPFIDGVYARNGANPCFDPVAGHHLFDGDGMVHALRIRNGAAESYACRFTETARLRQERAIGRPVFPKAIGELHGHSGIARLALFYARAACGLVDPSAGTGVANAGLVYFNGRLLAMSEDDLPYHVRVADDGDLETVGRYDFDGQLGCAMIAHPKLDPATGELHALSYDVIKRPYLKYFYFRPDGTKSDDVEIPLEQPTMIHDFAITENFVVVPDHQVVFKLQEMLRGGSPVVLDKEKTSRFGVLPKHAADASEMAWVDVPDCFCFHLWNAWEDEATGEVVVIGSCMTPADSIFNESDERLESVLTEIRLDARTGRSTRRAVLPPSQQENLEVGMVNRNLLGRESRYAYLAVAEPWPKESGFAKEDLSTGELTKFEYGEGRFGGEPCFVPMDPAAAHPRGEDDGYVLTFVHDERAGTSELLVVNAADIRLEATVQLPSRVPFGFHGTFITGQELEAQAA

SEQ ID NO: 15983 - protein, 501 aa, Photorhabdus luminescens
MSSEFCFVKYGFDKNLNKLINEFQFDELSTGTILFRSTTKVSKFKSERYTAFLIGNIYNISTIRSILGKIEGRSSVLSDVEILLLSRDKFGNSIISIAEGDYCLFIEDKKGNIEVITESRGLNLVNLVQTDLIWITNSLKIVGKVEGDKAFDFKPESEVIKNSLKPDNFSPIRNVSRLKPGTINKLTFDEQRYLHLEVEYVISPVEENSFDIKESVLLEIIDSDLRNSISRLSKNNETIGVPLSGGLDSSLVTALASKYFDKVKTWSIGTELSNEFEFSKIVSDYLGTEHEVKILSEDEVISGVVKAIYYNEIFDGLSSEIQSGLFNVYELAKGKVNSLITGYGSDLLFGGILDPEKSYIEPNKILSEQVYRTKWTGEFSTHGAGNYGLNVYHPFWTNNLISLCHNLDPYFKIRDNEVKNILREYANSINILPKEIVWRKKIGIHEGSSVNKSFATMIGTEVNNYQDKTRFSYSIYKEFLTGRLSIEEANSTKLCEIIRRN

SEQ ID NO: 15984 - protein, 300 aa, Archaeoglobus fulgidus
MYDVAIIGGGPAGLTAALYSARYGLKTVFFETVDPVSQLSLAAKIENYPGFEGSGMELLEKMKEQAVKAGAEWKLEKVERVERNGETFTVIAEGGEYEAKAIIVATGGKHKEAGIEGESAFIGRGVSYCATCDGNFFRGKKVIVYGSGKEAIEDAIYLHDIGCEVTIVSRTPSFRAEKALVEEVEKRGIPVHYSTTIRKIIGSGKVEKVVAYNREKKEEFEIEADGIFVAIGMRPATDVVAELGVERDSMGYIKVDKEQRTNVEGVFAAGDCCDNPLKQVVTACGDGAVAAYSAYKYLTS

SEQ ID NO: 15985 - protein, 156 aa, Lactobacillus plantarum
MANYIKEIRALVGHKPIILNTAAGILVNDQQQVLLNLRTDTHNWSLPGGYLEYGETYATTCLREYKEDSGIDVEVVDRIGIFDKGETAYPNGDVAQTISALFLVKPIGGHVLTQATDETLKLDYFDFDNLPPLLNQQNADMIHAAQEYLQTHSATK

SEQ ID NO: 15986 - protein, 183 aa, Karenia brevis
MQAIALVLTYLACAAQARRVRDDPRLVNLEAVNKLGELLLALNPAQEAAFNPSVPSFRASARVPVSSFLKTADAMVVTKSPARAGAPEMFTVTLETPDGTETIDCDEESYILDVAEEAEIELPSACRAGSCSSCAGIITEGTVDQSEGSFLEDDQIEKGFCLTCISYPTSDCTIKTHQEEELF

SEQ ID NO: 15987 - protein, 424 aa, Arabidopsis thaliana
MPTFSAIALDRMLEPGASTSVESVPSTTNLFYSKPPISKLEKGKGKLPNERTVTRPLMSPALYATPDAIPLPNSPSSFPPSPYIINHKSRGPPRLLKSSSEANVVSSSHQKTLEEETITAETDVKVSPRRRSTSFSFPITEVTEDDYSNGVHARTVGNYNFDGIVDGPVGNWSPLDGKSGNGKSELDNAANGLERVNGLSEPVPIKTDKESESEDFYDPGESASFTSNTDVEGDAGDESSQRLATPVGEFYDAWDELSTDSGMQSSVNNIESELSEIRLSLLMEIEKRKQTEEALEQMQIHWQRLREQMAQVGLFVPIDPTASTNNMNLSEELRCQLEIARFVSDSLGRGMAKAEVEMEMESMLETKNFEITRLSDRLHYYEAVNREMSQRNQEAIGSRKSLSFTKFIHCHFLSYNKNLISQLC

SEQ ID NO: 15988 - protein, 224 aa, Brassica napus
REDSSLAHITTRCGILAVLGCIDNSQAKRSRIIELSRRLRHRGPDWSGLHSHEDCYLAHERLAIIDPTSGDQPLYNQDKTVVVTVNGEIYNHKILREKLKSHQFWTGSDCEVIAHLYEEHGEEFIDMLDGMFAFVLLDTRDKSFIAARDAIGVIPLYIGWGVDGSVWFASEMKALSDDCEQFMAFPPGHIYSSKQGVLRRWYNPPGYSELVPSTPYDPLVLRKA

SEQ ID NO: 15989 - protein, 359 aa, Arabidopsis thaliana
MDNFLPFPSSNANSVQELSMDPNNNRSHFTTVPTYDHHQAQPHHFLPPFSYPVEQMAAVMNPQPVYLSECYPQIPVTQTGSEFGSLVGNPCLWQERGGFLDPRMTKMARINRKNAMMRSRNNSSPNSSPSELVDSKRQLMMLNLKNNVQISDKKDSYQQSTFDNKKLRVLCEKELKNSDVGSLGRIVLPKRDAEANLPKLSDKEGIVVQMRDVFSMQSWSFKYKFWSNNKSRMYVLENTGEFVKQNGAEIGDFLTIYEDESKNLYFAMNGNSGKQNEGRENESRERNHYEEAMLDYIPRDEEEASIAMLIGNLNDHYPIPNDLMDLTTDLQHHQATSSSMPPEDHAYVGSSDDQVLDWL

SEQ ID NO: 15990 - protein, 384 aa, Oryza sativa
MALALRPPRFQPLPAPIPASTASTTALAARPSSSAHAIICAAAASPFTEATSSSRYRRDAWSYAASDGDSSSSSAAAAAAAASSGRRDDEIALQLPELRRLLEALRASRGRGAEGEGGGGGPGRVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIRVEVIPGITSASGIAAELGIPLTHRGVATSVRFLTGHSRNGGPDPLYVAENAADPDTTLVVYMGLSTLPSLAPKLMKHGLPPDTPAVAVERGTTPQQRMVFAMLKDFVNEVKSEDLVSPTLIIIGKVVALSPFWIDSSKQGAQSIENLYAAETKR

SEQ ID NO: 15991 - protein, 225 aa, Arabidopsis thaliana
MAAAARNYQKEVLANEKAQGSNPVNEEVDLDELMDDPELERLHADRIAALKREVEKRESFKRQGHGEYREVSEGDFLGEVTRSEKVICHFYHKEFYRCKIMDKHLKTLAPRHVDTKFIKVDAENAPFFVTKLAIKTLPCVVLFSKGVAMDRLVGFQDLGTKDDFTTNKLENVLLKKVREFLLKECKSLTGMLSKKKKEEDDEDAEYQESIRRSVRSSENLDSDSD

SEQ ID NO: 15992 - protein, 657 aa, Sulfolobus solfataricus
MEVRKTICPFCGVGCGLDFYVENNFIFRVSPSQEHIVSRGHVCGKGAVASEVIYAWDRLTYPLKRVKDTFVRTTWDEAISDIASKLKEIRSKYGSEAIAFYGGCQNTLEEGYSFMKLARALGTNNVDSCARVCHEPSAMALKELVGIGASSVTVSEILNARNIVISGESVTDSHPVLSQYLVEAKRKGVKIVVIDPRMTGTARIADLFLQISSGTDIYLYNAVANYLISNGLYDSKFVKERVENFDEFREIVKSYTIEEAERITSVSKDKIIEFARIIANKPTILSWGLGLTQSSGVNAVKAYINLALLTGNVGINGGGLLVYRGQTNVQGSGDLIKPDVFPNGPMNEENAKELSKIWGFVPPIKKGLSITEAFLRDSNVKALFLMNYNPAFSLPNRYKVIKFLKSLELLVVMDPFMTETAKYAHYVLPTPLWAEKEGSVTNLDRTVKWRFKVVDPPGEVRSELWIIKRIAEKLGLTGFHDDPKLVFKEIKEVAKLYSNLTLDELMDYSVDSRYPDHESSLYKDRFMTPSGKAKFGLVRYNEISGDSYILITGRVVTRYNSDELIKRVPGYRNFSSDLLINPEDATKLNIKDGDMVKVVSKCGMAVMKAKLTNEVKVGHTFAYMHDYYVNNVVCDDLDDISKTPRYKITFVKIEKLG

SEQ ID NO: 15993 - protein, 426 aa, Tannerella forsythensis
MKRDSVIFEIIERDHQRQLKGIELIASENFVSEQVMQAMGSYLTNKYAEGYPGKRYYGGCEVVDESENLAIERLKKLFGAEWANVQPHSGAQANAAVFLAVLNPGDTFLGLNLSHGGHLSHGSPVNSSGILYRAVEYNVKEDTGRVDYEQMEEVALREKPKLIVGGASAYSRDWDYARMRAIADKVGALLMIDMAHPAGLIAAGLLNNPLPHAHIVTSTTHKTLRGPRGGVILLGKDFENPWGKKTPQGEIKTMSQLLDSAVFPGIQGGPLEHVIAAKAVSFGEALEPEYKTYQTQVKKNAAVMAQAFIDKGYKIISGGTDNHSMLIDLRTKFPELTGKVAEKALVAADITVNKNMVPFDSRSPFQTSGIRIGTPAITTRGVKEPLMGEIVEMIDTVLSNPESETTIASVRSKVNQTMKDYPLYAW

SEQ ID NO: 15994 - protein, 324 aa, Rhizobium leguminosarum
MPARHTKVLIIGSGPAGYTAAVYAARAMLKPVLIAGLEQGGQLMITTDVENYPGFADPIQGPWLMEQMLQQAKHVGAEIVNDLVTEVDMNQRPFVARTDSGQVWTADTLIIATGAKAKWLGIESEQHFQGFGVSACATCDGFFYRNKDVIVVGGGNSAVEEALYLSNIAKSVTVVHRRDFFRAEKILQERLFSKDNVKVLWNTEVAEITGTPAKPPMPQSVSGARLRDVRTGTITEMVIDGVFVAIGHAPATELFKDKLKLKDNGYLWTAPDSTATSLDGVYAAGDVTDDTFRQAITAAGLGCMAALEAERYLTGHMPVAVAAE

SEQ ID NO: 15995 - protein, 269 aa, Oryza sativa
PCIVLCFQEKFKSIKPNDDNTVFNALSFSAPKIRLLRSLTIEKKNSYQVLDFAAFSEPEYDLPIFCANVFTTHAQSIVVLDLNPLYDTTVHKDYKDKYYRSIMPLVHKYNELLPWGGKITSESLKFFSPIVIWTIFESTEHNHHVLHSAFVDYYKVWLELMDQAIKENNKATIARNQEEQHKYLTWRAEKDPGYPLLKKLIGESRAEDLVMEFLFEGVNTLGTKSFLDYFPEYARDDGSVNKKRSMIGKSFETRPWDANGEFIGDAEAQ

SEQ ID NO: 15996 - protein, 325 aa, Deinococcus radiodurans
MTAPTAHDYDVVIIGGGPAGLTAAIYTGRAQLSTLILEKGMPGGQIAWSEEVENFPGFPEPIAGMELAQRMHQQAEKFGAKVEMDEVQGVQHDATSHPYPFTVRGYNGEYRAKAVILATGADPRKLGIPGEDNFWGKGVSTCATCDGFFYKGKKVVVIGGGDAAVEEGMFLTKFADEVTVIHRRDTLRANKVAQARAFANPKMKFIWDTAVEEIQGADSVSGVKLRNLKTGEVSELATDGVFIFIGHVPNTAFVKDTVSLRDDGYVDVRDEIYTNIPMLFAAGDVSDYIYRQLATSVGAGTRAAMMTERQLAALEVEGEEVTAAD

SEQ ID NO: 15997 - protein, 431 aa, Pyrobaculum aerophilum
MEPYKKAITINEALKRGEGRVTLRGWVYRKRVLKEKAFILLRDSTGVIQLVFPRERLKDAEELNLESSIVVTGALVREPRAPGGVELHVESVDWAYIGEPYPINEDAVVADSEYLLDVRHLWVRSRKMQAVLKIRHTIFGAIHEYFRKNGFYEVHTPMFITAAVEGGATLFKVDYFGQPVYLTQSSQFYLEVLIYSLEKVYVIAPSFRAEPSRTRRHLTEFWHAEMEMAWAGMNDAARVGEELISYVVERVLAERQDELRLLGRRTEFLERAKPPFYRVSYDEAVDILRKKGISINWGDDIGADEERALTLEFDKPIILYGFPEKLKAFYHRNDPKRPEVTLSFDVLLPEGYGEVIGGGERIYEEKELVEKIVRFGLNPKDYWWYIDLRKYGSVPHAGFGLGVDRLTMWITGADHIRDVVPFPRDVRRTAP

SEQ ID NO: 15998 - protein, 629 aa, Deinococcus radiodurans
MQHRYQARPGAFQREGFRPGGQEFMEDNTQTPAVNGGTQPTTGDTSTQQAEGTQLDQETQSHQGALNAQTEQAQTEVSQGEQARQQEQAAKTQAQEERDYPEMTMEDILAAEAQEPQSVTRGDIVDGTVVFIGQEGIAVDIGAKVEGVIPLNQLGEEPVTLEQAQEMYKPGDAIEAYVVRVDLPNSQIVLSKKRAEQDKGWRVLERMQEADEAFEVEVLEKVRGGLVAQVEGIRAFLPASQVDTRRVNDLDPYVGKPLMVKLIELNRKRNRVIISHRAIMEAEKAKAREATVGQLEPGAVFEGEVVEITDFGVFVNLGGIDGLVHRSELTYGRFNHPRDVVKVGDKVQVQVIDVDEGRERINLSMKALTQDPWEGATERYHIGQRVKGKVTNLTNFGAFIELEPGLEGLVHVSEMSWTKRVRHPNEVMKEGDEVEAVILRIDPRERRISLGIRQTTDDPWSALPDRYPPGTPVKGKITGMTDFGVFMEIEEGIEGLIHISELDTQRVNNPADLFKKGDEIEAVILNIDPVEQRASLSRRRFLGGGPVPQRGEGGQRDYVSQGGGSRRDSTFGGGQRGGRGGRGGADYAYNAKDAQQGGKISTKLGDVYADLFAQFGLGNDKKDEGSSEE

SEQ ID NO: 15999 - protein, 112 aa, Unknown
  Synechococcus sp. WH 8102
MKKVEAIIRPFKLEDVKVALVEAGIIGMTVSEVRGFGRQKGQVERYRGSEFTVEFLQKLKIDVVVDDERVDDVVKAIADAARTGEIGDGKIFISSVDSVVRIRTGDRDSSAL

SEQ ID NO: 16000 - protein, 329 aa, Oryza sativa
  misc_feature (124)..(124): Xaa can be any naturally occurring amino acid
  misc_feature (202)..(202): Xaa can be any naturally occurring amino acid
  misc_feature (225)..(225): Xaa can be any naturally occurring amino acid
MAIPTKEEVEQNEEDNTFSRLQLLAQQRHAMEEFWRRSQEQIEASAGNHEHILPIDCVKNVIRPKNDAMMLSADTPTFVTKLCELFVQELTLRAWVCANSHNRDIILGTDIAEAITTTESYHFXLGNVLRSHKALGSTAPDIDTSARKHIKLDQMTSLYHPTQEMQASRLAGYPPHVPIYPPIGQMGTQHKLSPFAFMMQGXESLLNMKRENSLVNEVMVCTNKXSINNFDGATSIGGGSSSDVAIVVQQGETTHPFSSQNACPSLEDNYVVPMPTGHVQSFSPPTNINVKKLHQEEKNIYSQDVAEEDMSNESLEGSQKDEDLFLHEK

SEQ ID NO: 16001 - protein, 401 aa, Aspergillus oryzae
MSFSLPETFAKLPRYPLLYPYPSPIHPLPALTRHLNHNPRSAPAVSLFAKREDHSSPLACAGNKYRKLEYIVPDILSNSSLHGPGERSEAKATTTLVTEGAIQSNHTVQVASVARRLGLEAIVILHKATGGGLTASSDKDVFLRTGNVQIARLLGAEVRMLEDSSTVDNSDPITPILEGLRAQGKVPYWIPSGASLHPLGGLGYARCAFEIAAQEKEQLGENGRFDYVFVACGSGSTVGGLIAGFKLLQKIEAQRQDENAERVIGRKVIGILNSPTKPREYHEGRVLNFARRAAYLIGLDPERDVTPEDVQLDDRFAGTAYGELDQTSKKTLAFLAQEEGVIVDPVYTVKVMRGVMHWVQVGELIRDWSRRLESSPSEGRVNALFIHTGGQSALSAYADIE

SEQ ID NO: 16002 - protein, 575 aa, Oryza sativa
MASLPAPPTPLGSCPRGRGGGRVVARPRRAGLACAARSCYRFRTDDDGVVDVAVSGEDGDGGGGGYAVSRRVLRASGSGEGVPLAPAAGGASLAAELSFDPTRAPFYLSFLLTDASGAEIRTHRKTSFRVPVGVGPGSPAPLGMSISGDGAVNFAVYSKNANAVSLYLYAAAVGGGGGDEPALEIDLDPYIHRTGNVWHVSLASVDGYVSYAFCCGGIRRPLLDPYAKVIGDFVSSNSVYDEGVTAPSMRCFASLAIAPSYNWGRDRHPRLPLEKLVVYRANVALFTKDRSSGLPDDAAGTFTGLSAKVEHFRSLGVNAILLEPVFPFHQVKGPYFPYHFFSPMNLYSSKGLSVSAIKSMKDMVRVMHRNGIEVLLEVVFTHTAEGESECQTISMRGIDNSSYYIANGIAGCKASILNCNHPVTQKLILDSLRHWVLDFHVDGFCFINAPFLVRGPGGEYLSRPPLLEAITFDPVLSMTKIIADPWSPLDISNVQFPFPHWKRWAEVNTRFSIDVRKFLKREALISDLATRLCGSGDLFSTRGPAFSFNHVSRNSGLSLVDLKVHQRTVLSFRQG

SEQ ID NO: 16003 - protein, 112 aa, Streptomyces avermitilis
MKLITAVVKPHRLDEIKEALQAFGVHGLTVTEASGYGRQRGHTEVYRGAEYTVDLVPKIRIEVLAEDDDAEQLIDVVVKAARTGKIGDGKVWSIPVDTAVRVRTGERGPDAL

SEQ ID NO: 16004 - protein, 479 aa, Unknown
  Mycobacterium sp. MCS
MPSPVATSPQVAVNDIGSAEDFLAAIDKTIKYFNDGDIVEGTIVKVDRDEVLLDIGYKTEGVIPSRELSIKHDVDPNEVVSVGDEVEALVLTKEDKEGRLILSKKRAQYERAWGTIEELKEKDEAVKGTVIEVVKGGLILDIGLRGFLPASLVEMRRVRDLQPYIGKEIEAKIIELDKNRNNVVLSRRAWLEQTQSEVRSEFLNQLQKGAIRKGVVSSIVNFGAFVDLGGVDGLVHVSELSWKHIDHPSEVVTVGDEVTVEVLDVDMDRERVSLSLKATQEDPWRHFARTHAIGQIVPGKVTKLVPFGAFVRVEEGIEGLVHISELSERHVEVPDQVVQVGDDAMVKVIDIDLERRRISLSLKQANEDYTEEFDPSKYGMADSYDEQGNYIFPEGFDSETNEWLEGFEKQREEWESRYAEAERRHKMHTAQMEKFAAAEAEEAARPVSNGSSRSEESTGGTLASDAQLAALREKLAGNA

SEQ ID NO: 16005 - protein, 214 aa, Brassica napus
MASSQDQSALDLITQHLLTDFPSLETFVSSIHQSTTSTLSQRKPSLATISVPTTAPVVQEDDHRHYRGVRRRPWGKYAAEIRDPNKKGVRVWLGTFDTAVEAARGYDRAAFKLRGSKAILNFPLEAGKHEDNNTVALKSKRKRPETQDENHGRNLISHKAVIREETEAQGEACPLTPSSWMGFWDGVDGIGTGLFSVPPLSPYPSLGHSQLGVK

SEQ ID NO: 16006 - protein, 120 aa, Brassica napus
  misc_feature (59)..(59): Xaa can be any naturally occurring amino acid
  misc_feature (75)..(75): Xaa can be any naturally occurring amino acid
  misc_feature (77)..(77): Xaa can be any naturally occurring amino acid
  misc_feature (88)..(88): Xaa can be any naturally occurring amino acid
  misc_feature (92)..(93): Xaa can be any naturally occurring amino acid
  misc_feature (104)..(105): Xaa can be any naturally occurring amino acid
  misc_feature (108)..(110): Xaa can be any naturally occurring amino acid
  misc_feature (113)..(115): Xaa can be any naturally occurring amino acid
  misc_feature (117)..(117): Xaa can be any naturally occurring amino acid
  misc_feature (119)..(119): Xaa can be any naturally occurring amino acid
MARDGGVSCLRSSEMMRVGIGGMESPPLDLDEVHVLAVDDSLVDRIVIERLLRITSCKXTAVDSGWRALEFLGLXNXKASAELDRLKXDLIXXDYCMPGMTGVXXPSXXXKEXXXFXQXP

SEQ ID NO: 16007 - protein, 262 aa, Methanococcus maripaludis
MDGKLRADEVAVTKSILKSTFDMWMDLIDVDVVIVGAGPSGLTAAKYLAQNGVKTVVLERHLSFGGGTWGGGMGFPNIVVEKPADEILREAGIKLDEVIGEPELFTADSVEVPAKLGVAAIDAGAKILTGIVVEDLILKEDKVSGVVIQSYSIEKAGLHIDPITISAKYVIDSTGHDASVINTLARKNKDLGIEVPGEKSMWADKGENSLTRNTREVFPGLYVCGMAANAYHAGYRMGAIFGGMYLSGKKCAELILEKLENK

SEQ ID NO: 16008 - protein, 646 aa, Xanthomonas axonopodis
MCGLAGMLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRDALTLLLRLGYIPAPACIHEHTFKLMPGRVLRIDAQAVAAGAAAHRPDQAQQPFWNAREAMQRALATPFTGTDAQAEEQLDRVLRDAVALRMVADVPVGVFLSGGTDSSIVTAMMQAQSAQPVHTFSIGFEGSHHDEAPLAREVATHLCTDHTELYVSGADALAVVPNLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVLGATEPDSFYSLADPLHGSGTPADAMMLADFAAYLPDDLLCKVDRTTMAVGLEARAPLLDWRVAEFAWSLPLSLKYRDGVSKYLLKRVLCRYLPDAMVYRGKRGFGAPVSAWLRGDLHGWADDLLAHGALQREGVFAADSVARLWRDFNGGERKWHTHLWTVLMFQAWQAHWREQRAAVVR

SEQ ID NO: 16009 - protein, 437 aa, Arabidopsis thaliana
MANDYVSTVLLLLSLLIFLSQRTDSASIVKSLPGFDGPLPFELETGYIGVGEEEEVQLFYYFIKSERNPQEDPLLLWLSGGPGCSSISGLLYENGPVNVKIEVYNGTLPSLVSTTYSWTKVSSIIYLDQPVGTGFSYSRTKLVNKPSDSGEAKRIHEFLHKWLGKHQEFSSNPFYVGGDSYCGMVIPALVQEISKGNYVCCKPPINLQGYILGNPSTENEVDINYRIPYAHGMALISDELYESMKRICKGKYENVDPRNTKCLKLVGEYQKCTKRINKALIITPECVDTSPDCYMYRYLLTTYWANDENVQRALHVNKGSIGEWVRCYFEIPYNHDIKSSVPYHMNNSIDGYASLIFSGDHDMEVPYLGTQAWIRSLNYSLIDDWRPWMIGDQIAGYTRTYANKMAFATIKGGGHTPEYKPEESYIMFQRWISGQPL

SEQ ID NO: 16010 - protein, 735 aa, Oryza sativa
MGTAHLSHLQYMGRLRGKVRRFDSVRSTTARAQSGNAGRSMTEPRNGGSRVVERRSDEMCDPTTMVQTTQRARGTEDEKGADVVEFVLDQQKNKTGDIWHVIVELQCFIFFKVKLHFTVCSWGLPASGVLYGYRVGGPQGWDQGHRFDSSTVLLDPYAKLVSGRKYFGVAEEKSSQHFGTYDFDSSPFDWGDDYRLPNLPEADLVIYEMNVRAFTADESSGLDSTSRGSYLGLIDKIPHLLELGVNAVELLPVFEYDELEFKRYPNPRDHMVNTWGYSTINFFAPMSRYASAGGGPVAASKELKQMVKELHKAGIEVILDVVYNHTNEADDAHPYMTSFRGIDNKVYYMLDLNKNAELLNFSGCGNTLNCNHPVVKELILDSLRHWVEEYHIDGFRFDLASVLCRGPDGCPLDAPPLIKEIAKDAVLSRCKIIAEPWDCGGLYLVGRFPNWDRWAEWNGKYRDDLRRFIKGDPGMKGVFATRVSGSADLYQVNERKPYHGVNFVIAHDGFTLCDLVSYNLKHNDANGEGGCDGCNDNFSWNCGVEGETNDLNVLSLRSRQMKNFHVALMISQGTPMMLMGDEYGHTRYGNNNSYGHDTCINNFQWEQLEQRRDGHFRFFSEMIKFRHSNPILRRDRFLNKNDVTWHEDCWENQESKFLAFTVHDHNSGGDIYLAFNAHDYFVDAVIPPPPHHKCWNRVVDTNLESPNDIVPEGVPFTGPKYRIAPYSSILLKAKP

SEQ ID NO: 16011 - protein, 155 aa, Arabidopsis thaliana
DVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 16012 - protein, 344 aa, Parvularcula bermudensis
MMTNADPFRRLFVQGAGSWGTALALLGLQTGAEVVLWTRREDHAAAMRGDRENQRYLPGVSLPPALTITADRGAIAGCDAVLSVVPAQFAGGELAALREASGAAALPVALCSKGIEAETRRLMPEVLKAAWPEAAPAMLSGPSFAADVAKGLPTAVTLADADRDRGERWLATLGTLTFRPYWSADLTGVAIGGAVKNVLAVACGVVEGQGLGESARAALMARGFAEAARFAVALGAKVETLRGLSGLGDMILTCVSPQSRNYSLGVALGQGETAADILSKRHTVAEGAKTAPVLTALAREHGVEMPVAEAVAALVAGDIEVDDVVDSLLSRPLRPESPLLRDKT

SEQ ID NO: 16013 - protein, 418 aa, Haemophilus somnus
MNLKEMGKNAKQAATILAQLSQQQKNTALQIIAEQLELQSNKILVENAKDIQLAKENGLSDAIIDRLLLTKERINSIANDVRHIISLPDPIGQIIDGGILESGTKLERVRVPLGVIGVIYEARPNVTVDVATLCLKTGNAVILRGGKETSYSNKILVTVIQDALEQTGLPKNAVQAITDPDRNFVLELLKLDKYVDMIIPRGGAGLHEFCKQNSTIPVIIGGVGVCHVFVEESAEQDKALAVIDNAKTQRPSTCNTLETLLVQESIATEFLPKLVAHLKHKNVKYHADPTALSILEKQNAEVSIVQEQQLRQEWGSLDLNVVIVKDIQQAIAHITEYGTQHSEAILTSSPRLAHQFVSLVDAAAVYVNASTRFTDGGQFGLGAEVAVSTQKLHARGPMGLEALTTYKWVCSGDYTVRQ

SEQ ID NO: 16014 - protein, 131 aa, Arabidopsis thaliana
MQEIEHTTDFKNHTLPLARIKKIMKADEDVRMISAEAPVIFAKACEMFILELTLRAWIHTEENKRRTLQKNDIAAAISRTDVFDFLVDIIPRDELKEEGLGVTKGTIPSVVGSPPYYYLQQQGMMQHWPQE

SEQ ID NO: 16015 - protein, 426 aa, Bacteroides fragilis
MKRDDLIFDIIEKEHQRQLKGIELIASENFVSDQVMEAMGSCLTNKYAEGYPGKRYYGGCEVVDQSEQIAIDRLKEIFGAEWANVQPHSGAQANAAVFLAVLNPGDKFMGLNLAHGGHLSHGSLVNTSGIIYTPCEYNLKQETGRVDYDQMEEVALREKPKMIIGGGSAYSREWDYKRMREIADKVGAILMIDMAHPAGLIAAGLLDNPVKYAHIVTSTTHKTLRGPRGGVIMMGKDFPNPWGKKTPKGEIKMMSQLLDSAVFPGIQGGPLEHVIAAKAVAFGECLQPEYKEYQKQVQKNAAVLAQALIDRGFTIVSGGTDNHSMLVDLRSKYPTLTGKVAEKALVSADITVNKNMVPFDSRSAFQTSGIRLGTPAITTRGAKEDLMLEIAEMIETVLSNVENEEVIAQVRARVNKTMEKYPIFAY

SEQ ID NO: 16016 - protein, 425 aa, Erwinia carotovora
MVNNDKHDPLMLARQLPLKSVALILAGGRGTRLKGLTALRAKPAVHFGGKFRIIDFALSNCLNSGIRRIGVITQYQSHTLVQHIQRGWSFLNAEMNEFVDLLPAQQRYSTDHWYRGTADAVCQNLDIIRRYRAEYMVILAGDHIYKMDYSRMLIDHVEKGAECTVACLPVPLEEASAFGVMSVDKQHRILDFAEKPDNPTPMPDNPDMALASMGIYVFNADYLYQLLETDRNASDSAHDFGQDLIPKIVSQRLAWAHPFTLSCVTSGEDEHQYWRDVGTLEAYWRANLDLASVTPELDVYDRHWPIRSAIESLPPAKFVQDRSGSHGMTMNSLVSGGCIVSGSVVTHSVLFPRVRVNSFCSIDSTVILPDVNVGRSCRLRRCVIDRACHLPEGMVIGENAEEDSRRFYRSEEGIVLVTRSMLEKL

SEQ ID NO: 16017 - protein, 558 aa, Vibrio angustum
MSNAIPEIQKTKCLLIFGYNAADSHPVVARHILKARANGAKIIVCDPRKIESARVADQWLALKNGSNMALVNALANVIIEENLYDKEYVANNTEGFDAFRELVSRYTPESVETTTGLKAEDIRLAARTYAAAPEAMILWGMGVTQYGQAVDVVRGLAGLALLTGNFGREGVGCGPVRGQNNVQGTCDMGMLPHQFPGYQSVEDAEIRAKFEAAWGVSISGKPGYRLTEIGHKVDEGICKAFYVFGEDPAQTEADLAAMRETMRKMELVIVQDIFMTQTAEFADVIFPATSWGEHEGVYSSADRGFQRFYKAITPPGDVKPDWEIFSLLATRMGYPMSYQNTQEIWDEMRHLAPLYTGATYEKMEGLKSVQWPCPTEDHPGTPFLFEGNKFSTPSGKGQFIAAEWRAPLEQPDAEYPLVLSTVREVGHYSCRSMTGNCSALQTLEDEPGYVQMHPDDARQLGIDDQQLVWVSSRRGKVISRANYNERVNKGVVYMTYQWWIGACNELTIEHVDPISSTPEFKYCAVKVENIEDQSWAENYVQTEYSNLKARLKNHVVNA

SEQ ID NO: 16018 - protein, 483 aa, Cleome spinosa
MATRIGLAGLAVMGQNLALNIAEKGFPISVYNRTTSKVDETVQRAKKEGNLPVYGFHDPESFVNSIQKPRVIIMLVKAGAPVDQTIKTLSAYMEEGDCIIDGGNEWYENTERREKAVAERGLLYLGMGVSGGEEGARNGPSLMPGGSYKAYEYIKDILLKVAAQVPGSGPCVTYIGKGGSGNFVKMVHNGIEYGDMQLIAEAYDVLKSVGKLSNRELHAVFSEWNKGELLSFLIEITADIFKIEDDKGDGYLVDKVLDKTGMKGTGKWTVQQAAELSVPAPTIEASLDARFISGLKEERVQAAKVFKESGLCGDILTDQEIDKKQLIEDVRRALYASKICSYAQGMNLVRAKSMEKGWGLKLGELARIWKGGCIIRAIFLDRIKQAYDRNPDLPNLLVDPEFAKEMVERQSAWRRVVSLAVDSGISMPGMTASLAYFDSYRRERLPANLVQAQRDYFGAHTYERADFDGSFHTEWFKIAKSKL

SEQ ID NO: 16019 - protein, 262 aa, Unknown
  Synechococcus sp. WH 7805
MTAADRSGIVYLVGAGPGDPELLTLKAHRLLQSCDALVYDSLVPREVLDLVPEHCERHFVGKRRGHHSVPQPSTNAVLVELSARHACVVRLKGGDPFLFGRGGEEAAHLVKHGVRVEVVPGVTAGIAAPAYAGIPVTHRRAGSSVTFVTGHEEIDKRRPSVNWRSLASASDGLVVYMGLHNLPRIADELMAGGLSPDTPVAVIQQGTVAGQRCLQAMLSEIAERVRQEQFASPSIVVVGDVVKEQISACAPEPAAVTMPIPF

SEQ ID NO: 16020 - protein, 448 aa, Streptococcus pneumoniae
MTSAKEYIQSVFETVKARNGHEAEFLQAVEEFFNTLEPVFEKHPEYIEENILARITEPERVISFRVPWVDRDGKVQVNRGYRVQFNSAVGPYKGGLRFHPTVNQGILKFLGFEQIFKNVLTGLPIGGGKGGSDFDPKGKTDAEVMRFCQSFMTELQKHIGPSLDVPAGDIGVGGREIGYLYGQYKRLNQFDAGVLTGKPLGFGGSLIRPEATGYGLVYYTEEMLKANGNSFAGKKVVISGSGNVAQYALQKATELGATVISVSDSNGYVIDENGIDFDLLVDVKEKRRARLTEYAAEKATATYHEGSVWTYAGNYDIALPCATQNEINGEAAKRLVAQGVICVSEGANMPSNLDAIKVYKENGIFYGPAKAANAGGVAVSALEMSQNSLRLSWTREEVDGRLKDIMTNIFNTAKTTSETYGLDKDYLAGANIAAFENVANAMIAQGIV

SEQ ID NO: 16021 - protein, 102 aa, Oryza sativa
MAPKAEKKPAKKKPKAEKRLSESKASSKEGGAGDKKGRKKAKKSVEIYIFKVLKQVHPDIGISSKAMSIMNSFINDIFEKLAQEAAHLARYNKKPIATSREI

SEQ ID NO: 16022 - protein, 109 aa, Parvularcula bermudensis
MATKTVTDASFEQDVLKGTGLVLVDFWATWCGPCRQIAPALEEIADEMGDDLTVAKLDIDENPTTMMQYGVRGVPTLMLFKEGQLVSTKVGADAKGAILAWVKETASAA

SEQ ID NO: 16023 - protein, 452 aa, Chlorobium tepidum
MNKQVDVLVIGGSAAGIVAATTGKAFYASKSFLIVRKEPEAVVPCGIPYIFGTLDGVHQNIVPTAPLANADVELLIDEVVSIDREAKSATTAGGVVISWDKLVLATGSEPKTPDWLEGRDLDGVFVIPKNRDYLCRLRSRLEEPRRVAIIGGGFIGVELADELAKKGHDVTLVEILPHVLSMAFDSDLSLKAEELLVKRGVKLKTGEKLKKLAGQASVSKVILESGEEIEVDIVILATGYAPNVELARSAGIKINELGAIRVDEYMRTEDKNIFAVGDCAEKFSFITRIVKGLMLASTACSEARIAGMNLFGLSRLRTFSGTIAIFSTAIGGTTFAAAGVTEQLARERGFEVVSAGFTGIDKHPGTLPETSNQYVKLIVNSENGLVLGGAVMGGQSAGELINVIGVIIETKMTVNELLTLQFGTHPLLTGPPTAYALIKAAEAVEMKLRHFK

SEQ ID NO: 16024 - protein, 538 aa, Zea mays
METVTVVVAPAPVAVTQQPPQHKLAELKPSSFAGVPKSSPATKAKPAKTKKLAGGCGGYVLEDVPHLTDYLPELKSYPNPLQDHPAYSVVKQYFVNPDDTVAKKIVVHKSGARGTHFRRAGPRQRVYFQPDEVTAAIVTCGGLCPGLNTVIRELVCGLHDMYGVATVYGIEGGYKGFYARNTVELTPRSVNDIHKRGGTVLGTSRGGQDTAKIVDSIQDRGVNQVYIIGGDGTQKGAASIHEEVQRRGLKCAVVGVPKTIDNDIAVIDKSFGFDTAVEEAQRAINAAHVEAESAENGVGVVKLMGRNSGFIAMYATLASRDVDCCLIPESPFYLDGRGGLLEFVEKRLRDNGHMVIVVAEGAGQDLIAKSMNFADTHDASGNKVLLDVGLWLSHKIKEHFKKKPSFPITLKYIDPTYMIRAVPSNASDNVYCTLLAHSALHGAMAGYTGFTVAPVNGRHAYIPFYRITEKQNKVVITDRMWARVLCSTNQPCFLTHQDVEGAGLDEEEPQMPLVEGENALVRNPSMCNGNGHLCSGAA

SEQ ID NO: 16025 - protein, 210 aa, Candida glabrata
MAFVKRVTQETNIQLALDLDGGSVSVRESILGKEYASGDGQTIHVHTGVGFLDHMLTALAKHGGWSLILECIGDLHIDDHHTVEDCGIALGQAFKEALGSVRGIKRFGHGFAPLDEALSRAVVDFSNRPFAVVELGLKRERIGQLSTEMIPHFLESFATEGRITMHVDCLRGTNDHHRSESGFKALAIAIREARTPTGRDDVPSTKGVLA

SEQ ID NO: 16026 - protein, 528 aa, Unknown
  Azoarcus sp. BH72
MPGQPDFTLLANRMAPIGILQLASWLEKHGHPTQLHDCMGPYAPASLEANVAQIIATKPELVGFSATTSGFMDAVDMAEQIKQKLPHVKTFFGNVHTSSIGAPLLEHFPEIDYLCIGEGEGAILDVANGMAPKDIANIIYRDDAGRAVINERRTRILDLDELPFPAYEKLAGFPHGYHLPLFSYEKRWGATMITSRGCPYTCSFCDRTVYERLYKYNSAQYVHDHIRHLRDTFGVHHINIYDDLFTAHKKRIHELCELLIAKPLGVDFNCAIRTGHTSDEMLALLKRAGALMVSMGIESADPGMMERHKTGVTLEAVKKTVEQIHTAGLRAKGLFIFGLPGETPETLKKTSDFILELDLDEMNMTKFSPMYGAPIWDECVSGKEGDFNEDWRLMNCLNFVFKPNGFESREQMDALYNWHVRRYYDSKAYRRRFSKRIWQHRWSLWHLLKNAPRVIQAARYFSANKAQIEAAARDFAPHPRQPRGLQPFLSPELQADALAAMSPVKISRKPKPKVEDATAIAAPRIQAA

SEQ ID NO: 16027 - protein, 921 aa, Yersinia pestis
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELDILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRETLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKDCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 16028 - protein, 910 aa, Oryza sativa
  misc_feature (15)..(15): Xaa can be any naturally occurring amino acid
  misc_feature (124)..(124): Xaa can be any naturally occurring amino acid
  misc_feature (141)..(141): Xaa can be any naturally occurring amino acid
SKEQQQQRGYQLPRXDSRGSLEVFNPSSASSFRTAAAAPKSASPFLAIPDREEDNVVAQQRAAEWGLVLQTDHHTGLPQGVSARPSSGSARTSSEDNPQQQAERRRHPHGCRKELRAALTVFQXQTFVVSDATHPNHPIMXASAGFFNMTGYTSKEVVGRNCRFLQGSGTDPHEIDKIRQSLANGSNYCGRILNYKKDGTPFWNLLTIAPIKDEDGRLLKFIGMQVEVSKYTEGKKDTVVRPNGLSESLIKYDARQKDHARSSVSELLLALKNPRSLSESSNNTLKRKSQESLSMSMTEVPSKRSSESGSRRNSRSGTRSSLQKINEVPDQGNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRATVRKIRDAIDNQAEVTVQLINYTKSGKKFWNLFHLQPMRDQKGDVQYFIGVQLDGTEHVQDDAAKEGVVLVKKTADNIDEAAKELPDANLRPEDLWANHSKVVLPNPHMKDTASWRAIQKVLESGESIGLKHFRPVKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYAAEVVVALEYLHCQGIIYRDLKPENILLHRDGHISLTDFDLSCLTSCRPQVFLPEDADEKKGRKNGSYPIFFAEPMRASNSFVGTEEYIAPEIITGAGHTSAVDWWALGILLYEMLYGYTPFRGKTRQRTFANILHKDIRFPASISVSLAARQLMYRLLHRDPANRLGSYEGANEIKGHPFFRGINWPLIRATAPPKLEIPLFSKDDMEKKGLVTNNRTDMF

SEQ ID NO: 16029 - protein, 639 aa, Mesorhizobium loti
MSGVAGILLRQEAPADAATDIQRMLARMRHRGPDGNSWWLDSGIALGHAWLNTTDEAGPGPLTMAGGKLAITADCRLDNRDELMARLGIRDRSVADAVLLMRAYLRWGESCPVHLQGDFAFAIWDAERQLLFCARDHFGVKPFYYHAADRRFAFASEIGPMLGLDGVGARISEHRISGFLAGLPDDPQSTPYSDIFTLPARHSLTVTAQQVVLRRYWQIEPSVRPARSDAAEEFAHLFSQSVRNRMRGSRSVGAMLSGGLDSSSIACVAGLQNAAERKPKLPTFSLVFEKGSSMDERAFIDAVLDQHKTDPTLIPVGNYAPFAEFERVLEEQEGTFLAPGLTLTRGIYRTAGAKGIKVLLDGHGGDEVVSQGHGHLHELANGGRWLDLWREVRSASNTYGDSTLGLYFQFLTLYGPAWRIAKARQLANRALNRIRKPTQMQRGRSWRDLINPDLARRTELIDRFHRAGYMPPGVQASDALSHRWILSNGYVPHSFEVLDKAAANFGVEPRYPFWDKPLVEFCLALPGEEKLSHGFGRYVLRRAMEGILPAAVQWRRDKIDFTANLVNGMVRNHRDLLEQLLVSDAGRIAPYVNLPQVSAAYARLLSQPDQVASLDVQYVWRSASLSLWLRQVQHGGSPA

SEQ ID NO: 16030 - protein, 196 aa, Dehalococcoides ethenogenes
MTKRTASIKRQTTETTISLSLNLDGSGQAEMCTGVRLFDHMLSQLAKHGLFDINVSANGDDIHHLVEDVALTLGKAFNEALGERKGIVRMADATVPMDDSLATVALDLSGRGYAVVDLPFSKNDLTGFPTDLVRHFLETFAIEGRLNLHARILYGSNDHHKAEALFKALARALDKATSLDPRREGIAPSTKGMLEN

SEQ ID NO: 16031 - protein, 544 aa, Bordetella parapertussis
MSLARVGIAQINACVGDLAGNAARVLQAARQAAGQGADVLVTPELVLTGYPPEDLLLRPRFIQEQQAVFERLCQDLAGLAGLHVVIGHVLARQDRLYNAATVVCEGRVLGSYCKRELPNYSVFDEQRYFSAHGEAFGFTVKGVRFGLNICEDIWLERAPRAAAADGAQVLLVSNASPYNTGKQEERLSVARRSVQDTGCALIYANLVGGQDELVFDGASFALDAQGRMSARLPDFTEGVNVLEVDARGTVRPVTEQAAVQPYGLEEQVWNALVLGVRDYLGKNGFPGAIIGLSGGIDSAVVLAVAVDAVGADNVRAVMMPSRYTADISLTDAADMARRLGVQYDVIAIGEVVDRFEAALAPQFAGLPVDATEENIQARARGTLLMALSNKTGRLVLTTGNKSEMTTGYCTLYGDMAGGFAVIKDVPKTLVYRLANWRNQRQPIIPERIITRPPSAELRPDQTDQDSLPPYDILDGIIERYMEHNASAADIVAAGFPREAVGQVVRLIRINEYKRRQAPPGPRITPRAFGRDWRYPVTNGFRETV

SEQ ID NO: 16032 - protein, 181 aa, Dehalococcoides ethenogenes
MNRINLSLFIPRADIEVYLERLAAEINRSYQDKPLVVIGVLKGSFIFMADLIRRLNMPVELEFVGLASYGQNTQSSGKVRLTRPLKRDITGKDVLVVEDIVDSGLTISYLLKYLKRRKANSVKLCALLSKPSRRICPVEIDYLGCEVADKFLVGYGLDRGECHRQLPEIFALEEQPDADKP

SEQ ID NO: 16033 - protein, 363 aa, Actinobacillus pleuropneumoniae
MTQPTLFIDRDGTLIDEPKTDFQIDSLEKLKLERNVIPALLKLKDHYRFVMVSNQDGLGTSSFPQETFDKPHNAMMELFRSQGIEFDEVLICPHKPEDNCDCRKPKTKLLQKYIDRELFDPATSFVIGDRATDVQLAENLGIRALQYHPEKLNWDLIAEKLLGEAVTNIGDRQPRYAEVVRKTKETDIKVQVWLDETGVNDIKTGVGFFDHMLDQIATHGGFRMNISCKGDLWIDEHHTVEDTALALGTALKQAIGDKRGIARFGFVLPMDECQAQCAMDLSGRPFIKFKAEFKRDKVGDFSTELTEHFFQSIAFTMLATLHIKAKGDNDHHKIESLFKVFGRTLRQAIRIEGNELPSSKGVL

SEQ ID NO: 16034 - protein, 1032 aa, Candida glabrata
MLKGTAIKRSWTGLRRLYATDVSSTKFKQIYHADPLDSKNDRLDTFQRRHLGPNPKDVDEMLKTVNSNYNDLSDFVNDMVPSKILGMKDGLKFKSSPKGVFNETAMLNHLAQIAEKNNYKVKNYIGKGYYDTILPPVIQRNVLECPEWYTSYTPYQPEISQGRLESLLNFQTVVSDLTGLPVANSSLLDEGTAAGEAMLLSYHSLKSKKIKKSSPNQKLNFIIDKNLHPQTKSVLKTRAKPFNIELLEIDFNELSNKEIEDKLSKELLDNSFGGLVQYPDTNGNIPTTDKLNTISGLLHSSNCLFSVATDLLALTLLEPPSTFGADICLGSSQRFGVPLAYGGPHAAFFSVTEKLNRKIPGRIVGVSKDRLGNTALRLALQTREQHIKRDKATSNICTAQALLANVSANYCVYHGPEGLKNIAKRVYGMTTVLANAISEHSEHKLLNNSWFDTLTIELKEGTTADQFLELALSEFNTNVFAVNNRTVSISFDEKKTIDDLEDMIRLFCNLKKNSSISSSIKDSGILPEFPKELQRKSQFLQNPVFNRYHTETAMLRYLHHLQSRDLSLANSMIPLGSCTMKLNSTFEMMPITWPQFANIHPFQPVDQVQGYKELITAIEEDFSSITGFHSVSLQPNSGAQGEYTGLRVIRSYLEDIGEGHRNLCLIPISAHGTNPASAAMCGLKVIPINCLQNGALDLADLKEKAEKYKDDIAAVMITYPSTYGLYEPDIKEAFDIVHSCGGQVYLDGANMNAQVGLTSPGDLGADVCHLNLHKTFAIPHGGGGPAGAPICVKEHLAPFLPRHDVTDMITEIGSNKSIDSVSSAPYGNALVLPISYAYVNMMGEEGLPFSTVIATLNSNYMMARLKEHYKIMFVNGEDVKHCAHEFIIDLREFKAKGIEAIDVAKRLQDYGFHAPTLAFPVPGTLMVEPTESENREELDRFVDSMISIRKEIDDYIAGKPEGMVIKNAPHPLSDLISSTDWETRGYTREQAAFPLAFLKTSKFWPTVARVDDKFGDTHLICTCPSVEEMAEE

SEQ ID NO: 16035 - protein, 114 aa, Leptospira interrogans
MKLIVAIIQPHKLEEVKSELTKNEIYRLTVSDVQGYGQQKGKTEVFRGHEYQVNLLRKVRLEIAVNDEFVKPTVDAILKAAKTGDGKIGDGKIFITPLEDVIRIRTGERGSSAI

SEQ ID NO: 16036 - protein, 99 aa, Glycine max
  misc_feature (83)..(83): Xaa can be any naturally occurring amino acid
MMMLKNRKMRIYLFFLHTPLFADPDRRGLMALTLSQLGEILSPAACSIDCSLKHYNADSYVLSDFSLCAFALRIIIATCGCTXKLLLSIPPILSCVDVL

SEQ ID NO: 16037 - protein, 498 aa, Schizosaccharomyces pombe
MEIEKYTPEQIEELGKGARDFAFAHGVVFTELSVSKEGRNIATQIPITLFPSVIPHGAFVEAVSVQKAYNKLYAKIANDYEFLRLHLQSITKYDEFMNKLWNLYQKHREAVAHLKENQFQPLSLGVFRSDYMVHQDDSFIGCKQVEFNTISVSFGGVSKAVSNLHAYCSQSGLYRKPLTTNYLTVNTSVSGICTGISNAVDAYRDYVKNITSKMNIASDNTKPIVLFVVKGGERNITDQRTLEYELLNRFHVISKRIDIAELNSLIHDKSSNKLYMKTSFTTYEVAVVYYRVGYALDDYPSQEAWDMRLTIENTLAIKCPSISTHLAGSKKIQQVLAESNALERFLEGDELQAVRSTFADMYPLDDTPRGKEGIKLAFEKPEDFVLKPQREGGGNNTYGKDIPGLLSKMPQEEWDSYILMRYINAVPSQNYILKGERPEKFDVVDEIGILGTIVWNIKTDEVVQNGQSGFICRTKPKKTNEGGVATGYASLSSIELSE

SEQ ID NO: 16038 - protein, 484 aa, Xanthomonas axonopodis
MLRSLIVCCRVRMSYAIVWFRRDLRLEDNPALRAALDAGHHPIPLYIDAPHEEGEWTPGAASRTWRHRSLAALDGALRALGSGLVIRVGNSAQVLDEVIAQTGAVAVYWNRKYEPATQPRDAQIKRDLRERGIEVQSCNCALLFEPWQLSTQQGGPYKVFTPFWRNALTQLQLPAAIGAPRSLPPLPASLKTDALDTLQLVPGLQWDQGFWEHWQPGEAGAHEMLEIFIDGALSGYRENRDRPDRVGTSQLSPHLHFGEIAPWRIANTLETHRTARNGAEIDAYIRQLGWRDFAYHLLHHFPDTTNQNLNPRFAGFDWATVDPVALQAWQRGRTGIPIVDAGMRQLWHTGWMHNRVRMIVASFLCKHLRIHWIEGARWFWDTLVDADLANNTLGWQWVAGTGADAAPYFRVFNPVTQAEKFDPQAAYITRWVPELGKLAVKERFAPWLHPLSLARLAPEYPRTPIIGLAEGRDAALAAYAKTRG

SEQ ID NO: 16039 - protein, 166 aa, Buchnera aphidicola
MKHTLQVIITEKELDIRVRELGQEITKKYRNSRNKMILIALLRGSFIFISDLCRRIHIEHEIDFMTTSSYGRGMLSSGDVKIIKDLDEDIYNKNVLIVEDIIDSGKTLSKVLDILKLRNPKSLSICTLLDKPECREVNINVDFIGFSILENFFIVGYGIDYAQSYR

SEQ ID NO: 16040 - protein, 449 aa, Desulfotalea psychrophila
MDPIIQQLHAKDQDQHEFHQAVEEVLESVKPVLDRNLWYRQQGVWERLIEPERVIMFRVPWVDDEGNVRVNRGFRVEMNSALGPYKGGLRFHPSVNLSIIKFLAFEQTFKNSLTTLPMGGGKGGSDFNPKGCSDFEVMRFCHSFMLELYRHIGPNTDVPAGDIGVGAREIGYLFGMYKKIKNEFTGVLTGKSLGWGGSLIRPEATGYGNVYFASEMLTTRDQTIEGKSCLVSGSGNVAQFTIEKILDLGGKVHTISDSDGYIYDEEGIDCDKLGWIKQLKNIRRGRVAEYVETYPQAVYTPIDPTLGYNPLWDHSADCAFPSATQNEINEQDAKNLVKNGVFLISEGANMPSSPEAVAVFHDANCLYGPSKAANAGGVAVSGLEMSQNTIRMSWPREEVDTRLKQIMHSIHSTCVDAASEYNYGQNYVAGANIAGFVKVVNAMLDQGVV

SEQ ID NO: 16041 - protein, 161 aa, Xanthomonas campestris
MSDISTFAFTDLEGRTQSMRDYAGNVLLVVNVASKCGFTPQYAGLQALWQRYRERGLVVIGFPCDQFGHQEPGDAAQIRQFCSLDYAVDFPLAAKIEVNGNGAHPLWQWLKHEQRGVLGSEAIKWNFTKFLVGRDGRVLERYAPTTKPEALAADIERALGA

SEQ ID NO: 16042 - protein, 355 aa, Arabidopsis halleri
ISYLTYDRADMAFAHYGPFWRQMRKVCVMKVFSRKRAESWASVRDEVDKMVRSVSCNVGKPINVGEQIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLGFYSEEAKLVSEAADLQNSIKLTRDNIKAIIMDVMFGGTETVASAIEWALTELLRSPEDLKRVQQELAEVVGLDRRVEESDIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 16043 - protein, 418 aa, Eucalyptus globulus
GDNVKFNFPMAFTATLLAWSVIEFGEVMPPAEQRNALVAVRWGTDYLLKSISQLPNRIFVQVGDPNSDHNCWERPEDMDTARTAYIVDAPNPTSDVAGETAAALAAASMASRSSDPGYSETLLRNAIKAFDYADTHRGAYSDNANIKDDVCPFYCDFDGYQDELLWGAAWLRRATQDNSYLDYIQNNGQTLGAEENINEFGWDNKHAGLNVLVSKEFLEGSMFALESYKASADSFMCTLIPESSTAYHIDLTPGGLIYKPGGSNLQHSTSISFLLLVYANYLEKTSQSASCGDMTVGPAELRQQAKRQVDYILGDNPKGMSYMVGYGGQYPQRIHHRGSSLPSIKDRPDSIGCKEGSVYFNSPWPNPNVLVGALVGGPSEDDSFEDDRADFRKSEPTTYINAPFVGVLAYFAANPNLS

SEQ ID NO: 16044 - protein, 658 aa, Erwinia carotovora
MAELQTGKPTPLGASFDGNGVNFALFSADAERVELCVFDERQQEQRIVLTARSGDIWHGYLPDAQPGLRYGFRVDGPFEPSQGLRFNPHKLLLDPCARQLDGWVVDDASLQGGIDQRDERDSAEIMAKCVVTAEDYDWQDDQHPQTPWNQTVIYEAHVRGLTQLHPDIPEDIRGSYAALGHPVMIDYLTSLGITALELLPVQQHADEPRLQQIGLRNYWGYNVLLPFAVDNSLAAGDDALNEFRDAVKALHNAGIEVILDVVFNHSAELDVEGPTLCQRGIDNRSYYWLGDSGEYHNWTGCGNVLRLNHPAVMDWVMDCLRFWREVCHVDGFRFDLATVLGRTPDFTAAAPLLSAMKNDNRLQGCKLIAEPWDIGHGGYQLGQFPTPFAEWSDRYRDDMRRFWLHGDISLGAFARRFAASSDIFQQRDRLPYASINKLTAHDGFTLRDLVSFNHKHNDANGEGNRDGTDSNFSNNHGTEGLEADDDIHQRRQASQKALLTTLILSQGTPMLLAGDELGHSQQGNNNAYCQDNELTWLHWDHADRGLREFVAGLIQLRRTIPALQQETWWQEGDGAVQWLNREGQPLTPPQWEQGEHQLQILLSGRWLVLVNASLHAGAFMLPEGHWQVSPPFDETNPPEGGMWHGQAQAVCVLIKQTA

SEQ ID NO: 16045 - protein, 145 aa, Oryza sativa
MGFSETQEELVLRSWQSMKKDSESIALKFFLRIFEIAPAAKQMFSFLRDSGDDVPLESHPKACESATQLRKTGDVKVREATLRRLGATHVKAGVADAHFEVVRTALLDTIKDAVPEMWSPEMRGAWEEAYDQLAAAIKEEMKKAA

SEQ ID NO: 16046 - protein, 460 aa, Cryptococcus neoformans
MADSIASASNSGAESIAIAARRAFEASQLVNPSERDVALKAIRETLQASKDEIIAANKKDMEAAEALAATGKLSSSLVSRLDLGRPGKFEAMLQGITDVAALPAPTGIVTFAKEIGPELELHRVTCPVGVLLVIFEARPEVVVNIAALAIKSGNAAILKGGKESINTATLLSSLISQALAKTSIPPAFVQSVSTRSEISSLLAQDKYIDLVMPRGGNELVRSIQNNTRIPVMGHADGICAVYLDESAVQEKAVRIAVESKIDYMAACNAAETLLIHSSLLTTVWPAVASALMSNSVCLRCDAATLSALRDANVPKTSEFVTASSPADYSTEFLGPTIAVKAVESVQEAIQHINSHSSHHTDSIVTEDEASMSAWCRGLDSANCFVNASTRFADGTRYGLGTEVGISTGKTHARGPVGLDGLIIYKYMMRSRKQDGSVIADHEKGGKGYTHKDLVKGEPPF

SEQ ID NO: 16047 - protein, 396 aa, Desulfotalea psychrophila
MEESFADLFKAEETKKIVKLAPGQKLTATVVGISPDTIFLDVGGKSEGALNSSEMIDGEGNLTVEMGDKVEVYFLQGKGSGPLFTTKIGSGADISHLEEAWRSAIPVEGIVKAEIKGGFEISLGGKTRAFCPFSQMSLRRVADPAKEYVDTTMSFLISKIEESGRNIVVSARALEEAKRAEMRDELVATLAEGQTVEGVITSIRDFGAFVDIGAIDGLIPISEIGWSRVERVEEYFAVGQKVQAVVKSIDWEKDRISLSYKDTLTDPWIEAAKELVPGTILTGKVVRLAQFGAFVNIAEGIDGLIHISRLGSGRRINHPREAVEEGQEIEVKVESVDSDSKRISLAPSDFVSAEGEADKEEATFKEYAKKKKSSKESSNMGSLGQLLKAKMLAKKK

SEQ ID NO: 16048 - protein, 398 aa, Karenia brevis
MMRTVLITLACMAYAGAGFRVQTEAAFQPTGVAPGRSHRATSPSMSYSGGGAWGQWLGNKGFPKAPSPAEVEAQIAARSGTVTAAAESAVQDFLEFEPYTDRSTMPDNTFKPKSPFEGKIISVERIVGPKATGETCNVVIDHFGKMPYIEGQSYGVIPPGLNPKNGKPNKVRLYSIASSRYGDDTKGTTTTLCVRRATYWCPEMEKEDPAKKGVCSNYLCDASAGDVVKLTGPTGKVMLLPEDKPETDIIMVATGTGIAPYRSFLKRMFIEKTPFAKDFKGLAWLFLGVANSDALLYDEDWKAIEKENPDNFRYDVALSREMTNKDGGKMYIQDKVEEYGDEVFDRLDKGAHIYFCGLKGMMPGIQGMLEKVAGAKGLNYEEFIKKLKKNGQWHVEVY

SEQ ID NO: 16049 - protein, 567 aa, Oryza sativa
MSKKRREGGGGGNGGCDPPAVTDALSMDGGLREVSLSVVFSVWCLLFLLRSQFLHSQTDPSDFYDDVEDGMRENYCKVMPLEAYIFPTEYNASAAAPTCQPSLHPPDQPQQETDHRSLEPFNNTTGGKSSAEAAALDELDEFRSRILQGKAENGRVPDGATPAAHRLEPSGAEYNYAAASKGAKVLAHNREAKGAANILGGDKDRYLRNPCSADDKFVDVELSEETLVRTIGLANLEHYSSNFRDFELYGSPSYPAPAEEWELLGRFTADNAKHAQRFVLPDPRWTRYLRLRLATHYGSGFYCILSYLEVYGIDAVEQMLQEIISGSGADTDASAAAKAEEGGDGGTLRNDTAQVNARLDGVGGGGGSAAGRNDSAGDGAGAKNNGSRMTVAGDGKPAAAGRFHGDAVLKIMMQKMRSLELGLSTLEDYTKALNHRYGAKLPDLHTGLSQTTMALDRMKADVRDLVEWKGNVKALRILDENCCVGCRSNVEEMRSIQETMQNKELAVLSISLFFACLALFKLACDRVLFLFTRKGAAAAERMCGASKGWILVLASSSFTTFLVLLYN

SEQ ID NO: 16050 - protein, 246 aa, Zea mays
MELGSMRLRCCPQAPPNKIKPLPRTISAGARRLCSRRRRAGALLHVAAPDSRPLETVCADSTGQGTKPSIVDDAMYRDDDKFCLVEMEVRDCELDQYGLVSSDVYVDYLENGRQHCNMGCASASRSIITSPISFLFLLGSYLAREVFASRLGIGRDSIARTGNALALSEQKLNYYTPLKRGARFVVMVRVVQIKGARMVLEHFVETLPPERKLVLEATATVVFLDKDYRPTRVFPEVASKMRLHFF

SEQ ID NO: 16051 - protein, 1200 aa, Oryza sativa
MGGVEPPPPPAPAPAGLAAWLVARGVKRRAVSAKRSWPPLCGRFPAPPPPPPTAPVAGDDGSKGVEGVVANQGGAEGVAVSPDRSVPLSGSPTAASSLPPPPSIIAGDVGDNSVEGRGDVGDKGVHGVTEGNEEEQVASAAVSSAACNGALSHGPSQPEAERMEVDEGEGRETGEAQLPNDTDARLSDDQGMGEVLDVMPLAVAAPVSCGANVSNGSAGNVRDVASLLMDREGGKGGCEFERKEVTSDRDGRETESRVGVGQLERTNDVHDGGRKKRWLMSVLNPPPKRRAISAIRKFPRDCGRAASTLAESGASMEELPLEATPISVATGGASMEDSLARTPISVQGASLVCGLDHSSEAIDGKTIEDDESSKVENRIQEFQVATNVALDDFEGAKNGSTHPNDSIAKPSPSHGFVERVNGKGSQQEKKLVARSAWDGKMVSKYEERLQKGTPETRMRDLVDVKAKKKILKSDKMNGALQNDARSSGDGKMKTKASSTQRGVVRSDMSLKQGDIARKVDATGKCKGGVNSLIKEATSRKHATTNGIEENDDRDLVSDRIIVQALMAPDKCPWTRRRKSIGGSSESRTPKLKKKFGRPRKELKDTTPREEVSPEVASCKAIKHEAIEDKEDSYFEDEGNSKASYSDGEGNSKELVRGGKALVVCGGKKELCVTLPPSAPSGTDPRSKIRNLLIKFHAACRKLVQVEEQHKGNIGRIDIEAGKALKQNGFIKPGPIVGNVAGVEVGDEFNFRIELSFVGLHRPYQGGIDSTKVNGILVAISIVASGGYHDELSSSDELIYTGSGGKAIGNKAAGDQKLERGNLALKNSIETKTPVRVIHGFKGHSKGEASHSKSKQISTYIYDGLYMVVDYWKEGPEGSMVYKYKLQRIPGQPELALHIIKATRKSKVREGVCVPDISQGRERIPIPAINTIDDTQPTAFKYTTEVIYPHSYAKEPPKGCDCTNGCSDSNRCACAVKNGGEIPFNSNGAIVEAKPLVYECGPSCRCPPTCHNRVSQHGIKIPLEIFKTGNKGWGVRSLSSISSGSFVCEYAGEVLQENGDEHVETDEYLFDIGHHYHDEVWEDPKFEGILGLESSTSKTTEDTEGSKTTEDTEGSTIDASKCSNVGRFINHSCSPNLYAQNVLWDHDDMKKPHIMFFATENIPPLQELTYDYNYGKVEDKNGKEKVKPCFCGSPDCSRRLY

SEQ ID NO: 16052 - protein, 895 aa, Oryza sativa
MGHSNVWNSHPKNYGPGSRVCRVCGNPHGLIRKYGLMCCRQCFRSNAKDIGFIKPPRAGLDPEATPPASIASRFESKDQEKLGVQLSSMPQVRPASAEKPTRQWAAWTRQEEQSFFNALRLEGKNFEKITLRVQSKNKDQHQHPVAYTYILADFRGSTGEGCRANLGMDCAIISEGEWADTLTDISVGYLLTEASIGTNTDCPGTAIAKNTLFLENPCSYDSFDAAVALHASRHKTVEQPALASHSTIWGAEETCDEFSFNLAASRKQESSNTSASSCPGSDSGVLPSTSQGFQGFLQDLAGAKVADNPCMDDAKDMEALCANSPPRSKSDSGLKDQSLADLYWAQVTLTAHIAPLTRGSPVQVAVVLAHEIAWRHGHLYDDLTFDLEVLLVVREVGHWIPETFRAPLVERTVRAIDSSLALSIGRRDPRWAEFPADFLGGFVILRSHRVAMDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 16053 - protein, 620 aa, Dechloromonas aromatica
MKFRTKTILGVALIEGVLLAILGIGILSLFRDANEQQITRRAAVSARLLAASARDAMVAYDLATIDGIASDVLETGEISYVRFLDGQGRVMVERGALPSQPEFAAGVSQTEDGVLDRAVPITVSGESFGQIQFGIDIAPFTLALNRTQRWFMALSALEMGLVAFFSLILGTYLTRQLTALRNASREIAEGRFDRPLKIDGNDELAETAQAFNHMVEKVAGSISSLRESKAKLRQAKEEAESANAAKSQFLANMSHELRTPMTGIIGMSFLMMRTELDEQQRDFADTIQRSANALLIIINDILDLSAIEAEKLRLAHANYSARKVIGEVLALISPSADAKNISLISQIADDLPEILVGDAIRLRQVLLNLLGNAIKFTEQGSVTLEVAHQPTDDGRQRLNFVVRDTGIGMTPGVVNALFTPFFQADLSNTRRFGGTGLGLSISRRLIELMHGEISAESEPDVGSTFRFHIVADLPETSVAEEQPQKADGERHFDARRILVVDDRQINRKVVGAMLERLGCHVLMAEHGEEALARLATEVVDLVLMDCQMPVMDGFEATRRIREGEDSRIDPATKIIAMTANAMEGDKQRCLAAGMNDYISKPIFAAELERILTTWLPATPA

SEQ ID NO: 16054 - protein, 831 aa, Rhodobacter sphaeroides
MTLTRRDLIKAQAAATAAAAAGLPVSALAQPVTGGAEALRIRWSKAPCRFCGTGCGVMVGTRDGQVVATHGDTQAEVNRGLNCVKGYFLSKIMYGEDRLTTPLLRMKDGVYHKEGEFAPVSWDEAFDVMAAQAKRVLKEKGPKAVGMFGSGQWTIWEGYAASKLMRAGFRSNNLDPNARHCMASAATAFMRTFGMDEPMGCYDDFEAADAFVLWGSNMAEMHPILWSRLTDRRLSHEHVRVAVLSTFTHRSMDLADTPIIFRPGTDLAILNYIAHHIISTGRVNRDFVDRHTNFALGATDIGYGLRPEHQLQLAAKGAADAGAMTPTDFETFAALVSEYTLEKAAEISGVEPALLEELAELYADPDRKVMSLWTMGFNQHVRGVWANHMVYNLHLLTGKISEPGNSPFSLTGQPSACGTAREVGTFAHRLPADMVVTNPEHRAHAEEIWKLPAGLLPDWVGAHAVEQDRKLHDGEINFYWVQVNNNMQAAPNIDQETYPGYRNPENFIVVSDAYPTVTGRCADLVLPAAMWVEKEGAYGNAERRTHFWHQLVEAPGEARSDLWQLMEFSKRFTTDEVWPEEILSAAPAYRGKTLFEVLFANGSVDRFPASDVNPDHANHEAALFGFYPQKGLFEEYAAFGRGHGHDLAPFDTYHEVRGLRWPVVEGEETRWRYREGFDPYVKPGEGLRFYGKPDGRAVILGVPYEPPAESPDEEFGFWLVTGRVLEHWHSGSMTLRVPELYKAFPGAVCFMHPEDARSRGLNRGSEVRVISRRGEIRTRLETRGRNRMPRGVVFVPWFDASQLINKVTLDANDPISRQTDFKKCAVKIEAV

SEQ ID NO: 16055 - protein, 112 aa, Chromobacterium violaceum
MKLVTAVIKPFKLDEVREALSAIGVQGITVSEVKGFGRQKGHTELYRGAEYVVDFLPKVKLEIAIDDALLDQVVEAIEKSARTGKIGDGKIFVYDLEQVIRIRTGETGADAV

SEQ ID NO: 16056 - protein, 250 aa, Physcomitrella patens
MAKSYPNVSEKYAALIEKARRKIRGMVAEKNCAPIILRLAWHGSGTYDQESKTGGPLGTIRFGQELAHGANAGLDIAVNLLQPIKEQFPELSYADFYTLAGVVAVEVTGGPTIPFHPGRKDHETCPVEGRLPDATKGLDHLRCVFTKQMGLTDKDIVVLSGAHTLGRCHKDRSGFEGAWTPNPLRFDNSYFQVLLEGEKDGLIMLPSDKALLDEPKTRELVELYAKDEDKFFEDYAESHMKLSELGFAEA

SEQ ID NO: 16057 - protein, 762 aa, Unknown
  Synechococcus sp. WH 7805
MVTTPDAAGIGGFSIHRIAAMSPTTASVQSQCPYCGVGCGLDLLPPGEAGKAVKRDAEGNPMWSARGHREHPSSHGQVCIKGATVGETLGQGRLSQPLYRATLADPFQAISWNSAFDLLTERIRSTLASKGADAIAMYGSGQFHTEDYYIAQKLLKGALGTNNFDANSRLCMSSAVAGYTRSLGSDGPPCCYEDLDHCSVAFLIGTNTADCHPVLFQRLLKRKKRDPKGLTIVVIDPRCTDTAKIADYHLALAPGTDLALLHGLARLVLQDNGFDSDFIDSATEGFAAFTQTIKAWTPGKTSKFCGIAEKDLRSVARLWSRKEGILSLWSMGVNQRREGTAVVGGLINLHLLTGEIGKAGAGPFSLTGQPNAMGGREAGGLAHLLPGYRLVTNAEHRHAVEKAWGFAPGSIAAQPGLDAWKQVEAMERGELDLWWVAATNPLVSMPDLERVKAAMQRCKLVVVSEAYADTETSHYAHLLLPAAQWSEKSGAMTNSERRVTLCPAFRPRHGDSRADWEVFAELGRRLGFVDQFSYSSAAEVYEEFTSLTAARVCDMSGLSHSLLKEHGPQQWPYPKGEGPTRTSKRLYEKKRFPTASGRARFQKDSPLGLAEPPCEMYPLVLTVGRYLGQWHTMTRTGKVARLNAMHPEPSLEMHPSDAKRFGLEDNGLAAITSRRGTLTARVCVSERIRVGSVFLPMHWGFTQAEACEANALMHDQACPISKQPELKASAVVVAPAVSVVKPTEQDTGVLENLRRLLTPALR

SEQ ID NO: 16058 - protein, 335 aa, Fusobacterium nucleatum
MAKISVIGSGGWGIALAILLHKNGHNLTIWSFDKKEAEELKTTRENKTKLPNILLPEDIKVTDDLKEAVNDKDILILAVPSKAIRSVSKSLKDIIKDNQIIVNVAKGLEEDTLKTMTGIIEEELKEKNPQVAVLSGPSHAEEVGKGIPTTCVVSAHNKELTLYLQNIFMNPSFRVYTSPDMLGIEIGGALKNVIALAAGIADGLNYGDNTKAALITRGIKEISALGVAMGGEQSTFYGLTGLGDLIVTCASMHSRNRRAGILLGQGKTLDEAIKEVNMVVEGVYSAKSALMAAKKYNVEIPIIEQVNAVLFENKNAAEAVNELMIRDKKLEIQSW

SEQ ID NO: 16059 - protein, 522 aa, Unknown
  Synechococcus sp. WH 7805
MLGELWSFQGRYRTLHLTWFAFFLTFVVWFNLAPLATTVKADLGLTVGQIRTVAICNVALTIPARVLIGMLLDKFGPRLTYSTLLVFSVIPCLMFASAQDFNQLVVARLLLSIVGAGFVIGIRMVAEWFPPKEIGLAEGIYGGWGNFGSAFSALSLVGLAGWLSFSGGFELPTGAVLNWRGAIALTGIISAIYGVIYYFNVADTPPGKVYQRPERTAGLEVTSMRDFWGLLGMNVPFAAILCVLCWRLQKVGFLNASTYPLALLAVLVWFVFQTWGIVRTNRELIMGTKVYPKEDRYEFKQVAILELTYIVNFGSELAVVSMLPTFFETTFDLPKATAGILASCFAFVNLVARPAGGLISDKLGSRKNTMGFLTAGLGFGYLIMSLIKPGTFTGSTGIVIAVLITMLASFFVQSGEGATFALVPLVKRRVTGQVAGLVGAYGNVGAVTYLTIFSLLPLWMGGAGEPTPETIAASNSAFFQILGIAGLIVAFFCFFFLKEPKGSFADLHEGETASEGTPSMAG

SEQ ID NO: 16060 - protein, 1108 aa, Chlorobium tepidum
MPKKQAVTSYQPESLWYKDAIIYELHVKTFCDSDNDGIGDFRGLKSRLGYLESLGVTAIWILPFYPSPLRDDGYDIADYKSVNPDYGTIEDFRDFLEEAHRRGIKVITELVVNHTSDQHEWFKKARKAPKGSPERDFYVWSDDPTKYGEARIIFQDFEASNWTWDPVAGQYYWHRFFHHQPDLNFENPAVHQALFDVLDFWLGMGVDGLRLDAVPYLYEAEGTNCENLPQTFEFLRKLRSYVDEHYPNRMLLAEANQWPEDSAAYLGKGDMCHMNFHFPLMPRMYMALATEDRFPIIDILAQTPEIPESCQWASFLRNHDELTLEMVTDEERDYMRRVYAHDVKARINLGIRRRLAPLMSNDRRRIELMNIMLLSLPGTPVLYYGDEIGMGDNYYLGDRDGVRTPMQWNADRNAGFSRANPQRLLLPVIIDPEYHYEAVNVEVQESNPNSLLWWMRHTIATARRFRAFSRGTIEFLNANNPKVLMFIRSYEDETILTVINLSRNAQVINVDLSAYEGCVPEEIFSMNRFPRVHKTPYMVALGPYGYFWLRLIREESPADRSALLEKVALRAGSWQELFVGRSLDQFETAILPPYYKSVRWFGGKARNIIRIRVTDTVPVAGMENTAFAMTEVNYPSGENERYQLPLTFVPVERGNLADELFYRHAIARVELDGLEGFLIDASADETFRSRLLDLILHRETWSGAAGKITADAGKMLENSCLSTAGEEPPASHLMGLEQSNTSIRYGEQLCLKLYRKIDSGMAPEIEISRVLTDQTEYRNIPVYLGSFDYGKSYRERCSLGILQNFVPNESDGWQLSLGHVRRYYEDVLSRCSQGVLPPTLPELSGTTSKLPELIHELIGEFYFQMVGKLAERTAGMHRALGSVDTDAAFSPEPFTTLYQRSIYQAMTDQVKRSMIFLRESIHAVPKEARPLAHKLLDMQKEILEQFEPIRKEKIDTVKIRIHGDYHLGQVLYTGNDFVILDFEGEPARSLSERKIKRSVYRDLAGMLRSFDYAAFNVLMQNQAIRPEDRKALEPWAELWSYYVGQHFIDVYTQQTEGSGLIPKEPRQRELLLRSYLMNKAIYELNYELNNRPEWLPIPMNGILRLIRN

SEQ ID NO: 16061 - protein, 112 aa, Burkholderia xenovorans
MKRITAVIKPFKLDEVREALAEVGLTGLTVTEVKGFGRQKGHTELYRGAEYVVDFLPKVKIEVVVADIQCDQVIDAIIGAARTGKIGDGKIFVADVERVIRIRTGEENEAAV

SEQ ID NO: 16062 - protein, 890 aa, Glycine max
MAASVDQRPYPGLHNGVVRPLKPGPDIPRPKKLPQPPPPLSDSSSDEEEDTTLNLKDLIRKGTTEVESSIFDPRDDGTSDHWIQRNSSLVRLTGKHPFNSEPPLPRLMHHGFITPVPLHYVRNHGPVPRARWEDWTVEVTGLVTRPTCFTMEQLLHDFPSREFPATLVCAGNRRKEQNMVKQSIGFNWGAAAISTSVWRGVPLRTLLKSCGIYTRTKGALHVCFEGAEDLPGGGGSKYGTSILREVALDPSRDIILAYMQNGEPLSPDHGFPVRMIIPGFIGGRMVKWLKRIIVTTDQSQNYYHYKDNRVLPSHVDAELANAQAWWYKPDYIINELNINSVITTPCHEEILPINSWTTQMPYFIRGYAYSGGGRKVTRVEVTLDGGETWQVCTLDCPEKPNKYGKYWCWCFWSVEVEVLDLLGAREIAVRAWDEALNTQPEKLIWNVMGMMNNCWFRVKTNVCRPHKGEIGIVFEHPTQPGNQSGGWMAKEKHLEKSSESNPTLKKSVSSPFMNTTSKTYTMSEVRRHNNADSAWIIVHGHVYDCTRFLKDHPGGTDSILINAGTDCTEEFEAIHSDKAKQMLEDYRIGELTTTCYNSDSSSSNPSVHGSSDTIPLTPIKEVITPMRSVALNPREKIPCKLISKTSISHDVRLFRFALPSDDLLMGLPVGKHIFLCATVDEKLCMRAYTPTSSVHEVGYFDLVVKVYFKGVHPKFPNGGIMSQHLDSLPIGSVLDVKGPLGHIEYTGRGNFLVHGKPRFATRLAMLAGGTGITPIYQVVQAILKDPEDCTEMHVVYANRTEDDILLKEELDEWAKKYDRLKVWYVIQESIREGWEYSVGFITESILTEHIPNASPDTLALTCGPPPMIQFAVQPNLEKLGYDTQNNLLVF

SEQ ID NO: 16063 - protein, 407 aa, Myxococcus xanthus
MPGGRRPGATASETTWGPRAYTQKHPRSRELPETASMPTASTSSSLARRLMPLALAALAVLSACTEARGAAPAAPGPTIQDTRRYEKPSDADLRRTLSPLAYEVTQKGATEPAFRNPLWNHHEEGLYVDVVSGEPLFSSRDKFDSGTGWPSFTRPVDSARIVEKRDSTQGMERVEVRSKAAGSHLGHLFGDGPAPAKTRYCINSAALRFVAVNDLAKEGYGAWLPLFGRPAPAAATKRQDTSPFTETALLAGGCFWGMEDLLRKIPGVVQTEVGYTGGSSAFRNPTYHDVSSDKTGHAEAVRVVFDPTRLTYETLLEQWFFRMHDPTTLNRQGNDVGTQYRSAIFYLSDAQKRVAEEVKARVDASRKWPRPVVTQIVSAGAFTPAEDYHQDYLVKNPGGYTCHYMRD

SEQ ID NO: 16064 - protein, 949 aa, Rhodococcus fascians
TDRMTSTASAFVDRHVGPDTTELARILDAIGVDSLDELARKAVPESILDTVVDGVPDGLATLPPALSEHDALAALADLAGCNTVATSMIGLGYYDTLTPPVLTRGILENPAWYTAYTPYQPEISQGRLEALLNFQTMVSDLTGMDVANASMLDESTAAAESMTLMRRANRGSKSPRLVVDSDIFPQTKAVLATRAEPLGIELVYADLADGLPEGDFFGVLAQLPGASGRLVDHTATIEAAHERGALVAVGVDLLAATLVTAPGEIGADVCFGTTQRFGVPMGYGGPHAGYLAVRSGHSRQLPGRLVGVSVDADGHRAYRLALQTREQHIRREKATSNICTAQVLLAIVAAMYASYHGADGLRAIARRVNTRARTVAAGLQAAGIDVVHAEFFDTVLAAVPGAAHTVVDAAKQRGINLRPVDDDHVAIACDEATTEAHIVDVLAAFGAEPAGPGAESVPADCARTSEYLTHPAFTRYRTETAMLRYLRALSDKDIALDRSMIPLGSCTMKLNATAEMESITWPQFARQHPFAPSTDVPGLLRVIADLEQWLVDITGYDAVSLQPNAGSQGEYAGLLAIRRYHQANGDTGRTVCLIPSSAHGTNAASAVMVGMRVVVVACRPNGDVDVDDLRAKIAEHADTLAAIMITYPSTHGVYEHEISDICAAVHDAGGQVYVDGANLNALVGLARPGRFGGDVSHLNLHKTFCIPHGGGGPGVGPIGVRSHLQPYLPGHPLAPQLGDGPTVAGAPYGSASILTITWAYIAMMGAQGLRRATLTAIASANYIARRLDEYFPVLYTGDNGMVAHECILDLRGLTKDTGVTVDDVAKRLADYGFHAPTMSFPVPGTLMVEPTESENLEEIDAFCDAMISIRREIDRVGSGEWTVEDNPLRGAPHTAQCLVADWNHPYSRELAAYPAGYDRPKVWPAVRRIDGAHGDRNLVCSCPPIEAFA

SEQ ID NO: 16065 - protein, 335 aa, Mesorhizobium loti
MSDNKPFGGSFGSNGGQYATTVQYGGTAAAPAKVSLGDTPAAAPAGDVIKDTTTAAFAADVIQESRRQPVLVDFWAPWCGPCKQLTPQLEKAVRAAGGKVKLVKMNIDDHPSIAGQLGIQSIPAVIAFKDGQPVDGFMGAIPESQIAEFITKVGGKGNGAPAVAEALAAATEAREAGDMQTAADIFDAILAQAPETIEAIAGLGELLFEAGDTEGAEALLATAPEAKKDAPVLAALRAKMALAAQAAELGNPAEFERRLAENPKDHQARFDLAMIQNARGERTAAADNLLAIIKADRGWNEDGARTQLLQFFEAWGMTDEATLAARRKLSALLFS

SEQ ID NO: 16066 - protein, 616 aa, Oryza sativa
MASSKETYRVELRAAARQLGERGLYSAAKWAAELLVGIEPDATPAPSLVMDTPSSSGSAASGGRLLHLHRSGGSSFRRRLRPGAAEAGTPLGGVSYVSTPIPDDDAFDVGGDRYLLAKTYFDCREYRRAAHVLRGQTGRKAVFLRCYALYTAGEKRKEEETVELEGSLGKSNAVNQELVALERELATHRRTGAIDSFCLYLYGIVLRDKGSEALARTVLVESVNSYPWNWSAWLELQSLCTSSDILNNLNIKNHWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKDLERMEVEERQGQNFVEALLFLAKHCKSIGRFEEAEHYCTRLLDYTGPERETAKSILQGLKRAQSVLPLMDIDHFAIKLHIAGDVDLVCMMISSSC

SEQ ID NO: 16067 - protein, 498 aa, Leptospira interrogans
MQTALYISVLIISSCGLVYELLAGTIASYLLGETVTQFSLIIGTYLFSMGVGSWLSKYLEKDLIPKFLEIELAIGLVGGFSSAILYLSFGQIRYFQIPLFLLVILIGILVGLEIPVLLRILKKELQFKELVSRVLSLDYVGALLASILFPIFFAPKLGLMRTGFIFGILNVGVALWGTWVLPLRQSKIIILRAQSVVVLTLLILGFSYSDLITYYSEESLYTDEIILSKQTQYQRIIVTRWKNEIRLFLNGHLQFSSRDEYRYHETLVHPALLAHPAPKKVLVLGGGDGLAVREILKHKNVESVTLVDLDSAITNLFSEHGILKELNEESLKNSKVTVINTDAFLWLEESDQTFDVVLIDFPDPSNFSLGKLYTTAFFHTLKRRMNETSVLEIQSTSPLFARSSYWCIERTIASLGFYTLPLHVYVPSFGEWGFVLAGQRPIQFKKKFPKDLKFLNIQELESIQTFPQDMSRVPVEINRLDNQALVRYYDREWNRILD

SEQ ID NO: 16068 - protein, 323 aa, Salmonella enterica
MSKIFEDNSLTIGHTPLVRLNRIGNGRILAKVESRNPSFSVKCRIGANMIWDAEKRGVLKPGVELVEPTSGNTGIALAYVAAGRGYKLTLTMPETMSIERRKLLKALGANLVLTEGAKGMKGAIQKAEEIVASNREKFLLLQQFNNPANPEIHEKNTGPEIWGETDGQVGLFISGVGAGGTLNGVGRFLKSPRGKKNLITVAGEPTDSPVIPQALAGEELKPGPHKIQGIGAGFIPGNLDLKLVDKVIGITNEEAISTARRLMEEEGILAGISSGAAVAAALKLQEDEAFTNKNIVVTLPSPGERYLSTALFADLFTEKELQQ

SEQ ID NO: 16069 - protein, 435 aa, Rhodobacter capsulatus
MSVPPFTIRPAAPRLDGPTGPVAVAPGVHWVGALDPGLRNFDVILKTANGTTYNAYAVRGSEGVAVIDTVKAEFAGDFFARLEAVARYDEIRLIVLNHLEPDHTGAVPELLRRAPQAQVRLSPRGLPMLRALLKDDFERYDIKGVTTGQSVSLGDRDLQFFTTPFVHWPDTQCTWLAAERVLFTCDLFGSHYCDGRLFNDLVGDFRFSFEYYFDRIMRPFRSFVAQALDLIEPLDFGIIAPAHGPILRSHPRDYLTHTRRLISSRLAAETGSEKTLLIFYVSAYGATAQLAQAIHDGAAESPDVRVSLFDLEGGEITPFLDLIEEADGIALGTPTINGDAVRTIWEMLAALVDIETRGKLGAAFGSYGWSGEAVRLVETRLQGLKMRLPEPGLRVKLHPSAAELKEGRAFGRRLADHLTGRAAPREVDFAEIAAR

SEQ ID NO: 16070 - protein, 419 aa, Archaeoglobus fulgidus
MKKVHIFLRLRTQVGASRYRWVVFGVMASIYFFVYFHRTSSAILATTLMEEFAVTALAVGVLSSAYFYPYGLMQIPVGYLSDTKGPRLTTTVFTLLAFVGTVLFAVSPNFEVAVLGRFLIGIGVSGVYIPTIKLLSRWFRVDEFATLTGVLFAVGNMGALVSAYPLATMVSLFGWRVTFLFIGAITFVLALSCWIFVRDSPGGVLEKSREGGRFATNFRVVVLNPVVWLIATSAFLRYGIVMGYQGLWGGPYLMDVYGMQREEAGGVLMMVGLGTILGAPIIGFLSDKVFRTRKWFLVAAGIGFTFTMAPLVFFTASLTVFQLYAISFLIGLFSAAGPVAYALIKESYPLEVTGLATSIVNVFPFFGGALFQVFMGYLMDTVGMVDGSYPPEAYSLAFSFCLAASVVSAVLILFVHEKR

SEQ ID NO: 16071 - protein, 321 aa, Haemophilus influenzae
MIKKIAVLTSGGDAPGMNAAIRGVVRSALAEGLEVFGIYDGYQGLYNNKIKQLNRYSVSDVINRGGTFLGSARFPEFKDPNIRAKCAEILRSHGIDALVVIGGDGSYMGAKLLTEEHSFPCVGLPGTIDNDVAGTDYTIGYQTALQTAVDAIDRLRDTSSSHQRISIVEIMGRHCSDLTISAGIAGGCEYIVASEIEFNREELIQQIERSIIRGKRHAIIAITELLTDVHSLAKEIEARVGHETRATVLGHIQRGGSPCAFDRILASRMGAYAVDLLLQGKGGYCVGIQNEQLVHHDIIDAINNMQRVFKADWLKVAKRLE

SEQ ID NO: 16072 - protein, 531 aa, Escherichia coli
MMMFKAQEINMLDTNMKTQLKAYLEKLTKPVELIATLDDSAKSAEIKELLAEIAELSDKVTFKEDNSLPVRKPSFLITNPGSNQGPRFAGSPLGHEFTSLVLALLWTGGHPSKEAQSLLEQIRHIDGDFEFETYYSLSCHNCPDVVQALNLMSVLNPRIKHTAIDGGTFQNEITDRNVMGVPAVFVNGKEFGQGRMTLTEIVAKIDTGAEKRAAEELNKRDAYDVLIVGSGPAGAAAAIYSARKGIRTGLMGERFGGQILDTVDIENYISVPKTEGQKLAGALKVHVDEYDVDVIDSQSASKLIPAAVEGGLHQIETASGAVLKARSIIVATGAKWRNMNVPGEDQYRTKGVTYCPHCDGPLFKGKRVAVIGGGNSGVEAAIDLAGIVEHVTLLEFAPEMKADQVLQDKLRSLKNVDIILNAQTTEVKGDGSKVVGLEYRDRVSGDIHNIELAGIFVQIGLLPNTNWLEGAVERNRMGEIIIDAKCETNVKGVFAAGDCTTVPYKQIIIATGEGAKASLSAFDYLIRTKTA

SEQ ID NO: 16073 - protein, 142 aa, Oryza sativa
MAARAHDVAALAIKGRAAHLNFPDLAHELPRPATAAPKDVQAAAALAAAADFPASSANAGASNNPDGSDDASAGSASPPPPPDAADDALFDLPDLLLDLRYGPPSSGLSCASSWEDEVGLISGAGAAAAGVFRLEEPLLWEY

SEQ ID NO: 16074 - protein, 128 aa, Mycobacterium tuberculosis
MPKSFYDAVGGAKTFDAIVSRFYAQVAEDEVLRRVYPEDDLAGAEERLRMFLEQYWGGPRTYSEQRGHPRLRMRHAPFRISLIERDAWLRCMHTAVASIDSETLDDEHRRELLDYLEMAAHSLVNSPF

SEQ ID NO: 16075 - protein, 431 aa, Leptospira interrogans
METKIQNFGECSIPSPADYEYYTSDTSRLIFRTVFQSKEDWNSYVQEGPDFFEQAGPREKIYFNPQEVTAGIVTCGGLCPGINDVIRGIVMELYYRYGVSRILGFPYGYQGLVKRYSHQPIELTPEKVAHIVDEGGSMLSSSRGNQSPEEMVDSLSFYGVKILFCIGGDGTLRGARTIVDEIAKRKEKISVVGIPKTIDNDINYVQKTFGFSTAFSKAMEAVECAHVEAKGAPNGIGLVKLMGRHSGFIAVNAALASRNVNYCLIPEVDFDLFGNEAFLDDLKKRIQKKGHAVIIVAEGAGQKFFDSTEERDSSGNLKLKDIGLFLKDTMTEFFKKENIPVNIKYIDPSYIIRSIPANAEDSVFCGFLAQNAVHAGMAGKTDMVVGMWNNVFTHLPISVAIQERKVLQPDRSTLWRSLLASTGQPAHMLAK

SEQ ID NO: 16076 - protein, 457 aa, Xanthobacter autotrophicus
MRHHRLTPQRDPAMATASAARTDVSAVAGRSVPPVEGGADLAAYMSDMGRRARAASRTLALTPPEAKTQALHAAAAAIRAAADEILAANAGDVAKAKADGMTGSFLDRLTLTPARIAAMAEGVEQVAALSDPVGEVTESWTRPNGLKIERVRTPLGVIGVIYESRPNVTADAAALCLRAGNAVILRGGSDSIASSGAIHRAFVSGLKSAGLPEDAVQFVAVADRAAVGLMLAGLDNNMDVIVPRGGKSLVARVQSDARVPVFAHLDGINHVYVDKAADLDMAKTVVLNAKMRRTGVCGAAETLLVDQAVAATHLKPLVEMLIDAGCEVRGDEAVQAVDGRVKPATPLDWDTEYLDAIIAAKVVDGLAGAVAHIEAHGSHHTDSIVTEDVATAERFLAEVDSAIVLHNASTQFADGGEFGFGGEIGIATGRMHARGPVGAEQLTSFKYRIHGSGQTRP

SEQ ID NO: 16077 - protein, 487 aa, Escherichia coli
  misc_feature (415)..(415): Xaa can be any naturally occurring amino acid
MSLAKDNIWKLLAPLVVMGVMFLIPVPDGMPPQAWHYFAVFVAMIVGMILEPIPATAISFIAVTICVIGSNYLLFDAKELADPAFNAQKQALKWGLAGFSSTTVWLVFGAFIFALGYEVSGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGIQISWLQWFLCFLPVGVILLIIAPWLSYVLYKPEITHSEEVATWAGDELKTMGALTRREWTLIGLVLLSLGLWVFGSEVINATAVGLLAVSLMLALHVVPWKDITRYNSAWNTLVNLATLVVMANGLTRSGFIDWFAGTMSTHLEGFSPNATVIVLVLVFYFAHYLFASLSAHTATMLPVILAVGKXIPGVPMEQLCILLVLSIGIMGCLTPYATGPGVIIYGCGYVKSKDYWRLGAIFGVIYISMLLLVGWPILAMWN

SEQ ID NO: 16078 - protein, 476 aa, Unknown
  Bradyrhizobium sp. BTAi1
MQYLPVFLDLKTGPVLLIGAGELVRAKLRVLLAAGARIRWFATDGDFELGGLHDDHGQIARADGDPLSADLSGVIAVLCAGAGDIGVAMSARARAVGLPVNVMDDLAHSSFIFPAIVDRGDVVVAIGTGGSSPVVARRVRERIEALLPARIGELASFIGDFRKTINPRIPEMPLRRRFWERIVDGPIGALVLAGRKHEAAAALHGIADPSAFAGADHAGRSDGHVTLVGAGPGDPDLLTIKALRALQDADVVYYDELVTPEILDRIRRDASRVPVGRRVGKPGIGQDAVNKLLIEAAREGKRAVRLKGGDSYVFGRGGEEVDALRHAGVAYTIVPGITAGIGAAAQFEVPLTFRSKALRITFLTAHKERDAEAVDWSALTDTKMTVVVYMGMTAAPAVRAGLLAAGRSPQTPVGVFARVTRPDAQAAVGTLDQLPDLVGQIDGGPAILIIGDVVAHSAPWRQKNLSGVIAKLLEPV

SEQ ID NO: 16079 - protein, 286 aa, Buchnera aphidicola
MDHKKTWHEKLYCHLGQYFLIEKMLYKKKTPHHQVMIFKNSVFGKIMVIDDIVQTTERDEFIYHEMLTHVPIIAHGSIKSVLIIGGGDGGILREVCRYKMIENITMVEIDVNIIDLCKKYFPNHSNQAYQDSRLNLIIDDGLNFIKRTKEKFDLIISDSTDPIGCGKNLFRSEFYFNCKNHLEENGIFVAQNGVFFLQKNETILTYKNLKKYFYDTRFYQANVPTYYGGVMVFAWGTNNIEYRKNSLEKIQIRIKNTKLDFNYYNAKIHISSFYLPQYILNELNES

SEQ ID NO: 16080 - protein, 386 aa, Xanthobacter autotrophicus
MTSTDSTSDPTAPKTPVFTDFRRIVIKVGSALLVDRDHGRVKLAWLTSLVEDIATLHARGCEVMVVSSGAIALGRTVLGLPKGPLKLEDSQAAAAVGQITLSRTWAQILGHYGITAGQVLLTLGDTEERRRYLNARSTLGRLMDLKAVPIINENDTVATTEIRYGDNDRLAARVATMASADLLVLLSDIDGLYTAPPAQDPSATLIPVVPRIGAEIEAIAGDAGSELSRGGMRTKIEAGKIATSAGTHMVIASGHAKNPLKRIREGGRCTWFLTSANPVRARKSWIAGALEPRGTLHLDDGAVAALRRGASLLPAGVKRVEGLFDRGDAVVLRGPDGAEVGRGLVAYDSTHAARIMGRSTHEIEALLGVPGRSEMVHRDDMALGVE

SEQ ID NO: 16081 - protein, 300 aa, Nicotiana tabacum
LCGPISGMIVQPVVGYYSDNCSSRFGRRRPFIAAGAALVTIAVFLIGFAADLGHASGDPLGKGSKPRAIAVFVVGFWILDVANNMLQGPCRALLADLSGGKAGRMRTSNAFFSFFMAVGNVLGYAAGSYSRLYKIFPFSKTPACDIYCANLKSCFFIAVFLLLSLTILALTVVRENELPEKDEHEIDEKAGGGGKSKVPFFGEIFGALKDLPRPMWILLLVTCLNWIAWFPFFLYVTDWMAKEVYGGKVGDGRLYDLGVHAGALGLLLNSVVLGFMSLSVEFLGKKIGGVKRLWGILNFV

SEQ ID NO: 16082 - protein, 426 aa, Clostridium cellulolyticum
MIRKEMIAMLLAGGQGSRLGVLTKNVAKPAVLYGGKYRIIDFSLSNCTNSGIDTVGVLTQYQPLKLNAHIGIGKPWDMDRIEGGVTILSPYLKAEMGEWFKGTANAVYQNIQYIDKYSPHYVIILSGDHIYKMDYSKMLDFHKENHADATISVINVPYEEASRYGIMNCHENGKIYEFEEKPKNPKSTLASMGVYIFTWSTLREYLIKDNECSDSVNDFGKNIIPAMLGDGKSMWAYQYSGYWRDVGTIQAFWESSMDLVSRVPQFNLFDPEWRIYTPNPVKPAHYIASSACVKKSIIAEGCSVHGTVINSILFPGAYIEEGAVIQDSIIMSNSRVCKNAYINRSIISEQAIIGEKARLGEGPDVPNEYKPGIYDSGITVVGEKSSIPADPVIGKNVMIDIGASAVDFTSLNVQSGKSVFKGGVAE

SEQ ID NO: 16083 - protein, 849 aa, Rhodobacter sphaeroides
MDIEQKLAKERRARLAAERLLEYKQRELFAANEKLAIHARALSDQIIEQRAVVKTALSEAEKLKGQNSRFLSELERAHTAAVMAERRLWDSIDAIEDGFAVFDAGQRLVAANEAYRCHFEGLEVRPGMALADLLQLATTHGLIDLRGEPADHWRQRMIRRWDEDPVEPEIVRRCTGQWLRLVNRRARDGDMVSLLIDITEQMRLRAAIDAIPDGFVLFDRAERLVLCNDRYRAIYPRSAEALRPGAPFEEILRHGLAHGQFPEAAGREEEWLADRLAAFRHLGGAAEQQLDDGRWLRVIEHETPDGGRVGLGVDITELKRQQAALESARAAAEAASRAKSAFLANMSHEIRTPMNGIVGMADLLCETVLTEDQRLFSETIRSSGEALLVIINDILDYSKIEANRLTLHPEPFDLERTIHEVAMLLQPKARAKGIDLLIDFDLFLPTRFVGDPGRLRQVLTNLIGNAVKFTAAGHVLIRVVGLEVAPGRHDLRVTVEDTGIGIAPEHLDHVFGEFNQIEAEATRRFEGTGLGLAITRRLIELMQGAVWVESEPGRGSCFGFRLTLPAADDEAAPPVPIEVRRALVVDGQFINRTILERQLAPCGISVTLCRSGIEALAELSADAGYDLLLTDHEMPDLDGLALAQRVRAGGFSMPILLLTSNPSAVRDHPAEALLAGVLQKPLLRSDLYRRLQSLTAPPAAPDRPPPVPVPALRRMRVLAAEDNRTNQLVFGKMVRDLDIDLTFADNGREAVELYDRIRPDLVFMDISMPEMDGRAAARAIRARERGGTHVPIVALTAHALESDARASAAAGIDRTLTKPLRRAMILETLAAFCPAGTRPIQPALVEGPD

SEQ ID NO: 16084 - protein, 188 aa, Brassica napus
LIVHRDVKSNNILLDSNFEAHVADFGLAKFLQDSGTSECMSAIAGSYGYIAPEYAYTLKVDEKSDVYSFGVVLLELVTGRKPVGEFGDGVDIVQWVRKMTDSNKDSVLKVLDPRLSSIPIHEVTHVFYVAMLCVEEQAVERPTMREVVQILTEVPKMPPSKDQPATELAGEEKTATEGGQGQPDLLDL

SEQ ID NO: 16085 - protein, 112 aa, Mycobacterium smegmatis
MKLITAIVKPFTLEDVKTGLEQTGILGMTVSEVQGYGRQKGHTEVYRGAEYSVDFVPKVRVEVVVDDSAVDKVVDVIVQAARTGKIGDGKVWVSPVETVVRVRTGERGADAL

SEQ ID NO: 16086 - protein, 561 aa, Rhodobacter sphaeroides
MCAKATMEEFEALLNESLQIDTPQEGSVVKGKVIAVEAGQAIIDVGYKMEGRVDLKEFADMSGSVDISVGDEVEVYLDRVENARGEAVISRDKAKREEAWDRLEKAYANETRVEGAIFGRVKGGFTVDLGGAVAFLPGSQVDVRPVRDAGPLMGMKQPFQILKMDRRRGNIVVSRRAILEESRAEQRAEVISNLFEGQTVDGVVKNITEYGAFVDLGGVDGLLHVTDMAWRRVNHPSEILSIGETVKVQVIKINKETHRISLGMKQLQSDPWDAVEKAYPIGSVHKGRVTNITDYGAFVELEAGVEGLVHVSEMSWTKKNVHPGKIVSTSQEVDVMVLEIDSAKRRVSLGLKQTMRNPWEVFAETHPVGTPIEGEVKNITEFGLFVGLEHDIDGMVHLSDLSWDQRGEEAIQNYRKGDVVKAVVTEVDTDKERISLSIKALGDDTFSEAIEGVKRGSVITVTVTAIEDGGIEVEYNSMKSFIRRSDLSRDRADQRPERFQVGDKVDVRVTNVDAKTRRLGLSIKAREIAEEKEAVEQYGSSDSGASLGDILGAALRNSDRG

SEQ ID NO: 16087 - protein, 356 aa, Arabidopsis thaliana
MSLLADLVNLDISDNSEKIIAEYIWVGGSGMDMRSKARTLPGPVTDPSKLPKWNYDGSSTGQAPGQDSEVILYPQAIFKDPFRRGNNILVMCDAYTPAGEPIPTNKRHAAAEIFANPDVIAEVPWYGIEQEYTLLQKDVNWPLGWPIGGFPGPQGPYYCSIGADKSFGRDIVDAHYKASLYAGINISGINGEVMPGQWEFQVGPSVGISAADEIWIPRYILERITEIAGVVVSFDPKPIPGDWNGAGAHTNYSTKSMREEGGYEIIKKAIEKLGLRHKEHISAYGEGNERRLTGHHETADINTFLWGVANRGASIRVGRDTEKEGKGYFEDRRPASNMDPYVVTSMIAETTLLWNP

SEQ ID NO: 16088 - protein, 259 aa, Staphylococcus epidermidis
MGKVYLVGAGPGDPELITLKGLKAIKEADVILYDRLVNKEILNYASLSTKFFYCGKDPHRHSLPQEETNKMMVTLAKKGHIVTRLKGGDPFVFGRGGEEAEELACHNIHFEIIPGITSGIAAPAYAGIPVTHRDYSSSVAFVTAVNKPGMDKGKYWQHLANGPETLCIYMGVKRLSEICELLIQYGRSSETPVALVHMGTSKQQMTVTGTLDTIQERAHHIQNPAMIIVGEVVKMREKINWFVEQATVQNETLTEMSST

SEQ ID NO: 16089 - protein, 910 aa, Chara corallina
MDSSKYVRYTNEQVEALERVYNECPKPSSARRSQLLQEYPILANIEPKQIKVWFQNRRCREKQRKEATRLINMNAKLSALNKMLMEENERLMKQTTELSMEVQVLRQELAKYRPPPQSNGENLGLGDQQPDWHHVQEHITRKVESGLSVDVTSPLMMNAVQIQRGVHEDGSTLSRSLSATSLSLRADASTTVTDASSEVVVNGVQPSVSVSSRADSQSALMQMASDMVGEFLGKATGTAVDWANMPGTKNGPDTFEMVFILRGGPGIASRVYGLVLMEPAKVASALKDRSQWLRECRKSEVLGEFRTDQGTVEIVYTQMFAPTTLAPPRDFCTFRYTTFMQDGSIVICERSMSGGTNLEPVPAFVRAEMHPSGYYIKPCNGNSIIYIVDHVDLKPLSVPEVLRPLYESSAALAQRQTMEALRYLRRLASDSNLDSPRANGHQALAWRGIAERIARGFNEAVNGFPDDGWVPLMGDGMDDVSVAARPLNGQRHSGSNPAMSGNSEALRASEGGVLCAKASMLLQNVPPALLIKFLREHRAEWVPADLELSSAAMMRGANGSFMAPGRNGEEIITPMPPVPLSGCYGTYLSDPSEEFLEVVKGGSQACGQESGIMSRQTLNLQLCSGTDTNAVAAVAQLVFAPVDAASSADDFSILPSGFRVIPIDAGLGVEGRPQSRTLDLAASLDTRDHSNREAVDGMSPGVCWRSVLTMTFQFSYKPHSENDMATVARVYVRSVVNYVQRVAMALAPAPPSRSQSQPFMVSLAQNLVRSYRLNLGMDLFSRQESQGTEAEDVFKSVWNHLEAIVCCSWKTSPAFIFANRAGLEMLETTMQGLFDLSWEKTVTDEHLRKCIYEGFSEAIRQNYCIFPTGVWTTASGKAIGYNKAIAWKVIDNDDKLQCVAITFFNCSPLN

SEQ ID NO: 16090 - protein, 646 aa, Xanthomonas campestris
MCGLAGMLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRDALTLLLRLGYIPAPACIHEHTFKLMPGRVLRMDAQAVAAGAAAHRPDQAQQPFWNAREAMQRALATPFTGTDAQAEEQLDSVLRDAVALRMVADVPVGVFLSGGTDSSIVTAMMQAQSAQPVHTFSIGFEGSHHDEAPLAREVATHLRTDHTELYVSGADALAVVPGLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVLGATEPDSFYSLADPLHGSGTPADAMMLADFAAYLPDDLLCKVDRTTMAVGLEARAPLLDWRVAEFAWSLPLSLKYRDGVSKYLLKRVLCRYLPDAMVYRGKRGFGAPVSAWLRGDLHGWADDLLAHGALQREGVFAADSVARLWRDFNGGERKWHTHLWTVLMFQAWQAHWREQRAAVVR

SEQ ID NO: 16091 - protein, 343 aa, Clostridium difficile
MVLNMEKVCVLGTGSWGSALALGLAKKGNDVSMWTRKEEQAKKINRTKENTDYLPGVLFPNNITISTDIEKTIKDCKVIVLAVPSQAVRSTCQKIKPFIKEGQVIVNVAKGLEKGTGLRLSQVCEEELPQNPYVILSGPSHAEEVARDIPTTVVVASKDLKIAQMIQDLFMSPKLRVYTNPDIVGVELGGALKNIIAFGAGICDGLGYGDNAKAALMTRGISEMSRLGIAMGANMSTFAGLSGIGDLIVTCTSMHSRNRRAGILIGKGMSLEDTLKEVKMVVEGITATEVAHDVAEKLDIDMPITNAIYSVIKKGSNPKEVGIELMMRSKKHEMEEVVLGDDI

SEQ ID NO: 16092 - protein, 493 aa, Aspergillus oryzae
MVYIGIPKNYTQSPSSFMATPSLTINHEVTQDLDSTNAFEGPEKLLEVWFAPSANELGSSQPTGLKAVPEEVWKDMLDLVNCQVLSIVSSEDVDAYLLSESSMFVWPHKLILKTCGTTTLLSGLPRILEIAALFAGFPKSAAPSGGVGIAAAPYRVFYSRKNFLFPDRQRGPHRSWRDEVRTMDRLFLNGSAYMIGKMNGEHWYLYLTEPNTLLTPPASPKGDEEVTETKFLQIPEGGLPQGDDANDETLEVLMTDLDEENAKQFYLENATAVAEKRYRNFDKDNSDHVDVFSNNSDMDLEDTDGTRILPPELTTEGHALGTVVSESCGLSDVYSKEKFPDSRIDAYLFTPCGFSANGVIPTPDPKANTHYFTVHVTPEPHCSYASFETNVPHSQNGQTTAGIVKQVVNIFKPGRFTVTLFENKPSDAELSGIGEAKYIERQAARRKSQVEHIEGYRRVDRIVHDLDGYDLVFRYYERLDWKGGAPRLGEERI

SEQ ID NO: 16093 - protein, 674 aa, Unknown
  Synechococcus sp. WH 7805
MCGIGGVFLADRRQTLDRQLLVNMAAIQSHRGPDGFGVECIDAAGVGFCHARLSIIDLNESRARQPFLSDDRQVLMAHNGEFYDFQRIRADLTAQGVRFSTKSDSEILLRLYQRQGLESTLPLLRGEFAFALFDAVDDCLYLVRDRFGIKPQYWTMTPEGVVFGSELKVLFAHPLVERRFTSEGLFHQLMQTMVPGTTAFAGVHQVQPGHVLKVQRRGDRLEVSESTYWDVDFPRLDQRDSTLTEADHIANVRAALLEAVEMRMVADVPVGCYLSGGIDSCSILGLASAVSQGPVKAFTIGFDDARYDETPIAAEMAEATGAEQDVMRLSGRELYGHMEQTLWHTERTIYNTLAVAKYLMSRHVNNVDYKVVMTGEGSDELFGGYPAFRRDMFLHGLDDLPQSDRQDWESLLQTNNSLVQGAMLAADQVDDPDLDAVVGFTPSCLQPWLACAPLVPDLLAEEHRQALAEYSPGKAIAEQLNPQQLEGRHALDKAQYVWIKTMLEGQILTWGGDRVDMANSMEARPAFLDHHLAAAAVQVPPELRIKGKTEKYVLREAMAGLLPEVLYKREKFAFMAPPAHTEPEKWAQMKQLADDYLSDEAIDAAGLLSKEGVRTLFARHDDPVTTDAERVQMDAVINHLLGVQMLHRMFVAADVPAQAREQADHLGWRVLMPV

SEQ ID NO: 16094 - protein, 331 aa, Agrobacterium tumefaciens
MRQRLRETGMSDTNNPYGGSYGGQMTASAHHNGELNGAASGHIKDTTTAGFSKDVLEESRRQPVLVDFWAPWCGPCKQLTPVLEKVINEANGRVKLVKMNIDDHPSIPGQLGIQSIPAIVAFADGRPVDGFMGAVPESQIRQFIDKIAGPDAGDPKAEIEAALSEAKQLLADGDFNGAAQLFGAVMQADPENPAAIAGIAECMIAAGQYERASELLSSLPAELNDDAGIQLVSKKIAQYEEARKIGDPVALERDLAQNPDHHEARVKLAKVLNAQGRRDEAADHLLYVMRKDRTFDDDGARRQLLEFFESWGFKDPASIAGRRKLSAILFS

SEQ ID NO: 16095 - protein, 372 aa, Pseudomonas syringae
MRSKVTGAQRWVVKIGSALLTADGKGLDRNAMGVWVEQMVALHEAGVELVLVSSGAVAAGMSRLGWTARPSAMHELQAAAAIGQMGLVQAWESSFAEHGRHTAQILLTHDDLSDRKRYLNARSTLRTLVELGVVPVINENDTVVTDEIRFGDNDTLAALVANLVEADLLVILTDRDGMFDADPRNNPDAQLIYEARADDPALDAVAGGTGGALGRGGMQTKLRAARLAARSGAHTVIVGGRIERVLARLKGGERLGTLLSPEREMLAARKQWLAGHLQTRGTLVLDDGAVSALASDHKSLLPVGVKLVQGSFRRGEMVVCVAPDGREIARGLSNYSAIEAQKIIGHSSEAIVRELGYMAEPELIHRDNLILV

SEQ ID NO: 16096 - protein, 214 aa, Gossypium barbadense
MKVCNKNLFLSALLCIAVAGVLGQAPSNPPTSTPAPPTPPASTPPPTTQAPPTPTATPPPVSTPPPTSSPPPVTASPPPVSTPPPSSPPPATPPPASPPPATPPPASPPPATPPPASPPPATPPPATPPPATPPPATPPPAPLASPPATVPAISPVQTPLTSPPAPPTEAPAPTLGAATPGPAGTDTSGANQMWTVQKMMGSLAMGWALLNLMV

SEQ ID NO: 16097 - protein, 314 aa, Helianthus annuus
MALGFSDRNTEMSPYSQQSNTSAVPMDSSKKRKTRSRKEAPEKVAATLAKWIEYNKANEDGKAKTRKAPAKGSKKGCMKGKGGPENSRTNFRGVRQRTWGKWVAEIREPNRGRRLWLGTFGSAVEAALAYDEAARAMYGTSARLNLPNCRSKNDILPLLVTNPASSCDSTTTCSYSEVDATHDSKPGPAVFPSVKHEESVQVKHEPEIVAKEEHCVDNNDLGFDIGDEMFDLEELLGAVEDSNPEAGSGDGYDGRFVNGADANENMQMYMQPDPCVSGQDYSFDFLQPGRPEDCSFTLEELGLGLDAELDLYSN

SEQ ID NO: 16098 - protein, 186 aa, Triticum aestivum
MVSEAANAGIDRVLWTEAEIATRVAEVASELAADISRLAEPAVVVGVATGAFLFLADLVRRVDAPLTVDLVRVESYGDGTESSGRPRVTADLKVDVAGKHVVVVEDIVDTGNTVSCLIAHLQKKGALSISVCTFLDKPARRTVDFQLVGGGKFYRGFECPDSFVVGYGMDYCGALPQPALCWSSQA

SEQ ID NO: 16099 - protein, 325 aa, Listeria monocytogenes
MCEFINRIFWQERVSAMGKALLIVNPSSGKEKGKTYQGKTEEVLKKRYDEVEVRLTEKAGDATEFASWAAEQGFEAVIAMGGDGTLNETINGLAIHEKRPDFGFIPLGTVNDLARSVGIPLKPEKAIQALEKAIAVPMDVGRIGDQYFMNVLAIGMIAQAVDQVSVEQKTKFGSVAYFLEGLKAFNRNELLHFKIEYDEEVWEGEAALVVAGLTKSVGGMESWAPDAKIDDGYLHIIILTKLGLLDAANMIPQLIRGNLKNSDGVVYIKTKKLTIDASGDDLSINVDGDPGPGVPAEIEVLGSHLNILAPKKSSKKRFGPFILKK

SEQ ID NO: 16100 - protein, 198 aa, Desulfovibrio vulgaris
MQTVARKASVERVTNETTIALTLTIEGEGNVRVTTGFGMLDHMLTLTAFWAGFDLDLTCKGDMHIDAHHTAEDVALCLGQALATALDDRKGIARVGFARVPMDEALAEVTLDISGRPWLEWRGDEYLPPVIAGEEKDLWREFHKAFASAARMNLHVSYLYGKNGHHLLESASKGLGLALRQAVRRDRQTVLSTKGSLD

SEQ ID NO: 16101 - protein, 492 aa, Haemophilus somnus
MMESVELLANITPSETRIALVDNGILKEVHIERQAKRGSVGNIYKGRVTRVLPGMQSAFVDIGLEKAAFLHASDIVSHTECVDVDEQKQFVVKDIAQLVHEGQDIVVQVVKDPLGTKGARLTTDITLPSRYLVFMPENSHVGVSQRIESEEERARLKELVLPLCDELGGFIIRTAAEGATETELVQDAEFLKRLWRKVLERRAKYTTRSMLYGELALTQRILRDFIGANFSKIHIDSKLCFSEVKQFTEEFMPELTDKLVLYSGSQPLFDVYSVENAIQTALNSRVNLKSGGYLIIEQTESMTTIDINTGAFVGHRNLEETIFNTNIEATKAIAQQLQLRNLGGIIIIDFIDMQTEEHRDRVLESLRLALSKDRVKTNVNGFTQLGLVEMTRKRTRESLEHILCDECPTCSGRGSVKTVETVCYEIMREIIRVNHLFASEKFVVYASRAVADYLINEESHGLLAELEVFIGKQIQIKTEVYYSQEQFDVVVM

SEQ ID NO: 16102 - protein, 175 aa, Candida glabrata
MGAAPSKIVETLLEDTNFDRDEIERLRKRFMKLDRDSSGSIDKNEFMSIPGVSANPLAGRIMEVFDADNSGDVDFQEFITGLSIFSGRGSKDEKLKFAFKIYDIDKDGLISNGELFIVLKIMVGSNLDDKQLQQIVDRTIMENDLDGDGQLSFEEFKSAIETTEVAKSLTLQYSV

SEQ ID NO: 16103 - protein, 119 aa, Zea mays
MVPGVGLVHAPFSLLAARFPTSFFKQACELAPIFTELVDCVSLDGESLQAALSRTKQVHEFTARLLDIHDKMMLINNKEDIRLILHRSDYMLDSETNSLLQIENSRIYVSVQTLDFFVQ

SEQ ID NO: 16104 - protein, 479 aa, Mesorhizobium loti
MTDLKGFEERKGLARPLGVRHKADPERETWSESRARETRELGASEQPYCLVIGGGQGGIMLGARLRQLGVPTIVIEKNARPGDSWRNRYRTLVLHDPVWYDHLPYIPFPENWPVFTPKDKMGDWLEMYTRVMELNYWVATKCLSASYDEGRKEWTVVVDRVGRQITLKPKHVVFATGAYGPPRKIDLPGAAAFKGELLHSSQYASGDKFRGKKVAVIGAASSGHDVCVDLWESGADVTMIQRSPTTVVKSDTLMEVGFEIFSEGALARGITTEKADMIVASTPFALVPKGQRALYEVIKARDAAFYERLSASGFAIDFGDDETGLLMKAYRTGSGFYIDVGASDLIIDGKIGIRSGVAIKALTAKGILFEDGSELEVDAIIACTGYQSMNENVAALVSREVADKVGPCWGLGSGVKGDPGPWQGELRNMWKPTAQEALWFHGGNLALSRFYSKYVALQIKARMEGIATPVYGKPSNSRR

SEQ ID NO: 16105 - protein, 355 aa, Arabidopsis lyrata
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHIKKKENQNAVDDGDVVDTDMVDDLLAFYSEEAKLVSEAADLQNSIKLTRDNIKAIIMDVMFGGTETVASAIEWALTELLRSPDDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 16106 - protein, 319 aa, Candida glabrata
MSYPHKIAAAHDDPTLMFNHTCLRIKDPAKSIPFYQKHFGMELLNKLDFPEMKFSLFFLSFPKDNVAKNSEGKNDVFSTSGILELTHNWGSENDADFKICNGNEEPHRGFGHICFSYADINAACSKLEAEGVSFKKRLTDGRMKDIAFALDPDGYWIELIRYDRENSPKKDVGSRFNHTMVRVKDPKASLEFYQNVLGMKLLRTSEHEAAKFTLYFLGYKVSSEDNEFSHEGVLELTHNWGTENEADFKYHNGNDKPQGYGHICVSCKDPAKLCNEIEQTYGDKIQWAPKFNQGKLKNIAFLKDPDGYSIEVVPHGLIV

SEQ ID NO: 16107 - protein, 472 aa, Pseudomonas fluorescens
MSGQNSQSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYIHYWAPEIPSWVTAAAFFVLINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVILLSLTPWDSLLETLNASGDSYSGSPFVQVFSMLGSNTAAHILNFVVLTAALSVYNSGTYCNSRMLLGMAEQGDAPKALAKIDKRGVPVRSILASAAVTLVAVLLNYLIPQHALELLMSLVVATLVINWAMISFSHFKFRQHMNKTHQKPLFKALWYPYGNYICLAFVLFILGVMLLIPGIQISVYAIPVWVVFMWICYVIKNKRGAQQALHAASAAK

SEQ ID NO: 16108 - protein, 355 aa, Arabidopsis lyrata
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 16109 - protein, 860 aa, Marchantia polymorpha
MAVTKRESRSVMDASGKYVRYTNEQVEALERVYNECPKPSSIRRQQLIKDCPILANIEPKQIKVWFQNRRCREKQRKEATRLLSVNAKLTALNKLLMEENERLSKHTSQLAIENQYLRQHTSSDRNLKPNRRLHEQAGMATPDTSSESVVTGGLQRHPTPQHPPRDASPAGLLAIAEETLTEFLAKATGTAIDWIQMPGMKPGPDSIGIVAISHGCAGVAARACGLVGLEPTKVADVLKDRPAWLRDCRRLDVLGAFPTGNGGTVELIYTQMYAPTTLAPARDFCTLRYTSFLEDGNLVICERSLSGAHGAPTMPPVQFFVRAEMLPSGYLIRPCEGGGCIIHIVDHMDLEPWSVPEVLRPLYESSAVLAQKMTIGALRHLRRLAQEIPGEVVLGSDQQPAVLRALSQRLARGFNEAVNGFADDGWTTLPSDGMDDVSVVVNPNPNSKQFGGGPNATDRLCSIGGGILCAKASMLLQNVPPALLIRFLREHRSEWADCEIDADAAAALRSTNYVGSESRGSLCGGQLPLPLAHAVEQEEFLEVVKLEGHSPTQDGGVLNRSDSFLLQLCSGVDENAVGACAQLVFAPVDVAVTDDVPLLASGFRVIPLDSGIVDGYGLSRTLDLTSTLEGGSEARLVGDSGASACHLRSVLTIAFQFAFEVHTRDSVAAMARQYVRTVVASVQRVAMALAPSRLGSHLGGTRHPPPATPEALVLARRVLQSYRSYMGMELTRELERTDYSNSEALFKIFWNHSDAILCCACKSLPEFTFGNRAGLEMLETSSGALQELTWEKTLDENGRKPAYSDFTQVMTQGYACLPAGVRISSMGRPATYQQAIAWKVVDEDDHTHCIAFMFTNWSFL

SEQ ID NO: 16110 - protein, 355 aa, Arabidopsis lyrata
ISYLTYDRADMAFAHYGPFWRQMRKVCVMKVFSRKRAESWASVRDEVDKMVRSVSCNIGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 16111 - protein, 319 aa, Alkalilimnicola ehrlichei
MSETKHCKLLILGSGPAGYTAAIYAARANLNPVLVTGLEMGGQLTTTTDVDNWPGDAEGVQGPELMERMKRHAERFETEVVFDHIHTAHLKAKPFRLEGDAGSYTCDALIIATGATAKYLGLDSEQAFMGKGVSACATCDGFFYKNQPVAVIGGGNTAVEEALYLSNIASHVTLVHRRDSLRAEKILQRQLMERVEAGKVSIVWDHNLDEVLGDDAGVTGLRLKHTQTGETRQVDVHGVFIAIGHAPNTGLFQDQLEMNGGYIVVKSGLNGNATATSIPGVFAAGDVMDHVYRQAVTSAGTGCMAALDAEKYLDALHLE

SEQ ID NO: 16112 - protein, 500 aa, Xanthomonas campestris
MVIHRPASRHRCARWLMLRSLTVCCRARMSYAIVWFRRDLRLEDNPALRAALDAGHHPIPLYIDAPHEEGEWTPGAASRTWRHRSLAALDGALRALGSGLVIRSGDSAQVLDEVIAQTGAVAVYWNRKYEPATQPRDAQIKRDLRERGIEVQSCNAALLFEPWQLSTQQGGPYKVFTPFWRNALTQLQLPAAMDAPRRLPPLPASLKTDALDTLQLVPGLQWDQGFWEHWQPGEAGAHEMLEIFIDGALSGYRENRDRPDRVGTSQLSPHLHFGEIAPWRIASTLEAHRTARNGAEIDGYIRQLGWRDFAYHLLHHFPDTTNQNLNPRFAGFDWATVDPVALQAWQRGRTGIPIVDAGMRQLWHTGWMHNRVRMIVASFLCKHLRIHWIEGARWFWDTLVDADLANNTLGWQWVAGTGADAAPYFRVFNPVTQAEKFDPHATYITRWVPELGKLAVKERFAPWLHPLALARFAPEYPRNPIIGLAEGRDAALAAYAKSRA

SEQ ID NO: 16113 - protein, 139 aa, Nicotiana tabacum
AETPKTDIDFWKALFPVAVAHTIGHVAATVSMSKVAVSFTHIIKSGEPAFSVLVSSLLLGETSPLPAYLSLLPIIGGCALAAVTELNFNLIGFMGAMVSNLAFVFRNIFSKKGMKGKSVGGMNYYACLSIMSLLILTPF

SEQ ID NO: 16114 - protein, 861 aa, Phaeoceros carolinianus
MALNRHKDSRSSPMDNTGKYVRYTNEQVEALERVYNECPKPSSIRRQQLIKDCPILANIEAKQIKVWFQNRRCREKQRKEATRLLSVNAKLTALNKLLMEENERLSKHTSQLAIENQYLRQQQQQLVKSDCIGKPSRRSQEQLAMTTTDTSSESAVTGGLQQHPTPQHPPRDASPAGLLSIAEETLTEFLAKATGTAVDWIQMPGMKPGPESIGIVAISHGCAGIAARACGLVGLEPTKVAEILKDRPSWLRDCRRLDILGAFPTGNGGTVELIYTQMYAPTTLAPPRDFCTLRYTTFLEDGNLVICERSLSGAHGGPTMPPVQYFVRAEMLPSGYLIRPCDGGGSIIHIVDHVDLEPWSVPEVLRPLYESSAVLAQKTTIGALRHLRQMAVESAIELPIGNGQQPAVLRALSQRIARGFNEAVNGFSDDGWNTIVTDGMDDVSVAFNSSPHCKQLGAQATSTDRLCSLGGGILCAKASMLLQNVPPALLIRFLREHRSEWADCDIDADAAAALKTSTYGASGRGSLCSGQLPMPLAHAVEQEEFLEVVKLEGHGAHDGTVLPRETFLLQLCSGIDENAVGACAQLVFAPVDAAVSDDVPLLPSGFRVIPLDSGLIDGYGGLSRTLDLASTLEGGSESSRFVGDSGTSSCHLRSVLTIAFQFSYEIHTRDAVAAMARQYVRTVVASVQRVAMALAPARVGSQLALRQSPGTPEALLLARRILQSYRVNLGMDLVRTETGSTDALFKAFWLHGDAIVCCSWKTLPEYSFANRSGLEMLEITSGGLQDVSWEKTLDENSRKNVYADFNQVMQQGYAYLPGGVRLSSMGRPATYERAVAWKVILDDDESTPCVAFMFVNWSFLT

SEQ ID NO: 16115 - protein, 653 aa, Lotus angustissimus
MRTMAIGSPKHEKKMQQKNLSAQLAVAVRSIQWSYGIFWAPSTTQQRELEWRDGYYNGDIKTMKTVQTMETKADKIGLQRSEQLRELYKFLHVGEADPQAKRPSASLSPEDLSDSEWYYLVCMSFVFYPNQSLPGKALEIGETMWLCNAQQADSKFFSRSLLAKSASIQTVVCFPYLGGVIEIGTTEVVSEDPNLIQHVKACFLEISKPTCSGKSSSAHDKPHDDNKYPTCTKGDHEVFDKMPLENSCSFVEELKLDEYPGKELQDDDNNEDHYDIMDGFSDGGCDHYESMIEGINEGGSSQVHFVNDGGDIIGAPDSLSSCDCMSEASENHGKKDSKNVTQNQQRELQDCDDNSKSSSLDIKADEDLYYTRTLCAVLGNSSSFAQNLCASKSSFVKWKKGGVSERKRPRLQQMMLKKTLFDVPFMNLSCSSLKSQQENGRKDWPGKLGNAHNFMGNVFSDKKRESRNIQVLKYVAPSACEVEKSSVLGDTIKYLKKLEARVEELESYMDTTATGARTRRTCPDVLEQISDNYGPSNIYMGMKKPRINERKACDIDDIDTGLDRIVSEEDKPLDVKVNMKEEEVLIEMKCPYREYILYDIMDAINNLHIDAHTVDSSTVDGVLTFKLTSKFRGAATAPMRMIKEALWKVSGNI

SEQ ID NO: 16116 - protein, 355 aa, Arabidopsis lyrata
ISYLTYDRADMAFAHYGPFWRQMRKVCVMKVFSRKRAESWASVRDEVDQMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 16117 - protein, 421 aa, Brucella suis
MTKDIAQVMAEVGRKAKAAAAPLSIATSEQKNKALNAAADAILEARADILEANRLDLANAEKNGMAASFVDRLTLNEARIDAIAEDIRAIATLPDPVGEVIAEWDRPNGLHIERVRTPLGVIGVIYESRPNVTADAGALCLKAGNAVILRGGSDSAHSSAAIHKALVKGLEAANLPADAIQIVPVTDRAAVGEMLKGLGGAIDVIVPRGGKSLVARVQSEARVPVFAHLEGICHLYIDKSADLDMARRIALDAKMRRTGICGAAETLLVDRAVASTHLAPILGDLAAGGCEIRGSAEVLALYPAAKPATEEDWSTEYLDAIISVALVDGISGAIDHINRYSSHHTEAIVAEDAQTVARFFNEIDSAILLHNASTQFADGGEFGMGAEIGIATGKMHARGPVGVEQLTSFKYRVRGSGQVRG

SEQ ID NO: 16118 - protein, 876 aa, Physcomitrella patens
MESWKEQTMDSSGKYVRYTNEQVEALERVYHECPKPSSIRRHQLIKESPILANIEPKQIKVWFQNRRCREKQRKEATRLVSVNAKLTALNKLLMEENERLAKHASQLTLENHSLRQQLPSLPLTNGTHRLSSQNLLKKERAVNGGDESSTQGGICVKLHGQAGVASTDTSCDSAVTGGLPHHLTPRHSPRYTSPAGLLATAEETLTEFLAKATGTAVDWIQLPGMKPGPDAIGIIAISHGCVGIAARACGLVALDAGKVTEVLKDRPAWLEDCRRMEVLGALPTGNRGTIELLYTQMYASTTLAPARDYCTLRYTTILEDGNLVICERSLTGGQNGPSMPPVQSFVRGEMFPSGYLIRPCDGGGCIIHVVDHYDNGPWSVPEVLRPLYESPAVLAQRSTIAALRHLRRLAAEESGEGNPRNGQHPAVLRTLGQRLAKGFKNAVNGFADDGWVSTVSDGLDDVSVILNATSQSMEGQIASDKLLYSLGGGILCAKASMLLQNVPPSILIKFLREHRSEWADYDMDANLATSFRSNGNGYAPQGGGVSHVQLPLPLPNSGEHGEILEVVKLEDHSSVQHMVISRDSFLLQLCSGIDENAVGASAQLIFAPVDVALTEDIPLLPSGFCISPVDANVLDEFDLDHTLDLASTLEGGSDLRLNGDSKSNGTSSHMRSVLTIAFQFAYEVHSHEACAVMARQYLRTVVSSVQRVAMALAPSRGSAPPRQMSANPDALSLARHVLRSYRLHLGLDLTGSENGGDETLFKAFWHHTDAILCCAWKGKPEFVFANRSGLEMFETTTSSLQELDWDKTLNESDCKLSYATFTQVLQQGYCSLPAGVRMSSSGRTATYERALVWKVVDDNETVECIAFLFINWSFVV

SEQ ID NO: 16119 - protein, 880 aa, Physcomitrella patens
MTETWKDQTMDASGKYVRYTQEQVEALERVYHECPKPSSIRRHQLIKESPILANIEPKQIKVWFQNRRCREKQRKEATRLVSVNAKLTALNKLLMEENERLAKHTSQLTLENHALRQQIPNLPFPDGRHRLPSQILQSPLKKEGAVNGGDESSTQGGICVKVHGQAGIASTDTSCDSAVTGGLPHRLTPQHSPRDSSPAGLLATAEETLTEFLAKATGTAVDWIQLPGMKPGPDAIGIIAISHGCVGIAARACGLVALDISKVTEVLKDRPRWLQDCRRMEILGALPTGNGGTIELLYTQMYAPTTLAPARDYCTLRYTTILEDGNVVICERSLSGVQGGPTMPPVQSFVRGEMYPSGYLIRPCDGGGCIIHVVDHYNNEPWSVPEVLRPLYESPAVLSQKSTLAALRHLRRLAAEESGEGVPRNGQHPAVLRTLCQRLTKGFNNAVNGFPDDGWEATISDGLDDVSVMLNATPKSMEGQIASDKLLYSLGGGILCAKASMLLQNVPSSLLIRFLREHRSEWADYDIDANVASFRSNGNGYVPRCGGVSHVQLPLPLAYSGESGEILEVVKVEGHSSVQHMVLSRDTFLLQLCSGVDESAVGACAQLVFAPVDVALADDIPLLPSGFCVSPIDTNVVDGFGLDRTLDLASTLEGGNDLRLNGDAKSSNSPGQMRSVLTIAFQFAYEVHTRETVAAMARQYVRNVVASVQQVAMALAPSRGAPPPRQVPSNPDALSLVRHVLSSYRFHMGIDLIRPENGSDEALFKAFWHHTDAIVCCALKGIPEFVFANRSGLEMFETATASSLKDLDWEKTLNENDRKLSYATFTHVLQQGYCSLPAGVRMSSTGRTATYEQALAWKVLNDSEAVECIAFLFINWSLAT

SEQ ID NO: 16120 - protein, 74 aa, Nicotiana plumbaginifolia
PFMNTASKMFSMSEVRKHSSADSAWIIVHGHIYDATRFLKDHPGGTDSILINAGTDCTEEFDAIHSDKAKKLLE

SEQ ID NO: 16121 - protein, 165 aa, Vibrio angustum
MAQQKAILAGGCFWGMQDLIRRQTGVITTRVGYTGGDVANATYPNHGTHAEAIEITFDDDQTSFENILAYFFQIHDPTTTNRQGNDIGTSYRSAIFYTSEAQKNTAQDLIKRINASGIWPGTVVTEVVPASDFWQAEPEHQDYLLHRPNGYTCHFPRPDWVLPEE

SEQ ID NO: 16122 - protein, 158 aa, Staphylococcus epidermidis
MSIYDIAVENYDGSTYLLKRYKGKVLIIVNTATNCTLNDQFNKLEMLYKKYHKYGLEILSFPCNDFNNQEPGLIKDIYRVYKYKFGITFPIHAKINVNGEHEHPLYTLLKCKQPGLFGSQIKWNFTKFVVDQQGNIVKRFLPCDNPNQMEKLIRQLLK

SEQ ID NO: 16123 - protein, 247 aa, Fusobacterium nucleatum
MSVVSMKQLLEAGVHFGHQAKRWNPKMAKYIFTERNGIHVIDLHKSLKKIEEAYEEMRKIAEDGGKVLFVGTKKQAQEAIKEQAERAGMYYVNNRWLGGMLTNFSTIKKRIERMKELERMDAEGILDTDYTKKEAAEFRKELSKLSKNLSGIRDMEKVPDAIYVVDVKMEELPVKEAHLLGIPVFAMIDTNVDPDLITYPIPANDDAIRSVKLITSVMANAIVEGNQGIENVEPQSEEVNVEEGSAE

SEQ ID NO: 16124 - protein, 243 aa, Zea mays
  misc_feature (193)..(193): Xaa can be any naturally occurring amino acid
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQAQAQQGQAVELEPEQQLDPRTQPAHDAEETAAEPPPAXASNGTTDGGNKRKAAAMEEEGMLAVMTVAAPESSTKPRLSTTTSSLAVET

SEQ ID NO: 16125 - protein, 483 aa, Rhizobium leguminosarum
MTHRRFVVEKAEIGLIGLAVMGSNLALNIAEKGNKIAVFNRTPEKTDEFYESAGDLKKQIIPCKTIEEFVDAIRPPRPIVIMIKAGEPVDQQMELLRPHLSKGDIMIDAGNANFRDTVARFDRLKNTDLTFIGMGVSGGEEGARHGPSIMVGGTEESWKRVEKVLTSIAARYNDEPCVAWLGNDGAGHFVKTIHNGIEYADMQMIAEIYGILRDGLGKSASEISGIFGEWNKGRLNSYLIEISEKVLAATDPVSGGPMVDMILDKAGQKGTGKWSAIEAQNMGIPATAIEAAVAARSLSSMKSQREAAEKIFGTQAVSFPIAYGPELNKDLELALFAAKIGAYAQGFAVMAEASREFNWSLPMPTIARIWRAGCIIRSQFLDEITSAFTKAPDAANLIVTPAFSDMVKESIPALRRVVGAAIAAGLPVPALTSALTYFDAYRQGRGTANLIQAQRDFFGAHGFDRLDGKDFHHGPWGSGASTF

SEQ ID NO: 16126 - protein, 337 aa, Streptococcus mutans
MKRIAVLTSGGDAPGMNAAVRAVVRKAISEGMEVCGINRGYAGMVEGDIFPLDAKGVSNILSRGGTFLQSARYPEFAKLEGQLKGIEQLKKHGIEGVVVIGGDGSYHGAMRLTEHGFPAVGLPGTIDNDIVGTDYTIGFDTAVNTATDALDKIRDTSFSHGRTFVVEVMGRNAGDIALWSGIAAGADQIIIPEEPYDIKEVVANVKNGYLSKSKNHHLIVLAEGVMHGEEFAAQMKEAGDNSDLRVTNLGHILRGGAPTPRDRVIASWMGAHAVELLREGKGGLAIGIQNEELVEHPILGSAEDGALFSLTEQGEIVVNNPHKARLDFAALNRDLSN

SEQ ID NO: 16127 - protein, 954 aa, Bordetella parapertussis
MSRAPDTHSDFIPRHIGPSDEDQATMLAAIGAASLDALIDEVVPPRIRSRAPLALPAARSETDVLQDLKRMAARNQIYRNYIGQGYYGTHTPNVVLRNVLENPAWYTAYTPYQPEISQGRLEALLNYQTMVADLTGLDISNASLLDEGTAAAEAMTLARRGSRSSSPVFFVSQHCHPQTLEVVRTRAEGLGIELVIGDESRGLPECFGVLLQYPHSLGGVADYRELAQAAHAQGAVVACVTDLLALALIEPPGQWGADIAVGSAQRFGVPFGFGGPHAGFMACRDAYKRNMPGRLVGVSKDAQGNPALRLALQTREQHIRREKATSNICTAQVLLAVMAGLYAVWHGPRGVRRIAERVQSLTGALRAALAGLGVKVANDTWFDTLLLETGVATPAILAAADCARTNLRQVDGARLAVSLDETVTLADLQALVNVFAAGLGKDEVALPAPQASLDGIPAAVRRQGPILSHPVFSSVQSETDMLRYLRKLADKDLALDRTMIPLGSCTMKLNATAEMIPITWPEFALIHPFAPASQTPGYRELIDGLSAQLCEITGYDGISLQPNSGAQGEYAGLLAIRAYHQANGQPQRNVCLIPASAHGTNPASAQLAGMDVVVVASDANGNVDLADLRARIAQVGERLAALMITYPSTHGVFEEAVTEICDAVHEAGGQVYLDGANMNAMVGVAQPGKFGSDVSHLNLHKTFCIPHGGGGPGVGPVAVRAHLAPYLPGVLDAQGRLDPEAKVGPVSAAPYGSAGILPIPYVYIALMGAEGLRRATEVAILNANYIAARLRDHYPVLYAGRNGRVAHECILDVRPLKETSGISAEDIAKRLMDYGFHAPTMSFPVAGTLMVEPTESEGLAELERFIEAMIAIRAEIAQIESGERDRDDNVLRNAPHTAQMLLAEEWHHDYPRQQAAYPVASLRENKYWPPVARVDNAYGDRNLVCACLPVEAYA

SEQ ID NO: 16128 - protein, 598 aa, Streptomyces avermitilis
MTTPTSDIRSGIPSDLPEAGTVRLVDHLAGELARAGVTHMFGVGGANIEDLYDAVHRGRAVHGVVAKHEFSAVTMADGYARTTGRLGVVAATSGGGAMNLVPGLAEAYASRVPVLALVGQPPTGQEGHGAFQDSSGRAGSFDAREVFTPVSRFCARVENADSLTELLPRAMAAAQAHPRGPAVLLLPKDVQQARIQVPGRGATPTPGMPEPEPTAEAAWLDSAVLTAVSDTLRGAGRVLVIAGEDVAAADARAELAELAGRLGAWVAVTPDAKDVFDNRDPRFAGVAGVMGHANVEECLRRADVCLLAGTRLPLLARGGLDRALAATEVVCLGPEPPFVAGTALGGNLRDALRAVTGRLPPRPRACPEHAGPLPTPTPSPVSQARGRPIPYAQAVAAVEAALPQDAHVFVDAGNAGASAVHLLPAPRHGRFVVAVGMGGMGYTFGAGIGAALATGRRTYVLAGDGSFFMHGMEVHTAVEYAAPVTFVVFNNNAHAMCAVREEFLQGGVRSDDLFARTDLAAGVAAAFPSLEVTGADDAAQLRQALLRSNAGGGPAFVALDCDPGEIPPFLPFQSFTEATENATENKESPVERGIVHVG

SEQ ID NO: 16129 - protein, 168 aa, Unknown
  Rhizobium sp. NGR234
MTKRAVLAGGCFWGMQDLIRKLPGVIETRVGYTGGDVPNATYRNHGTHAEGIEIIFDPEKISYRRILEFFFQIHDPTTKNRQGNDIGTSYRSAIYYVDDEQKRIAEDTIADVEASGLWPGKVVTEVEPVGDFWDAEPEHQDYLENYPTGYTCHFPRPDWVLPRRAAAE

SEQ ID NO: 16130 - protein, 350 aa, Oryza sativa
MIKQPSVSLAPNTSCQPQHALARAAAGSARSRRISCLHLAVLHVGRHHARALCSHESAFSGANNNTNHDVKLRPRKFFEMEMSVRDCELDQYGVVNNVVYGSYVERAREELAEFLGVSASTAACTGNAMAVSEQNFKYFTPLKRGDNFVVKVTIQIKGVRIYADQFIETLPDRKISTTSDGDVKFNCELYGPIVHQRYSVNYVDVDKEARKFFELEMSVSDCDIDPYGVVNNAVYANYVERAREELAAILGVSASTVACTGKALAISEQNLNYLAPLKRGAKFVVKVTLHIKGVRIYAEQFIETLPDRKLVLESTAIIVCLNGEYRPTRVFPELSSKLLDFFSPQESCSD

SEQ ID NO: 16131 - protein, 320 aa, Silicibacter pomeroyi
MSIAVLGSGAFGTALAISLAGKGPVTLWSRAPEQARQMQETRENHQRLPGLPLPAALNVTADLDQATRCDTLLLAVPMQKLRGMLSEHAAALHGRVLVACCKGIELNSGLGPMAVMAETLPGTRTALLTGPSFAQDIARGLPTALTLACADPDLGRDLQAQLTTTNLRLYRTTDTIGAELGGALKNVIAIGCGACIGAGMGDSARAALLTRGFAEMQRLAALKGARPETLMGLSGLGDLMLTCSSDLSRNYRFGLALGRQEPFDRATTVEGVATAHAVAQLARDLGIDMPISTTVAQLSNGDYSVAEAMRSLLNRPLKEE

SEQ ID NO: 16132 - protein, 240 aa, Oryza sativa
MQQPSVSLAPNTSCHPQHAGSAAGSSRRSHGHLGVLLHVGHSDGRRAGALYAATNLRSLEAIPATGPTLRSLEEAIAAPNLLSHEAVISANNTYQDAKPRARKFFELEMTVQDCDLDQYGVVNNTVYPSYIERAREELISGLGMSRTSIACTGNAMALTELNIKYFTPLKRGEKFVVRLSLGRIKGARIYAEQYIERLPDRKLVVESTATIICLNRKHRPTRVWPELSSKLLDYFSSQED

SEQ ID NO: 16133 - protein, 332 aa, Unknown
  Rhizobium sp. NGR234
MNTHHARVLIIGAGPAGYTAAIYAARANLKPLLVTGLQAGGQLTITTDVENYPGFAEPVQGPWLMEQMRQQAENVGTEVVYDIITSVDLSERPFRLKGDSGDTYIADALIIATGAQARWLGLPSEKTFNGFGVSACATCDGFFYRNKEVVVVGGGNTAVQEALYLSNLASKVTVVHRRDRFRAESILQDRLLAKPNVEVVWNHVIDEVIGEHEPRKSVTGVRIRDVKTGDVKELSAHGLFVAIGHDPATALFRGLLDMDEAGYIKVGSWSTKTTVPGVLAAGDVIDPVFRQAISAAGMGCMAALEAEKFLAEHSPDPVARAVEAREAEMVGA

SEQ ID NO: 16134 - protein, 265 aa, Pyrobaculum aerophilum
MRLVKKEFPDVGELVIGTVKKIAEHGAYVYLDEYDLEAFAPTQEIVQSWFHSIRDYVKEGNKTVFKVISVNPKMRVVEVSLKRVRVDEKEKKLLLYRHRVRVLKLLEIAMKKLNRPAEEALKVMWYLEEQFGDPFKVFEEVVKTGPHVLDDLQLDAKLKEIIIELARQQVELPPTKISGIIKIVSVEGDGVEKIKAALIELEKTLREKFPQISTKIYVVGPPRYRIDLTGQQPKQVEAAFSEAANILQALQKKYKVIGNIQRIEQ

SEQ ID NO: 16135 - protein, 177 aa, Medicago truncatula
MALISSAAVTTVNRVSANLVAPFTGLKSSAGFPVTKKTNNDITSITSNGGRVNCMQVWPPIGKKKFETLSYLPPLTEDQLAKEVEYLIRKGWVPCLEFELEKGFVYRENHSSPGYYDGRYWTMWKLPLFGATDSSQVLKELAEAKAAYPESFIRIIGFDNVRQVQCISFIAHTPATY

SEQ ID NO: 16136 - protein, 456 aa, Escherichia coli
MMEGQQHGEQLKRGLKNRHIQLIALGGSIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFLLLYPLGNWICLLFMAAVLVIMLMTRGMGIWVYLIPVWLIVLGIGYLFKEKTAKAVKAH

SEQ ID NO: 16137 - protein, 110 aa, Streptomyces coelicolor
MAGTLKHVTDDSFEQDVLKNDKPVLVDFWAAWCGPCRQIAPSLEAIAAEYGDKIEIVKLNIDENPGTAAKYGVMSIPTLNVYQGGEVAKTIVGANAKAAIVRDLEDFIAD

SEQ ID NO: 16138 - protein, 693 aa, Ustilago maydis
MADSPASISHPANLGTADANAPIHVYPHDSATMRPTSSGSNLHLNISGLSVKSEGEQHQQHQQYQQHQQPHLANSLNFAGTAASSPPSNLASPADASASFSIGAAAASTSPHLHPDSIATSDAHLGAPNVSSPLRAEYNMSTETAPLTAAMRSYSSTSIKSATGSQNAESPTSGFGGGAGNQSVGDVSVDDPNVTSQSDADLAAEKRQSSKFVYKLFRMVSDPDYQHLISWNRNGTSVMVCNFDEFAKEVLGKHFKHSNFSSFIRQLNMYGFYKVNKTPRGHRQSADAQIWEFSHPKFLRGRPDLLDDIRRKALDSEHARVEARDLQYSVSVGQMQLRQQVDEMQFRLEELAEQNMALRTFTTQLRDVLGMVLEHVKKTSGGNLGFDVRVPTLDIPSPMPPQGLWTPQGHDGPPIFVTEPEFGPGVGPGGLRMGAGATHLSRGMHGTSSAFGVSMEGYGMAATPISRRVSVSSAHSESMLTMNGSPMHSSMHGDGAMMAMGANMTPQRSASFGEGQMPPPQFNIGRGDGPGANRAGLAGLAIDTSGATAGMFAPGMHPGVSPTSAGLSAGNAGLGVMSMPPSPLTPQHQAMMTAINTPLPPSPAPGSMAGGQFKSFEGSPFIASNGFAPQFGQNVISMADQSFFGPDGSEGPNAKAMRTPLKRTASNSGPSGQSTPVLMHSTSPGLAKRKSPV

SEQ ID NO: 16139 - protein, 180 aa, Medicago truncatula
MALISSAAVTTVSRASSTQANLVAPFTGLKSSAAFPVTKKTNNDITSIASNGGRVNCMQVWPPIGKKKFETLSYLPPLTEEQLAKEVEYLIRKGWVPCLEFELEKGFVYRENHSSPGYYDGRYWTMWKLPLFGATDSSQVLKELAEAKAAYPESFIRIIGFDNVRQVQCISFIAHTPATY

SEQ ID NO: 16140 - protein, 49 aa, Medicago truncatula
MSSRRSRQQSGGSTRISDDQIIDLVCKLRQLVPEIRNRRSDKDVKVIGC

SEQ ID NO: 16141 - protein, 566 aa, Arabidopsis thaliana
MLFVTRTLRINPKGIDFKQIDHEWHWDNYIILQAIIVSLICYMSPPLMMMINSLPLWNTKGLIALIVLHVTFSEPLYYFLHRSFHRNNYFFTHYHSFHHSSPVPHPMTAGNATLLENIILCVVAGVPLIGCCLFGVGSLSAIYGYAVMFDFMRCLGHCNVEIFSHKLFEILPVLRYLIYTPTYHSLHHQEMGTNFCLFMPLFDVLGDTQNPNSWELQKKIRLSAGERKRVPEFVFLAHGVDVMSAMHAPFVFRSFASMPYTTRIFLLPMWPFTFCVMLGMWAWSKTFLFSFYTLRNNLCQTWGVPRFGFQYFLPFATKGINDQIEAAILRADKIGVKVISLAALNKNEALNGGGTLFVNKHPDLRVRVVHGNTLTAAVILYEIPKDVNEVFLTGATSKLGRAIALYLCRRGVRVLMLTLSMERFQKIQKEAPVEFQNNLVQVTKYNAAQHCKTWIVGKWLTPREQSWAPAGTHFHQFVVPPILKFRRNCTYGDLAAMKLPKDVEGLGTCEYTMERGVVHACHAGGVVHMLEGWKHHEVGAIDVDRIDLVWEAAMKYGLSAVSSLTN

SEQ ID NO: 16142 - protein, 268 aa, Caulobacter crescentus
MALPEFSMRQLLEAGAHFGHQTHRWNPKMDRYIFGSRSNIHIIDLSQSIPLLHQALVKVREVAAAGGRVLFVGTKRQASDPVATAAKRCAQYYVNHRWLGGTLTNWRTVSGSIARLRELEGVLAGEGQGRSKKELLQLTRERDKLELSLGGIKDMGGIPDIMFVIDTNKEAIAILEARKLNIPVVAILDTNCDPDGITYPIPGNDDAARALQLYCDLIADAVLDGLAAGQAAAGVDLGASVAPVEPALARELAPEAPAAEAAPESAEG

SEQ ID NO: 16143 - protein, 108 aa, Zea mays
  misc_feature (106)..(107): Xaa can be any naturally occurring amino acid
MCVLARYVLHSDTGDGSAHKQEPRTSLGLHVYRERFTGVFALYVQGAPHPPQLLMGDTWSKPYSREYAAFPAAWLRGAKFWPTTGRVDNVYGDRNLICTLQQATQXXK

SEQ ID NO: 16144 - protein, 197 aa, Zea mays
MEKSTRTLMIITIVITSMLVGFGSSDLDQDREECTDQLIALSPCLPYVGGNAKAPTKDCCGGFDQVITKSEKCVCILVKDKDDPNLGLKFNATLAAHIPTLCHITAPNITKCISLLHLSPNSTLAKEFESLGRIEYEGKTNSTSPSHNVKDGTGGGKAEQVKSTGEKKSWLAVELLIFALFSHLLFIIPSFTSSSFI

SEQ ID NO: 16145 - protein, 460 aa, Coccidioides immitis
MGQTLSEPVVEKNSEEGSDECVIYGLSAMQGWRISMEDAHSAVLDLQAKYLAKDHHPTDPSKRLSFFGVYDGHGGEQMALYAGKNVSRIVTNQETFARGDIEQALKDGYLATDRAILEDPNYEEEVSGCTAAVAIVSKDKIRVANAGDSRSVLGVKGRAKPLSFDHKPQNEGEKARISAAGGFVDFGRVNGNLALSRALGDFEFKKSPDLSPEQQIVTAYPDVTTHEITEDDEFLVIACDGIWDCQSSQAVVEFVRRGIAAKQELHRICENLMDNCLASNSETGGVGCDNMTMIIVGFLNGKTKEEWYNMIAERVANNDGPCAPPEYAQFRGPGVRRQFDDSPDEYDPGLDSRPTGRSGRIILLGDGTELLTDMGDGEMFENGDRVSEQESTREVTSSVDEPRNERKGTPGPQTNHVAHSNGPSNGLTAEASTTEMNPPAPAGVEQSANASTTEEQPKTT

SEQ ID NO: 16146 - protein, 68 aa, Medicago truncatula
MTLGRIKLEILRETCSKVPASKVLQETCNYIRNLQREVDDLSLRLSQLLATIDSDSAEASIIRSLLNQ

SEQ ID NO: 16147 - protein, 174 aa, Zea mays
  misc_feature (74)..(74): Xaa can be any naturally occurring amino acid
MGRRPARCYRQIKGKPYPKSRYCRGVPDPKIRIYDVGMKKKGVDEFPFCVHLVSWEKENVSSEALEAARIACNXYMVKSAGKDAFHLRIRVHPFHVLRINKMLSCAGADRLQTGMRGAFGKALGTCARVAIGQVLLSVRCKDAHGHHAQEALRRAKFKFPGRQKYPRGEGGPQG

SEQ ID NO: 16148 - protein, 244 aa, Buchnera aphidicola
MEIVSMREMLKAGVHFGHQTRYWNPKMKPFIFGIRNRVHIINLEKTLPMFHFALSELKKIALKKGRILFVGTKKAASKGIKEVAINCEQFYVNHRWLGGMLTNWKTVRQSIKRLKDLEIESKDGTFSKLTKKEALIRSRELFKLENSLGGIKNMGGLPDCLFVIDAAHENIAITEANNLGIPVFSIVDTNSNPDGVDYIIPGNDDAIRSVNLYLKSIMLTISKINNQNSLDKVFIDTKNSTNIE

SEQ ID NO: 16149 - protein, 820 aa, Selaginella kraussiana
MRMTKDKGGDLDSGKYIRYTPEQVEALERVYHECPKPSSIRRQQIVRDYPVLANIEPRQIKVWFQNRRCREKQRKETSRLQSVNSSLTAMNKIIMEENERLTKHSSQLSLDNQLLRQQLQQLRNNQDPDRKSSDRLNDQALALADRSPDSEVTGGVPHHHLTMAPQSPRDSSPAGLLSIAEETPNSFLAKATGTLVDWIQIPGMKPGPDSISAAAISHGSAGVAARAVGLVDLEPIRVAEILKDRPSWLWDCRRLEVVGTFPTPSGGTLELIYSQMYAPTTLAPARDFWTLRYTIFLEDRSLVVCEKSLTGAHGKHKGGPDFERAEMLPSGFLIRPYEGGVSSIHIVDHYDLESWRVLEVLRPLYESSVFLAQRVTIAALQHLKRISQESSGEILLRGGQQPAALRAFSHRIARGFNDAVNGFAEDGWVSLVADGIDTVSITINTSVASKALPGNQVWPDRFSNNISGILCAKSSMLLQNVPPATLIRFLREHRSEWVGCNSATSDSVSALRISGYGTSKGDEEPELLEVIKMEGYGSQSVPKDTVLLQLCTGYTDNVSGTCAQLIFAPVDPAVTNDMPLLPSGFRVIPLDSGSALPTKLAPTLDLASTLDTAKFPDDSSLAHCRSVLTMAFQFVFEAHNREEIISSARQYVRNVMVSVQSIAMALASFRMSPQQGPKQPEARIIAEQIVRGFRSSFGVELSDGSTDAFWNEKDAILCCTWKAIPEFIFANRSGLEMMETTWRDLHSLPYERTFDSAGRETAYSDFAQVLHQGYAQLPGGVRISSKGHTVAYDSATAWKVYDEEGNVTCIAFMFTNWTIL

SEQ ID NO: 16150 - protein, 351 aa, Arabidopsis lyrata
ISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQL

SEQ ID NO: 16151 - protein, 142 aa, Brassica napus
RGGPRRPEKEEKLLLVNFFFSSAVVVTARVKATMGVPLTAWKSSFAFPVTRRATTAIPSIVGTGGGVNCLQVWPPIGKKKFGTFFYFPDLTEVEWGKEVDYFFRTRWIPGVEFKLEHGFVARGHGSTPGYYDGRYWPMWKLP

SEQ ID NO: 16152 - protein, 840 aa, Selaginella kraussiana
MAVMKMKEPKGIMDSGKYIRYTPEQVEALERVYNECPKPSSIRRQQLLREYPLLANIEPRQIKVWFQNRRCREKQRKETSRLQSVNSSLTAMNKIIMEENERLTKHNTQLALDNQYLRQQLQQQTGASDREPKTTSSRRYNNNEVVAADRSPDSEVTGGMPQQHITATTAAPQIARDSSHAGLLAIAEETLAEFLAKATGTAVDWIHMPGMKPGPDSVGTAAISHGSTSVAARAWGLVGLEPSKVAEILKDRPSWHRECRRLEVLRAFSTPNGGTVELVYTQMYAPTTLAAGRDFWTIRYTSFLEDGLVICERSLNGIHGGPSNKQSGSDFVRAEMLPSGYLIRPYEGGMCSIHIVDHMELESWKVLEVLRPLYESSSVLAQKMTLAALRYLRRLVYESSVERGAQQIAAWRGVSRRIARGFNEAVNCFTDDGWSTLVTDGVEDVTVAINTNPTASSIGGQLASADRLYAVGGGVLCAKASMLLQNVPPATLIRFLREHRSEWADCNITDSSLRHGMARGANAFIGQYPVPLIHSSEEEEFLEVVKLEGHTTGQNGVILPRETVLLQLCSGNDDNAVGACAQLVFAPVDAAVSDDVPLLPSGFRVIPLDSGLDGRTLDLASSLEGGAEGGRFAEEPSCHLRSVLTMAFQFLFEAHNRDDVAASARQYVRNVMVSVQSVALALASFRLGPRVGPRNVEALLLAQQILRSYKANFGLDLTESDPGSTDAFWHHKDAILCCTWKTIPEFIFANRAGLEMLDTTWNDLHGLPWDKTLDDNGRKSSASDFAQIIQQGFAELPAGIRISSKGRPAAYERVIAWKVLDEENNAQFIAYMFMNWSFLG

SEQ ID NO: 16153 - protein, 236 aa, Liriodendron tulipifera
MTRRYWNIHLEEMMEAGVHFGHGTRKWNPRMAPYISAKRKGIHITNLTRTARFLSEACDLVFDAASRGKNFLLVGTKNKAADSVASAAIRARCHYVNKKWLGGMLTNWSTTETRLHKFRDLRAEQKTGKLNRLPKRDAAMLKRQLSHLQTYLGGIKYMTGLPDIVIIVDQQEEYTALRECLTLGIPTICLIDTNCDPDLADISIPANDDAIASIRLILNKLVSAICEGRSSSIRNR

SEQ ID NO: 16154 - protein, 218 aa, Desulfovibrio vulgaris
MSDEPKGAILQRDKLTYAIVPRTPCGLLTPDVLDAVSRVCRKYEVPIIKITSGQRLALVGMKKEAVEPMWEELRLDVGRAVELCVHYVQACPGTAVCRFGLQDSLGIGVAIEEEYVGHDFPAKVKFGISGCPFCCGESYLRDVGLVGTKKGWTLIVGGNSGGHPRIGDVLAEELSTDEAKGLIRKFMEFYRDNSGKRLRVSKFVEKTGIEAIRQAVLG

SEQ ID NO: 16155 - protein, 827 aa, Psilotum nudum
MSLMGIKDCKGVMDSGKYVRYSNEQVEALERLYNECPKPSALRRQQLIRECPILSNIEPKQIKVWFQNRRCREKQRKEAARLQTVNGKLTAMNKLLMEENDRLQKQVAQLLCENGYLRQQLPQGGLTTTDTSCDSVVTSGLQHLPTPQHPPHDAATHSGILSLAEEALAEFLQKATGTAIDWIQMPGMKPGPDSTGMINISHGCTGVAARACSLVGLEPAKVVEILKDRPSWHWDCRQLTKLYSSNVGNNGTIEVLYMQMYAPTTLAPARDFCTLRYTSPLEDGSYVICERSLNNTHGPPTAPHMQSFVRAEMLPCGYLIRPCEGSGSILIIVDHMDLESWTVPEVLRPLYESSAALAHKITIPALRYLRHLAQAAGVEIPGVRRPAAVRSLSQRLARGFNDAVNGFGDDGWTTVPSDGTDDVTVAIKSNYNARELGDQFTSGTAGVLCAKASMLLQNVPPALLVRFLREHRSEWADYGAAANSTSALQINNFGILDTHGDVCISQVLQQPIHAVEDDEFLELIKLEGREEGSTLPRDIFLLQLCSGLEENTAGASAQMVFAPIDISIPDDVPLLPSGFRAIPLDNCLLDAGSPSRTLDLASTLDVGSTNGKYANNAVFHLRSVLTLAFQFSFHSHMQESATTMSRQYVRNVVSTVQRLAMALAPSRLSPHMGSSRQMPGTPEGVNYARWICRSYKCKLGIDLVSVDGERSDEYLKAVWQCYDAIMCCSCKSMPVFTFANQAGLEMLETSSVTLQELSWEKTLDENAKKSLCSVFSQVMQQGYACLSAGVRLSSMGRVASYERAVAWKVLDDDDNMRGVAFIYVNWS

SEQ ID NO: 16156 - protein, 341 aa, Pseudomonas putida
MTEQQPVAVLGGGSFGTAVANLLAENGVPVRQWMRDPAQAEAMRVNRENPRYLKGIRLHDGVEPVNDLLATLQASELVFVALPSSALRSVLAPHAELLRGKGLVSLTKGIEAQSFKLMSQILEEIAPQARIGVLSGPNLSREIAEHALTATVVASEDEKLCQQVQAVLHGRTFRVYASADRFGVELGGALKNVYAIIAGMAVALGMGENTKSMLITRALAEMTRFAVSQGANPMTFLGLAGVGDLIVTCSSPKSRNYQVGYALGEGHSLEEAVNRLGEVAEGVNTLKVLKAKAQEVQVYMPLVAGLHAILFEGRTLNQVIEHLMRAEPKTDVDFISISGFN

SEQ ID NO: 16157 - protein, 819 aa, Psilotum nudum
MALIVTKDGKGGIDAAGKYVRYTTEQVDALESLYNECPKPSSLRRQQLIKECPILSNIEPKQIKVWFQNRRCREKQRKEASRLQNVNAKLTAMNKLLMEENDRLQKQVAQLLYENGYIRQQLQHGGITTDTSCDSVVTSGLQHLSTPQHPQTDAAHSGILSLAEETLTEFLGKATGTAIDWIQMPGMKPGPDMTGMVNISHGCPGVAARACGLVGLEPARVVEVLKDRPSWHRDCRQLATLYATNTNNNGKMEVLYMQMYAPTTLAPARDFCTLRYTSLLEDGSYVICERSLNGTLGVPTAPPMQSFVRAEMHPSGYLIRPCEGSGSVIIIVDHMDLEPWTVPEVLRPLYESSAILAHKITIEAMRHLQQLAQQAAIEVPGGVQQPPAVWSLSQRLARGFNDAVNGFADDGWTSVSNEGMDDVTVIVKSNPKGRELSVLCAKASMLLQNVPPGLLVRFLREHRSEWADNNSETNALRFSNLGISGPCGDVYNSQILQPQFPADQRDEFLELLKFEGPQHGTLSSMDMFLLQLCSGIEESAAGASAQIVFAPIDSSISDDVLLLPSGFRVIPLENSSLGGGTPTRTLDLASTLEIGLGGCKHANDNPMLNLRSVLTIAFQFTFESHIQEKVATMARQYVRSVASSVQQIAMALSPCCMDTPSAPLRKMAGSPKGLALVHWMCQSYRFNLGMDLVRVNSENNEEYFKLVWHHCDAIMCCSCKSIPIFTFANQAGLEMLETTSIALPEVSWEKTLDEDEIKNMGSVFNQVLQQGYACLPAGIGRSSLGRPTSYDRAIAWKVTDEDELITGVAFLYHNWSFLL

SEQ ID NO: 16158 - protein, 413 aa, Deinococcus radiodurans
MKPRVLGMILAGGQGSRLAPLTQKRSKPAVPFGSKYRIIDFAINNFINSGMFSVYVLTQYKAQSLTEHIQRGWRFGTFLSDYFITLVPAQMYRFEELGDAWYRGTADAVYQNMHLIDNFEADYVAIFSGDHIYKMNVEHMLEKHIETRADVTIAAYPMPQSQAHQFGVMQVDERWRVTEFHEKVPDPPTIPGQADLSLTSMGNYIFSRRALEELLEASISGQETGYDFGHNVIPRALSDGYHVQAYDFHKNPIPGQERPNTYWRDVGTLDAYFEANMDLVSVNPEFDIYNPEWPLRTSSEFSPPAKFVHESEGRKGQAFNSIMAGGAIISGGTVRDSVLGRNVRTHSYSLVESCVLFDDVQVGRHSHLRRVIVDKDVVIPPGTTIGLNREHDEQRGFTVTEHGVVVVPKGYVF

SEQ ID NO: 16159 - protein, 856 aa, Psilotum nudum
MVVSKQKDGKLGDPGKYVRYTHEQVQLLERLYNECPNPSSFRRLQLLKDCPILSNIEPKQIKVWFQNRRCRDKQRKESSRLVSLNEKLSAMNQVLVEENGQLSKQAIQLVLQNKQLRQQLQQLKSCSAGSECKRGSLDKLQEKLAAAATETSSDSVVTSGLRHLSPTFHPAHDAGPTRLMAIAEDTLTEFLAKATGTAVDWIQMPGMKPGPDSIGIVAISHGCDGIAARACGLVGLEPFKIAKLLKDRTSWLRDCRRMDVLAEFNTDAGGLLELLYIQMYTPTTLALPRDFCTLRYTSFLEGRNVVVCERTFPVVNGVPTVAPVEHFVRAEMKSSGFLIRSYGSVGSIVHIVDHLDLQPGSVPEVLRPLYDSPSVLAQNMTVGALRYLQSLGQEAEADLALGQGLQLPVIRTLCQRMARSFNEAVNSLPDDGWSSLASDGMDDVSIVVNASVSSGFSGQQLSLSDKLLSINGGVLCAKTSMLLQNVPPALLIRFLREHRSEWADSEVDAEGTATIGSTIYDVSGFGRLGVSYAPVPLLLAHSLEQELLELLQMECSAFVQDGAVLPKDQFLMQLCTGLDESPVGASAQLVFAPVNVSISEDMPLLPSGFRVVPLDNNLLDGYGASRTLDLASALEGGSGVVTPVGDSGISTFPSRSILTIAFQFPCEVHSYEIVASFARKYLRTIVASVLRVAMALVPNLSSKFGQRQLPGTPELLMLVQRILQAYREWFGVDLMRGHTATINGSFKLLWHHPDAIFCYVWKSFPDIIFANQSGLDMLETTPDALQTVSWDKTLDENGRKTAYSEFADVMQQGFGYLPAGMRLSSTGRPAAYERAIAWRVDSETMQCAAFMYLNWS

SEQ ID NO: 16160 - protein, 735 aa, Populus trichocarpa
MKGLEMHGEDRHEGVENEGNPTIGFDAMEEEQDILVEDKEIWLERGQEDLLHASDVSIFYEDFPPLPDFPCMSSSSSSSSTPAPVNAITSSSSSSCSSSASSSSSAAAWAVLKSEAEEDVEKNHQHRNHCYHHNNNDDFNSQAMDDPVDVSTAALSSTCSMEVPQPPDQAMELGIECMDVMEDFGYIDLLESNDFFDPSSIFHPDEGLFEEFQMEQNEPQDQLQLQYYDEQAGNEEITKGKNDQEADHQGGRSDDLAMVFLDWLKSNKETVSADDLRRVKLKKTTIECAARRLGGGKEGMKQLLKLILQWVQTNHLQRRRMRESSSNVNLLYPYNQDPLQNQNPNPNSNLNCNPIPADHSNPCFTQSPWNVAPPPYLAADPATVMPGFSPMVGFMGDPFSNGSSNINGHPYGTPQDCNHMLQSYQTWPPSQFHSASHFNSFADNNLQSAQPQNPAFTGYGNQYPYQYVPANGDNRLTRLGSSATKEARKKRMARQRRFLSYHRNQNHHNIQHQNQGAGDPHERLSDDPNGAPTGQSNPGSWVYWPTAAGGGSASTTVDAPVDRPAMQAQTNNHRQAAAERRQGWKPEKNLRFLLQKVLKQSDVGSLGRIVLPKKEAETHLPELEARDGISIAMEDIGTSRVWNMRYRFWPNNKSRMYLLENTGDFVRTNGLQEGDFIVIYSDVKCGKYLIRGVKVRQPAGPKPENKRAGKSQRNSHANCPAAANNGSGSQKQTVK

SEQ ID NO: 16161 - protein, 195 aa, Oceanicola granulosus
MRKATVSRQTSETDISVEIDLDGSGVYDNRTGVGFFDHMLDQLSRHSLIDMTVRCTGDLHIDDHHTVEDVGIALGQALTKALGDKRGIRRYGDCALAMDDTQVRAALDLSARPYLVCELPFPSGRIGSFDTELVREFFQGFSTHGGITLHIDLVRGLNSHHIAEAAFKAVARALRTAIEPDPRKSDAIPSTKGAL

SEQ ID NO: 16162 - protein, 734 aa, Populus trichocarpa
MKGLEMHGEDRHEGVENEGNPTIGFDAMEEEQDILVEDKEIWLERGQEDLLHASDVSIFHEDFPPLPDFPCMSSSSSSSSTPAPVNAITSSSSSSCSSSASSSSSAAAWAVLKSEAEEDVEKNHQHRNHCYHHNNNDDFNSQAMDDPVDVSTAALSSTCSMEVPQPPDQAMELGIECMDVMEDFGYIDLLESNDFFDPSSIFHPDEGLFEEFQMEQNEPQDQLQLQYDEQAGNEEITKGKNDQEADHQGGRSDDLAMVFLDWLKSNKETVSADDLRRVKLKKTTIECAARRLGGGKEGMKQLLKLILQWVQTNHLQRRRMRESSSNVNLLYPYNQDPLQNQNPNPNSNLNCNPIPADHSNPCFTQSPWNVAPPPYLAADPATVMPGFSPMVGFMGDPFSNGSSNINGHPYGTPQDCNHMLQSYQTWPPSQFHSASHFNSFADNNLQSAQPQNPAFTGYGNQYPYQYVPANGDNRLTRLGSSATKEARKKRMARQRRFLSYHRNQNHHNIQHQNQGAGDPHERLSDDPNGAPTGQSNPGSWVYWPTAAGGGSASTTVDAPVDRPAMQAQTNNHRQAAAERRQGWKPEKNLRFLLQKVLKQSDVGSLGRIVLPKKEAETHLPELEARDGISIAMEDIGTSRVWNMRYRFWPNNKSRMYLLENTGDFVRTNGLQEGDFIVIYSDVKCGKYLIRGVKVRQPAGPKPENKRAGKSQRNSHANCPAAANNGSGSQKQTVK

SEQ ID NO: 16163 - protein, 399 aa, Streptococcus mutans
MNEFEDLLNSVSEVNPGDVVTAEVLTVDGEQANLVIDGTGVEAVLTLRELTNDRNADINDFVKAGDKVEVLVLRQVVGKDTDTVTFLVSKKRLEARKAWDKLVGREGDVVTVKGTRAVKGGLSVEFEGLRGFIPASMIDTRFVRNTEKFVGQQFEAKIKEIDPSENRFILSRRDVVEAAAAKAREEVFSRLAVGDIVTGTVARLTSFGAFIDLGGVDGLVHITELSHERNVSPKSVVTVGEEIQVKVLAIDEEAGRVSLSLKATTPGPWDGVEQKLAAGDVIEGKVKRLTDFGAFVEVLPGIDGLVHISQISHKRVENPKDVLSVGQDVTVKVLDVNTADERVSLSIKALEERPAQDESNGEKRQSRPRRQKRQDKRDYELPETQTGFSMADLFGDIEL

SEQ ID NO: 16164 - protein, 242 aa, Alteromonadales bacterium
MANVSMRDMLQAGVHFGHQARYWNPKMKPFIFGTRNRVHIINLEQTVPMFNNALKFLSGAAANKGKVLFVGTKRAASDAVKEAAIASDQFYVNHRWLGGMLTNWKTVRQSIKRLKDLEIQSQDGTFEKLTKKETLMLNREMEKLEKSLGGIKNMGGLPDAIFVIDADHEHIAIREANNLGIPVVAIVDTNSNPDGVDFIVPGNDDAIRAVTLYTSAVAAAITEGRENNIVAQAENDDFVEAE

SEQ ID NO: 16165 - protein, 426 aa, Coprinopsis cinerea
MKAVGHLHRTLRYWSGCNNPISYSTMSSESAPTQKPTAPSQFILPEHVYFKNPRGRYLKCVPNHLGMGVGLRWDHTKLDESCQFKIMRVPDQPGKFKIIGKPSGNYLQITHCRAPKPRGSSYSASLPDTADGGGKDAGSLQLGQIWQILSTDNADDDSEIYLVSETSHPPASSSRMRSRSRARSSSRRRGSTATASAGTDTPDTGSLFLSNNYNQVHWPGPRYAIGLTTYANDGNKITVERAALKTEICDIVYQTDQKVVGELNPTIAVQKVLENLTGVEASQSVGYKYSKSEEGNWNNKLGFELGQRLTFAVGVPMVGSGEGELTFSEGYEHTWGGSTTESQEVTTSTTVCVPPYTTVELSVLIYKKEITIPFTYTERATLFDGSVVEKKNKEGIYHNVQFIRDHATSSVIGRVGDLEVKLKKAC

SEQ ID NO: 16166 - protein, 2228 aa, Streptococcus pneumoniae
MGKGHWNRKRVYSIRKFAVGACSVMIGTCAVLLGGNIAGESVVYADETLITHTAEKPKEEKMIVEEKADKALETKNVVERTEQSEPSSTEAIASEKKEDEAVTPKEEKVSAKPEEKAPRIESQASSQEKPLKEDAKAVTNEEVNQMIENRKVDFNQNWYFKLNANSKEAIKPDADVSTWKKLDLPYDWSIFNDFDHESPAQNEGGQLNGGEAWYRKTFKLDEKDLKKNVRLTFDGVYMDSQVYVNGQLVGHYPNGYNQFSYDITKYLYKDGRENVIAVHAVNKQPSSRWYSGSGIYRDVTLQVTDKVHVEKNGTTILTPKLEEQQHGKVETHVTSKIVNTDDKDHELVAEYQIVERGGHAVTGLVRTASRTLKAHESTSLDAILEVERPKLWTVLNDKPALYELITRVYRDGQLVDAKKDLFGYRYYHWTPNEGFSLNGERIKFHGVSLHHDHGALGAEENYKAEYRRLKQMKEMGVNSIRTTHNPASEQTLQIAAELGLLVQEEAFDTWYGGKKPYDYGRFFEKDATHPEARKGEKWSDFDLRTMVERGKNNPAIFMWSIGNEIGEANGDAHSLATVKRLVKVIKDVDKTRYVTMGADKFRFGNGSGGHEKIADELDAVGFNYSEDNYKALRAKHPKWLIYGSETSSATRTRGSYYRPERELKHSNGPERNYEQSDYGNDRVGWGKTATASWTFDRDNAGYAGQFIWTGTDYIGEPTPWHNQNQTPVKSSYFGIVDTAGIPKHDFYLYQSQWVSVKKKPMVHLLPHWNWENKELASKVADSEGKIPVRAYSNASSVELFLNGKSLGLKTFNKKQTSDGRTYQEGANANELYLEWKVAYQPGTLEAIARDESGKEIARDKITTAGKPAAVRLIKEDHAIAADGKDLTYIYYEIVDSQGNVVPTANNLVRFQLHGQGQLVGVDNGEQASRERYKAQADGSWIRKAFNGKGVAIVKSTEQAGKFTLTAHSDLLKSNQVTVFTGKKEGQEKTVLGTEVPKVQTIIGEAPEMPTTVPFVYSDGSRAERPVTWSLVDVSKPGIVTVKGMADGREVEARVEVIALKSELPVVKRIAPNTNLNSVDKSVSYVLTDGSVQEYEVDKWEIAEEDKAKLAIPGSRIQATGYLEGQPIHATLVVEEGNPAAPVVPTVTVGGEAVTGLTSRQPMQYRTLSYGAQLPEVTASAENADVTVLQASAANGMRASIFIQPKDGGPLQTYAIQFLEEAPKIAHLSLQVEKADSLKEDQTVKLSVRAHYQDGTQAVLPADKVTFSTSGEGEVAIRKGMLELHKPGAVTLNAEYEGAKGQVELTIQANTEKKIAQSIRPVNVVTDLHQEPSLPATVTVEYDKGFPKTHKVTWQAIPKEKLDSYQIFEVLGKVEGIDLEARAKVSVEGIVSVEEVSVTTPIAEAPQLPESVRTYDSNGHVSSAKVAWDAIRPEQYAKEGVFTVNGRLEGTQLTTKLHVRVSAQTEQGANISDQWTGSELPLAFASDSNPSDPVSNVNDKLISYNNQPANRWTNWNRSNPEASVGVLFGDSGILSKRSVDNLSVGFHEDHGVGAPKSYVIEYYVGKTVPTAPKNPSFVGNEDHVFNDSANWKPVTNLKAPAQLKAGEMNHFSFDKVETYAIRIRMVKADNKRGTSITEVQIFAKQVAAAKQGQTRIQVDGKDLANFNPDLTDYYLESVDGKVPAVTANVSNNGLATVVPSVREGEPVRVIAKAENGDILGEYRLHFTKDKNLLSHKPVAAVKQARLLQVGQALELPTKVPVYFTGKDGYETKDLTVEWEEVPAENLTKAGQFTVRGRVLGSNLVAEVTVRVTDKLGETLSDNPNYDENSNQAFASATNDIDKNSHDRVDYLNDGDHSENRRWTNWSPTPSSNPEVSAGVIFRENGKIVERTVAQAKLHFFADSGTDAPSKLVLERYVGPGFEVPTYYSNYQAYESGHPFNNPENWEAVPYRADKDIAAGDEINVTFKAVKAKVMRWRMERKADKSGVAMIEMTFLAPSELPQESTQSKILVDGKELADFAENRQDYQITYKGQRPKVSVEENNQVASTVVDSGEDSLPVLVRLVSESGKQVKEYRIQLTKEKPVSAVQEDLPKLEFVEKDLAYKTVEKKDSTLYLGETRVEQEGKVGKERIFTVINPDGSKEEKLREVVEVPTDRIVLVGTKPVAQEAKKPQVSEKADTKPIDSSEADQTNKAQLPNTGSAASQAAVAAGLALLGLSAGLVVTKGKKED

SEQ ID NO: 16167 - protein, 456 aa, Streptomyces antibioticus
MSTRRPYQGAFTPVDQEVTAFDLPVTGRIPAELRGRYLRNGPNPLRLDDPRAHLFLGEGMVHGVRLRDGRAEWYRNRWVRSAAVARSLGEKPRRGTRFAGAEFAPNTHVIGHAGRTLALVENGFRPYELTEELETVGPCDFRGTLQAGYVAHPKLDPHTGELHAVSYATRWEFVQYSVISPTGMVTRTVNIPAPHRPVMHDFALTASYVVLYDLPVVNSLAAAAAGAPMVYDWQENRGARLGLLPRNGTEVRWFDISPCWVFHTLNAYEDGDRVVVDVIRYPRMFTGLRLDGNSTPTMDRWVIDTVSGRVTETRLDDRAQEFPGVNPAVVSGPHRYGYAAVVPDMHTYFGPDDDLDDLPDQAYSDALIKHDFSAGSSSVRPLGRGHYTGEPVFVATASPAAEDDGYLLAYVHDPDRGASDLVILSAQDFTGEPVATVHLPARVPLGLHGSWIADPA

SEQ ID NO: 16168 - protein, 322 aa, Sinorhizobium meliloti
MPEARKPGRGRVFSSITETIGDTPIVRLDKLAKEKGVKANLLAKLEFFNPIGSVKDRIGVAMIESLEAQGKITPGRTTLVEPTSGNTGIALAFVAAAKGYRLILTMPETMSVERRKMLTLLGAELVLTEGAKGMKGAIAKAQELTETLPDAIIPQQFENPANPEIHRTTTAEEIWNDTEGAVDILVSGIGTGGTITGAGQVLKARKPSVRVIAVEPEESPILSGGAPGPHKIQGIGAGFAPAILDTSVYDEVVTVNAGEAIEAARLVARLEGVPVGISAGAALQAAIEVGQREENAGRNIVVIIPSFAERYLSTVLFEGLGA

SEQ ID NO: 16169 - protein, 436 aa, Arabidopsis thaliana
MGKGPLSFRRLSSIRHRKKGSAVKDDSAQTSTPSSPPPPLPIHAGGSAVGATGKAKKKTGGARLWMRFDRTGAMEVVECDKSTIIKRASVPARDLRILGPVFSHSSNILAREKAIVVNLEVIKAIVTAEEVLLLDPLRPEVLPFVERLKQQFPQRNGNENALQASANVQSPLDPEAAEGLQSELPFEFQVLEIALEVVCSFVDKSVAALETEAWPVLDELTKNVSTENLEYVRSLKSNLTRLLARVQKVRDELEHLLDDNEDMADLYLTRKWIQNQQTEAILAGTASNSIALPAHNTSNLHRLTSNRSASMVTSNTEEDDVEDLEMLLEAYFMQLDGMRNKILTVREYIDDTEDYVNIQLDNQRNELIQLQLTLTIASFAIAAETLLASLFGMNIPCPLYSIHGVFGYFVWSVTALCIVLFMVTLGYARWKKLLGS

SEQ ID NO: 16170 - protein, 716 aa, Candida glabrata
MSDISLAESIELNSSVPKDDQVFDDEIPDAEVQSEPSEEPPKLKRRLYLEEEDKTDEALSTFVNLEDCLYSNKHVGNCNSNDFMECDCYEDFQNGKNHACGEDSDCINRLTLIECVNDLCGTCGNDCANQRFQKKEYANIAVFKTKMKGYGVRAESDIEINDFIYEYKGEVIEEEEFRDRLVDYDQKKFRHFYFMMLQSGEFIDATIKGSLARFCNHSCNPNAYVNKWVVAGKLRMGIFAKRKILKGEEITFDYNVDRYGAAAQKCYCEEPNCIGFLGGKTQTDAASLLPQNVAEALGVKASEEKKWIKLKKAEGQKIEKSEAENINIEFLESITINPCNTATDVQKVMSVLLQIENKTVAQKLLQRLYLSSNEELLHHVIKLHGYTCFTKLLQLFALEEDELKKILYFLERLPKTTKNGIISSHIDFQVKSVCKNHSSLSSIGDSLIEKWKAYEEYKRITKLDINNSTKTKLQDIRRIKLPPGWEIVFENGRPMYYNAEKKTKLLYPPTGASKTFASQKSSSPIPKFKNKRDQNNGIKRKLTDEEYEERKRKRIELEQENIKKAKEEELQRLKAKFNQEREQKQILENIIAEANRKKEEERQNQLKIEKEKKDKKESKKQLSQISKMEHKWTKFFASVVPNILKKYESDKKIDHDNMKQCARDIVKILAAKEMKKDSSKEPEATVSKEKRHKIKQFVHGYMEKFLEKLDKKKQRH

SEQ ID NO: 16171 - protein, 115 aa, Oryza sativa
MAVAIEAPFHVLAVDDSLPDRKLIERLLKTSSFQVTTVDSGSKALEFLGLHDHEDSPISTQSDQQEVAVNLIITDYCMPGMTGYDLLKKIKESSYLRDIPVVIMSSDNIPSRINR

SEQ ID NO: 16172 - protein, 174 aa, Ammopiptanthus mongolicus
MISSPAVTTVKASMGAPFTGLKSMASFPVPRKVNSDITTIANNGGRVQCMLVWPPLGRKKFETLSYLPPLSIESLTKEVEYLLRKGWVPCLEFELEHGFVYRENNRSPGYYDGRYWTMWKLPMFGCSDASQVMKELEECKKEYPTAFVRIIGFDNKRQVQCISFIAYKPPGFEN

SEQ ID NO: 16173 - protein, 414 aa, Solanum lycopersicum
MALSVQEMGQRAKKATAQVAGLSLATRNTLLKNMGAALLMRQDEIIAANQQDLVAYGASLSRPMQKRLTLDSDALTAIAESLAAVATLPDPLAGPYDTWENHAGLKIVKKIVPLGVVAMIYEARPNVTVDAAALALKSGNAVILRGGKEAIHSNTVLATILRDVLIDQNLNPDIIQLITDTTHESVNTLLHMREAIDVLIPRGSAAFIDYVVANATVPVIETGAGNTHIFVDASADQAAALRIIHNAKTQKPAVCNAAEKLLIHEAIAQEFLPKIADRLIAARVALRGDQASLGIDGRLTPASDADWDTEYNDLVMGIKIVPDVTAAIDWINTHTTHHSETIISQDPDNIAAFMNQVDAAVVYQNASSRFTDGFEFGFGAEIGISTQKLHARGPMGLPALTTIKYEALAMAIRA

SEQ ID NO: 16174 - protein, 412 aa, Mesoplasma florum
MSTINKNILESLKGELKRQQDHIELIASENYVSDAVLQLSGSILTNKYAEGYPDKRYYGGCEFVDQIEKQGIELAKKIFNAGHANLQPHSGSQANEAVYRALLQNGDKVVSMSLDAGGHLTHGYPINFSGNNYDFKFYGVNRETEEIDFDEVRKVVLEHQPKLIVAGASAYSRIIDFKKFREIADEVGALLMVDMAHIAGLVAGGAHPNPMEYADVVTTTTHKTLRGARGGMILSKAEIGKKIDSSVFPGTQGGPLENQIAGKVQALYEADTPEFKEYVHQVVANSKAFAKALADNGMRLIANGTDNHLINLDVKNTLNVTGKDAEKILESIGIVSNKNMIPFDTEKPFVTSGIRVGTAAMTTRGFKEEQFVEVAKIIASALKDQSETNLNTLSKEVAKLCKQFPIYEHLSY

SEQ ID NO: 16175 - protein, 152 aa, Casuarina glauca
MALTEKQEALLKQSWEVLKQNIPAHSLRLFALIIEAAPESKYVFSFLKDSNEIPENNPKLKAHAAVIFKTICESATELRQKGHAVWDNNTLKRLGSIHLKNKITDPHFEVMKGALLGTIKEAIKENWSDEMGQAWTEAYNQLVATIKAEMKE

SEQ ID NO: 16176 - protein, 401 aa, Methanocaldococcus jannaschii
MLSYDYENALKVGEISLEDINKVDFANAYSNLMEKLDNGVVGFRDVIYDENLDKYKSLNGYENVVVIGMGGSILGTMAIYYAISPFNNNAYFIDNSDPEKTLSILKKVDLNESIIYIISKSGNTLETLVNYYLIKKRIEKLNSFKGKLVFITNGGKLKREAEKNNYDIFSIPENVPGRFSVFTAVGLAPLYSLGVDISKILEGAREMDKICQNEDILKNPALLNGVIHYLYDKRGKDISVIMSYVESLKYFGDWYKQLIGESLGKNKHGITPLLSIGAKDQHSLLQLYMDGKKDKIITFMVAKKYRLDEEIEFEDINDEKISCRYSDIIRSQQKATEIALTNNGVPNVRITLDEINEMAMGALLYMYEMQVGFMGELYNINAYNQPAVEEEKKICWRLIKQ

SEQ ID NO: 16177 - protein, 118 aa, Brassica napus
MATISAAITTPSITRACLVQKRSLGFSSPVLGLPAMGKVGRVSCSMEEKPSSVKESSSSMLGMGASLMAAASAAAMSGPAMALVDERLSTEGTGLPFGLSNNLLGWILFGVFGLIWAL

SEQ ID NO: 16178 - protein, 244 aa, Oryza sativa
MSSTNNSSGEPPPAVRVLGGWASPFTNRVVVALKLKGVEHELLQETVGKKSELLLRSNPVHKKFPVLLHHGKPLPESLVIVEYIDEVWPASNGAASAILPRDPHGRAVERFWARYVDDKILPGLRVLRGSVTGDKYKTAGEMSTALQRLEEAFVKCSQGKEYFGGDSIGYLDIALGSFLGWIKAVEKIAGVELLNETKLPILAVWADRFCAHPAVVDVVPDADKLVEFTVQYGAVLNTTNVLPK

SEQ ID NO: 16179 - protein, 695 aa, Acidobacteria bacterium
MARPPRTPAQPVPGLTHPLGATICPEGVNFSLFSRHATGVELLFFDHAEDAQPTRVFRLDPVRNRTYYYWHLCIPDVSPGQLYGYRVYGPFAPDKGHRFNPEKLLLDPYGRCVVTPKTYSRDAAITPGDNCATAMKNAVVDVHDYDWEGDEPLRCPASRTIVYEMHVRGFTRNPNSGVAEEKRGTFAGVIEKIPYLKDLGITAVELLPVFEFDPLDCPPGLVNYWGYAPVSFFSPHKAYSSGHAYLAAINEFRDMVKALHRAGIEVILDVVYNHTAEGSETGPTFSFKGIDNLTYYILESDRCRYANYSGTGNTFKANHPVVRRMIVDSLCYWVEEMHVDGFRFDLASILARDSSGNTMANPPALWDIESEPRLAGTKFMAEAWDAAGLYQVGTFVGDSWKEWNGRFRDDVRDFFRGEDGTVCKLASRLLGSPDIYGHKGREAEQSVNFVTCHDGFTLNDLVSYEVKHNEANREQNRDGHDDNRSWNCGVEGPTNDPAINRLRNKQVKNFLATTLLSLGMPMLTMGDEVRHTQRGNNNAYCQDNELSWFDWSLLDEHADIHRFVKMIALRRLLRDVAPEQERRSLTEFLESARKTWHGVELDQPDWADHSHSIALCIEVAEEGIVFHFILNGYTEGLDFELPPRLNGSRWRRWIDTSLDSPDDIVNWRTAPAIQGPRYHAAAHSTVVLISATDGP

SEQ ID NO: 16180 - protein, 179 aa, Actinobacillus pleuropneumoniae
MKKHHVETLISREEVQSRIMELAKEINHHYAHAHCENLVVVGLLRGSFMFMADLVRLIDVPVEVDFMTASSYGSGTESSRDVKILKDLDGEIHGKDVLIVEDIIDTGFTLSKVRDILNLREPRSVAICTLLDKPSRREVEVPVEWVGFAIPDEFVVGYGIDYAQKYRNLDFIGKVVMDA

SEQ ID NO: 16181 - protein, 285 aa, Candida glabrata
MDGIKILATFSVLVLFYKLFTYSKKGGVSQKEAVKALLKTEFREFELVEKEQLTHNTAKYKFKLADESHVLGLPIGQHITVKTIIGGKPVSRSYTPTSLDEECVGFFELLVKSYPEGNISKHIGDMKIGEKINISGPRGFYEYVPNVHKHLAMVAGGTGITPMFQIMKAIARDPSDKTRVTLLYGNVLEEDILLKQELDDLVKQRPDQFKITYLLDKPERDDWEGGVGYVTLDLMKESFPSAEEDVQLLVCGPPGMVSSVKRNAVALGFPRAKPVSKMEDRVFVF

SEQ ID NO: 16182 - protein, 185 aa, Glycine max
MHSHIERILWSEDQISRRVFELAAEISDDFGGHSPAPVVVGVATGAFLFLADLVRKIDLSIAVDFVRVESYGSGTVSNGAPTISFDLKVDVNSRHVIVVEDIVDTGHTLSKVIEHLKSKGASSVSVCTFLDKPARRKVHFQLVGEGKYYRGFECPNYFVVGYGLDFAELYRNLPYIGVLKPELYK

SEQ ID NO: 16183 - protein, 60 aa, Quercus petraea
VAEIDGAPRMGPTFGAMMISGQKAAHLALKALGLPNALDAEAIHPEMILAAANPAEMAEA

SEQ ID NO: 16184 - protein, 386 aa, Magnetospirillum magnetotacticum
MPRAHGSALLSLVETQALLFATLGTGQDEQISDHLAGEYREHFMLHYNCPPYSVGEAGRMGSPGRREIGHGKLAWRAMRPTLPTKESFPYTMRVVSEITESNGSSSMATVCGSSLAMMDAGVPLPKPVAGIAMGLIKEGNDFAVLSDILGDEDHLGDMDFKVAGTVDGVTALQMDIKITSITEEIMKIALGQAKDGRIHILGEMNKGLDHARDSVSGNAPRITSISIPKEKIREVIGTGGKVIREICEQTGAKIDIDDDGTIKVASVDADAAQRAIDWIRGIVAEPELGVIYNGKVVKVVDFGAFVNFLGSRDGLVHISELARERVAKTADVVKQGDVVKVKVLGFDDRGKVKLSMKQVDQTTGEDISAQLEAERAASKRERHHED

SEQ ID NO: 16185 - protein, 1161 aa, Arabidopsis thaliana
MENHFVTSKLIRVSLHEVENQLELSLRQAFENLQPKLRPPFSLELPDPQEYLELNKAIVYGVLCEPNSSKTHIKHLHALVTDGYAFFTSLLIGIVVELYVKLVDSAKIQLIWVTKEMIDVSSVGIEDLVVSLLRRIGSGDYGDHNVWLCSELVSLFLEKWECLLDDSPLVLTSALYSFLRLLADHYRVLGVVKLENVKRLEIKFCVKMFREQLHLSLKIGRDLILLLQDLSHVSEFREIWNDLVSNHCSEIYQLKTSSRYFLLRITPEMETQLRFLLGNVKLGSHKRHQIWFLKKFLLGPEKETLLIDIVRFVCCVIHPTNEIIRSEIMPRWAIIGWLLELCRQNHHIERSVMLALFYDWLFFDERIDNIMNVEPAALLMVWSIPQYPHITHSLLEFLLHLVETYDITRRDTIVRGLTSAFREIERKGVIRSLDIFLANPALAPDLKKKLANLLSCHQEKTVHVNLNQVSVLSKQTVLSSEANLKDCSTKIVDTPDQKLDNSVENPAKNHKVELFKEFIRPSREGLSTRNAAGSEEIQLRIDPMHSDLDDEITGLHGQVRQLKNIAQEIGSEAKFQRDFLDELQMTLIRAQAGVKNNIRKLNMSIIRSGNNHIMHVGPMALLSTKSLQPIGSPSAKALAGFKLISQSSIEIFSGKSSHRLPSTTRNQKMQSLSQLGPSEIFLVARREKPSTRAQLWFTGRLSFRQETNGVRLKNRVEFSPRPVPPNLIAAEKEEAKAVLTLFFKKQGLSNSLSSRLINKSDQFIDHLVSRLHSVHKARYLVGRELTTLEIRDSLIPYLEQLHEEHGDLLAELVVSFPDPPAEPRLVASSSVPVLPPRGDTDSAADTRKLRAVSRVSELDTEGALRPQTLYLLDLGLNLEQIKTITRKFAAFPYYSLDGKIKPVVEFLLDLGIPKSDIPTILCKRPQICGISLTDNLKPTMAFLETLGIDKNQWAKIISRFPAILTYSRQKLTSTVEFLSQTGLTEEQIGRILTRCPNIMSYSVEDKLRPTMEYFRSLNVDVAVLLHRCPQTFGLSIESNLKPVTEFFLEKGFGLDEIGVMISRYGALYTFSLKENVMPKWDYFQTMDYPKSELVKFPQFFGYSLQERIKPRYELVQRSGVRLLLNQVLSLSGIEFEKVVKKKMMKLVSNNVIAEQSSGGLL

SEQ ID NO: 16186 - protein, 375 aa, Xanthomonas axonopodis
MSKRDYYEVLGVARGASDEELKKAYRRCAMKHHPDRNPGDAAAEAAFKECKEAYEVLSDGNKRRAYDAHGHAAFEHGMGGGGGPGGPDMGDIFGDIFGNIFGGGAAGPRAARRGADVGYVLELDLEEAVAGIERRIEIPTLIECAPCHGSGSEDGKVETCGTCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 16187 - protein, 844 aa, Ceratopteris richardii
MAVSKMKDARSLADSCKYVRYTQEQVQALERLYAECPNPSSFRRLQLLRECPILSKIEPKQIKVWFQNGGCRDKQRKEASRLANLNEKLSAMNRVLVEENESLSKQAIQLVLQNQKIRKQLKQLHCHESSVKLDQNGLSSTENSSDSVVTNIMNHQTLQLPRDAGPLRLAAIAEETLAEFLAKATGTAVEWIQMPGMKPGPDSIGIVAVSDGSNGIAARACGLVGLDPAKIVELLKNRPLWLSDCRRMEVVGTCTSTSGGMVELLYMQFYAPTTLAMPRDFYTLRYTTVLDDCNVVVCERSLPLSHGDPVLPPPDQFVRAKMHSSGYLIRPYGGVGSIVYLVDHMDLQPETVPEVLRPLYESSPVLAQRVTMGAMRYLRTVAHDVDGDSSPVRGLQPAVIRTLTQRMARGFNEAINCLSDDGWSSMPSDGMDDVTIAVNTYPVSRISQGQFLFCDRLPAASDGVLCAKTSMLLQNVPPALLIRFLREHRSEWADLEVCTDIAASLGHAPLASRRGVSCYGSAPLLLSHSPEQRELLELLQMDSPTVFQDGGFYAKDNFLLQLCTGLDEASVGASAQLVFAPVSVSVSEDMPLVSSGFRVVPLDSSLANEHEMARTLDLASVLESGGRIISPSADKGPTCPMRSILTIAFQFPCEIQTFECVATLARKYVRTVVASILRVAMALASNLSPPADLKQTPGTPELLILVQRMLQSYESHFGIELLKGHSESIDTLFKLLWHHPDAILCCIVKASPELIFANQSGLDMLETSSNELRTLDWQKMLDENERKSFCTELDEVLQRGFAYLPRGVRISATGRVATFERGVAWKVHSEMPECLAYMFVKWSF

SEQ ID NO: 16188 - protein, 160 aa, Rubrobacter xylanophilus
MAKHRGQAQGMDFGIRVGAVVERDGRLLLVRHQKPDREPYWVLPGGRLEPGERIPECARREVLEETGLAAEFLGVLYVSEFLREGRHTVDITVRMGAGEGEARLGEDPEVAPGGEPTLRELRWVPASGLAEIELLPPWLRERLISDFPRGWPPGEVYLGG

SEQ ID NO: 16189 - protein, 435 aa, Arabidopsis thaliana
MGSWIPKLLLLQLVLLLTKHADSSSIIKYLPGFEGPLPFELETGYIGVGDEDEDQMFYYFIKSESNPEEDPLLVWLSGGPGCSSFTGLVYENGPLGFKVEAYNGSIPTLVSTTYSWTKVANIIYLDQPVGAGFSYSRNPFADRPSDTGSAKLVNEFVRKWLAKHPDYFSNPFYVTGNSYSGKVIPAIVQEISNGNYICCKPQINLQGYVIGNPVAYYDHDKDSRIPFAHGVALISDELFESLKRSCGGSYSIVDPLNTECLKLIKDYHKCVSGIYQELILKPKCETTSPDCYTYRYLLSIYWANNEIVRRALKVVEGSKGKWERCDLSVRSNQDIKSSIPYHMNNSIKGYRSLVISGDHDMTIPFLGTQAWIRSLNYSITEKWRPWMILDQVAGYTKTYANKMTLATVKGGGHTLEYKPEENSILFKRWISGQPL

SEQ ID NO: 16190 - protein, 202 aa, Brassica oleracea
MNILNRFGLGSGGQTSTDPSPIAQGPDDDSPAPGNHFAQFAAGCFWGVELAFQRLPGVTQTEVGYAQGITHNPSYEDVCSETTGHAEVVRVQYDPKGCTFESLLDLFWSRHDPTTLNRQGNDVGTRYRSGIYFYTPEQEKLARESLERHQQRMERKIMTQILPAKKFYRAEEQQQQYLSKGGRYGMGQSCAKGCTDPIRCYG

SEQ ID NO: 16191 - protein, 320 aa, Arabidopsis thaliana
MELTLKLLVLLLFILNHHVGSGSIVKFLPGFEGPLPFELETGYIGIGEEEEVQLFYYFIKSERNPKEDPLLLWLSGGPGCSSITGLLFQNGPLALKSEVYNGSVPSLVSTTYSWTKTANIIFLDQPVGAGFSYSRAPLIDTPTDTGEVKRIHEFLQKWLSKHPQFSSNHFYAGGDSYSGMIVPALVQEISKGNYICCNPPINLKGYVLGNPITHEDDPNYRIPFSHGMALISDELYESIREACKGNYFNVDPRNTKCLKLVEEFHKCTDKLNEFHILSPDCDTASPDCYLYPFYLISFWANDESVRDALHVNKVYAINNV

SEQ ID NO: 16192 - protein, 361 aa, Brassica oleracea
MENEKGESSSIFKMGNSAQERSLPYVPDCYAVPPSYEPRDALDSNFEIVPTIDISRLKGSDDERRGVIQELSSACQLFGFFQVVNHGINQNILDDALEVAHGFFELPAKEKKKFMSNDVYAPVRYTTSIKDGLDKIQFWRIFLKHYAHPLHRWIHLWPQNPPEYREKMGKFCEEVRSLSLEIMGAITESLGLGRDYLSSRMDKNGMQVMAVNCYPPCPDPTTALGLPPHSDYSCITILLQNLTGLEIFHLSAHGGSGRWVLVPEVKGVLKVHIGDHVEVLSNGLYNSVIHKVTLNEEKTRISLASLHSLGMDDKMSVPYQLVNNENPARYRESSFNDFLAFLVKNDISQGERFIDTLRIKD

SEQ ID NO: 16193 - protein, 411 aa, Arabidopsis thaliana
MSLTLEFLLLLIVLILSHHAHSGSIVKFLPGFEGPLPFELETGYIGIGEEEEVQLFYYFIKSEKNPEEDPLLLWLSGGPGCSSLTGLLFENGPVALKFEVYNGSVPSLVSTTYSWTKMANIIFLDQPVGSGFSYSRTPLVDKISDTGEVKRIYEFLQKWLSKHQQFFSNPFYVGGDSYSGMIVPPLVQEIGKGNYQINLQGYILGNPITDTESEQNYQIPYAHGMALISDELYKSMERICKGNYVKVDSLNTKCYKLIKDYQKCIHKLNKYHILLPDCDITSPDCFLYRYTLITFWANNKSVREALQVNKGSIGKWVQCNYKNISYNYDIKSSVAYHMKNSIDGYRSLIYNGDHDMMVPFLATQAWIRSLNYSITDDWKPWMINDQIAGYTRSYSNKMTFATIKASLLVST

SEQ ID NO: 16194 - protein, 235 aa, Glycine max
  misc_feature (229)..(229): Xaa can be any naturally occurring amino acid
ARCTIVSELSNKDFDSYVLSESSLFIYSQKIVIKTCGTTMLLLTIPRILELAEELCMSLAAVKYSRGMFIFPGAQPAPHRSFSEEVDVLNRYFGHLKSGGNAYVIGDPAKPGQKWHIYYATEQPEQPMVTLEMCMTGLDKKKASVFFKTSADGHVSCAKEMTKLSGISDIIPEMEVCDFDFEPCGYSMNAHHGSAFSTIHVTPEDGFSYASYEVMGMDASALAYGDIVXRVLRCF

SEQ ID NO: 16195 - protein, 365 aa, Cleome spinosa
MALPVSAIGFEGYEKRLEISFFEPSLFLDPKGMGFRALAKSQLDEILQPAECTIVSSLSNDQVDSYVLSESSLFVYPYKVIIKTCGTTKLLFSIPPLLELAGELSLVVKSVRYTRGSFICPGAQPFPHRSFSEEVAVLDAHFAKLGLSSSAYVMGNDGADETRKWHVYAASAKGTSRSDYNNVYTLEMCMTGLDRKKAAVFYKTESSSALSMTEESGIRKILPNSAICDFEFEPCGYSMNSIEGEAISTIHVTPEDGFSYASFEAVGYDFKAMDVSGMVRRVIDCFEPKQFSVAIHADTVEEEDMMMMMITGIEEDGDYGCRERTVQKLGEEERGAVLYYGFDRTNGSPRSILKCGWSSEDEKDM

SEQ ID NO: 16196 - protein, 279 aa, Rhizobium leguminosarum
MIDAAFSHLPVLEPGNVWLVGAGPGDPGLLTLLAAKGLFEADVIVHDALVNEECLALARPETLVEYAGKRGGKPSAKQRDISLRLVELARAGKKVLRLKGGDPFVFGRGGEEALTLVEHNIPFRIVPGITAGIGGLAYAGIPVTHRDINHAVTFLTGHDSSGIVPDRINWEAIGRGSPVIVMYMAMKHIAEISTNLIAAGRLPTEPVAFVCNAATGRQQVLETTLGEATEAVAVSGLEPPAVVVVGEVVRLRASLDWLGALAGRRLQPDPFRRSGKVRA

SEQ ID NO: 16197 - protein, 479 aa, Triticum aestivum
MALTRMGLAGLAVMGQNLALNIAEKGFPISVSHRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSVEKGWGLNLGELARIWKGGCIIRASFLDRIKKAYDRNGELANLLIDPEFAQEIMDRQAAWRRVVCLAINNGVSTPGMSASLAYFDSYRRERLPANLVQAQRDYFGAHTYERVDMPGSFHTEWYKIANSKI

SEQ ID NO: 16198 - protein, 277 aa, Unknown
  Phalaenopsis hybrid cultivar
MAATAATMALSSPSFAGKAVKISPSNVLIFGEGRITMQDKTTSNRPRTTAGKLRPATSSPWYGPDRVKYLGPFSGEPPSYLTGEFPGDYGWDTAGLSADPETFAKNRELEVIHSRWAMLGALGCIFPELLARNGVKFGEAVWFKAGSQIFSEGGLDYLGNPNLIHAQSILAIWAVQVVLMGAVEGYRIAGGPLGEITDPLYPGNSFDPLGLADDPEAFAELKVKELKNGRLAMFSMFGFFVQAIVTGKGPLENLADHLADPVNNNAWAYATNFVPGK

SEQ ID NO: 16199 - protein, 480 aa, Coprinopsis cinerea
MASQNTPAFNKILYAPLAEIDPEVKNIIDKETWRQFTGLELIASENLTSQATMEANGSILTNKYSEGLPNARYYGGNEYIDELELLCRKRALEAFHLDASKWGVNVQPYSGSTANFAALTALIQPQDRLMGLGLPDGGHLTHGYYTAKKKMTASSIYFQSLPYGIIPESGLIDYDKLEAQAKIYKPRLIICGASAYPRDWDYARLRQIADKEGAWLMADIAHTSGLIAAQELNSPFDYCDVVTTTTHKTLRGPRAGLIFYRKDLENAKDLEKRVNDAVFPACQGGPHNNTIAAIATALKQVASPEWKAYAKQVVANARALAETLVGHGYKLQTGGTDNHLVLWDLRPIGLTGSKVEKVCDLMGITINKNAVSGDASAQVPGGIRLGTSALTSRDMREEDVKQVAEFLHRAVQISLTLQKEAGTKLLKDFVRVATTKEEGKVGYEQVSQLREEVQAFAKRFPLPGVDTQNLQRPEGLHEYH

SEQ ID NO: 16200 - protein, 243 aa, Oryza sativa
MSSSSTSGSAEPAAAVRVLGSWTSPFVMRVVVALKLKGVEYELLQETRGKKSELLLRSNPVHKKIPVLLHHGKPLAESLVIVEYIDEVWPASDGAPAILPRDPYCRAVERFWAQYIDDKFPRGTRVLRGTVAGDKDEVVVEMSTALQHLEAAFVKCSRGKEYFGGDNIGYLDIALGSFLGWIKAVEKFAGVELLDEAKVPNLAAWVDRFCAHPAVVDAMPDADKLVEFAVKHAASMKALDAPK

SEQ ID NO: 16201 - protein, 273 aa, Oryza sativa
MAGGGDELKLLGMWASPFALRAKLALSFKGLSYDYVEEDLKNKSELLLSSNPVHKKVPVLIHNGKPICESQVIVQYIDEVFPDAGVTLLPADPHDRAVARFWASYIDEKLLGAWIPVFRGKTEEEKAEGVKQTFAVAETLEGALSECSKGKPFFGGDTVGYVDVVLGGFVAWVHAIEEVFGLNQFDAAKTPLLAAWLERFDELDAGKEVMPDIGRLVELEKMRQAQAQAAFLAVRLYLLLFLQPCFISSCCRTVYVSPCVAEVANWVFYKIVL

SEQ ID NO: 16202 - protein, 212 aa, Oryza sativa
MSSTNSSGDPAAVRVVGGWASPFVNRVVVALKLKGVEHEMLQETVGKKSELLLRSNPVHKKIPVLLHHGKPIAESLIIVEYIDEVWPASNGAPSILPRDPYGRAVERFWAKYIDDKHLEEAFVKCSQGKQYFGGDNIGYLDIALGSFLGWIRAVEKIAGVELLDEAKVPNLAAWADRFCAHTAVVDVVPDADRLVEFTVQHAALLRAVNAPK

SEQ ID NO: 16203 - protein, 106 aa, Silicibacter pomeroyi
MSTVAVTDATFDAEVKNSDIPVVVDFWAEWCGPCKQIGPALEELATEYAGKVKIAKVDVDSNPNAAAAMGVRGIPALFIFKDGQVVSNRAGAAPKAALQNWIDSSI

SEQ ID NO: 16204 - protein, 422 aa, Pyrococcus horikoshii
MDMVEQDPFEIAVKQLERAAQHMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAVYDIISPYEDIPAPDVYTNPQIMAWMMDEYETIARRKTPAFGIITGKPLSIGGSLGRNEATARGASYTIREAAKVLGWDGLKGKTIAIQGYGNAGYYLAKIMSEDYGMKVVAVSDSKGGIYNPDGLNADEVLKWKREHGSVKDFPGATNISNEELLELDVDVLAPAAIEEVITKKNADNIKAKIVAEVANGPVTPEADEILFEKGILQIPDFLCNAGGVTVSYFEWVQNITGYYWTLEEVRERLDKKMTKAFYDVYNTAKEKNIHMRDAAYVVAVQRVYQAMLDRGWVKH

SEQ ID NO: 16205 - protein, 243 aa, Oryza sativa
MAGGGDELKLLGMWASPFALRAKLALSFKGLSYDYVEEDFKNKSDLLLSSNPVHKKVPVLIHNGKPICESQVIVQYIDEVFPDAGVTLLPADPHDRAVARFWAAYIDEKLFSAWILVFRSKTEEEKAEAVKQTFAVVEKLEGALSECSKGKPFFGGDTVGYVDVVLGGFVAWVHAIEEVFGLNQFDAAKTPLLAAWLERFDELDAVKEVMPDIGRLVELAKMRQAQAAAAAAAVAAAAAGEAN

SEQ ID NO: 16206 - protein, 418 aa, Pseudomonas aeruginosa
MFSKHDQLQGYDDELLAAMDAEDRRQEDHIELIASENYASKRVMQAQGGGLTNKYAEGYPGKRYYGGCEHVDKVERLAIDRARQLFGADYANVQPHSGSSANAAVYLALLNAGDTILGMSLAHGGHLTHGAKVSSSGKLYNAVQYGLDTATGLIDYDEVERLAVEHKPKMIVAGFSAYSKTLDFPRFRAIADKVGALLFVDMAHVAGLVAAGLYPNPIPFADVVTTTTHKTLRGPRGGLILARANEEIEKKLNSAVFPGAQGGPLMHVIAAKAVCFKEALEPGFKDYQAQVIRNAKAMAEVFIGRGYDVVSGGTDNHLMLISLVKQGLTGKAADAALGAAHITVNKNAVPNDPQSPFVTSGIRIGTPAVTTRGFREGECRELAGWICDILDDIDNPEVGERVRGQVGEFCRHFPVYAD

SEQ ID NO: 16207 - protein, 369 aa, Oryza sativa
MASRRHGHGGCCRNRTPFRLHRAPLPLSLWLTAPAAELLAVATSPAVAAAGFGERWATTTGRAAVPPDLGEESELRTSKRQGTQQNKSQKLQILETCLEHWIAMAGGGDDLKMLGVYVSPFPLRVKLALSFKGLSFEYVEEDLHNKSDLLVSSNPVHKRTPVLIHNGKPISESMVIVQYLDEAFPGAGAALLPSDPLDRAVARFWASYIDDKVIRMITVHQFSHASFSDDFGADRMMQLFSAWKMVFKGKTEEEKAEGRKQTFAVAETLEGALRECYKGKPFFGGDAVGFVDVALGGFVPWVHAMEELFGLRQFDAATTPLLAAWLERVGELEAYKAVMPDAGMMIEFKKKQAQEAAAAAAAAAAAAEA

SEQ ID NO: 16208 - protein, 641 aa, Bordetella parapertussis
MCGIVGIWGPLRDKANVLAESCRRIRHRGPDSNGYWEDAEADLALAHVRLAILDLTEAGHQPMVSACGRYVIVLNGEIYNHMELRERLQQDGLAPAWRGHSDTETVLACFAGWGLEQTLQAAVGMFAIALWDRAERKLALMRDRMGEKPLYYGYSQANLLFGSELKAFMPVPGFGRELDRNALASFMRHNYIPAPQSIYAGIRKLPPGAWVEIDAAQMRRGELPEPQVYWSARRAADQGLGDRRRFESDAQAIDALEQVVSQAVRGQMLSDVSLGAFLSGGIDSSTVVALMQAQSAQPVRTFAIGFHEKGYNEAEHAKAVAAHLGTEHTELYVTAEDGLAVVPSLADMYDEPFADSSQIPTSLVTRMARQHVTVALSGDGGDELFGGYSRYFRVDNWWRKCAAMPGPLRHLAGAALRGSAALPGAGAWRGKVGKLGELLGADTRGEFYRLFVSYWADPGRVVIGGTEPLSPFEQPMEGSTFDAMMKLDTVTYLPDDILVKVDRAAMAVSLETRVPLIDHRVYEFAWQLPFEYKVRGGTGKWLLRQLLYRHVPQAMVDRPKRGFAVPLAAWLRGPLRDWAEALLDPARLRQEGWFEPEPILRKWREHLSGHRNWDSHLWGVLMMQAWLDRYRAGAGDEAGRR

SEQ ID NO: 16209 - protein, 959 aa, Pseudomonas aeruginosa
MTDNLNLGAIDLGTDDEFIARHIGPRAADTQAMLQRLGYDSLDTLIGNVIPDSIKGSSVLDLPAGMGEAEALASLKAIAARNRALRSFIGQGYYNCHTPAPILRNLLENPAWYTAYTPYQPEISQGRLEALLNFQTLVSDLSGLPIANASMLDEATAAAEAMTFCKRLSKNRTSQAFFASRHCHPQTLDVLRTRAEPLGIEVVVGDESTIEDFSAYFGALLQYPTCDGEIVDYRELVSRFHAVDALVAVAADLLALTLLTPPGEFGADVAIGSAQRFGVPLGFGGPHAAYFATRDAFKRDMPGRLVGVSIDRHGKPAYRLAMQTREQHIRREKATSNICTAQVLLANIASMFAVYHGPQGLLRIARRTHRLTAILAAGLERLGVAVEQKHFFDTLSLATGARTAAIHAKARAAGINLREIDAGRLGLSLDETVRQTDVETLWGLLAEEGQALPDFAALAASSGDRLPVELLRQSAILSHPIFNRHHSETELMRYLRKLADKDLALDRTMIPLGSCTMKLNAASEMIPVTWAEFGNLHPFAPAEQSEGYRQLTDELEAMLCSATGYDAVSLQPNAGSQGEYAGLLAIRAYHQSRGDSQRDICLIPSSAHGTNPATASMVGMRVVVVACDARGNVDVEDLRNKASEHKERLAALMITYPSTHGVFEEAIREICAIVHDCGGQVYIDGANMNAMVGLCAPGKFGGDVSHLNLHKTFCIPHGGGGPGVGPIGVRAHLAPFLPGHARGERKEGAVSAAPYGSASILPITWMYIRMMGGEGLKRASEMAILNANYIAHRLEEHYPVLYAGGNGLVAHECILDLRPLKDSSGISVDDVAKRLMDFGFHAPTMSFPVAGTLMIEPTESESKAELDRFCDAMIRIREEIRAVERGELDKEDNPLKNAPHTAAELLGEWNHAYSREQAAYPLASLVEAKYWPPVGRVDNVYGDRNLTCSCPPIEAYSEE

SEQ ID NO: 16210 - protein, 236 aa, Oryza sativa
MAGGGDELKLLGMWASPYVLRVKIALSLKGLSYKYVEEDFKNKSELLLSSNPVHKKVPVLIHNGKPICESQVILQYLDEAFPDAGATLLPADPHERAVARFWAAFCDDTIAKASQQASSGKTEEEKAEGEKKVVEALEKMEVGLSECSKGKPFFGGDTVGYVDVVLGGFLAWVRAGDAMKGVKRFDPATTPLLAAWAERFVELDVAKAAMPEVDKLIELAMARMAGAAAAAAAATN

SEQ ID NO: 16211 - protein, 268 aa, Gossypium raimondii
GAWTKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNMPTSVSKSSSIKNPSLDFNYNEFQFKSNTDSLEEPNCTASSGMTTDEEQQEQLHKQQQYDPSNGQDLNLELSIGIVSADSSRVSSANSAESKPKVDNNNFQFLEQAMVAKAVCLCWQLGFGTSEICRNCQNSNS

SEQ ID NO: 16212 - protein, 127 aa, Glycine max
  misc_feature (33)..(33): Xaa can be any naturally occurring amino acid
  misc_feature (40)..(40): Xaa can be any naturally occurring amino acid
  misc_feature (52)..(52): Xaa can be any naturally occurring amino acid
  misc_feature (99)..(99): Xaa can be any naturally occurring amino acid
  misc_feature (119)..(119): Xaa can be any naturally occurring amino acid
MASSMISSPGATTVDRAGADMVAPFTELKTMAXGFPTRKXSDDITSIASNAXRVQCMQVWPFLGKKKFETLYYLPDLDNDNWERKYNTFLTKGSIPCLXFEMEHGFLYREHNRSPGYYXGRYWTMWK

SEQ ID NO: 16213 - protein, 265 aa, Gossypium herbaceum
TKEEDQRLINYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNSPTSVSKSSSIKNPSLDFNYNEFQFKSNTDSLEEPNCTASSGMTTDEEQQEQLHKKQQYGPSNGQDINLELSIGIVSADSSRVSSANSAESKPKVDNNNFQFLEQAMVAKAVCLCWQLGFGTSEICRNCQNSNS

SEQ ID NO: 16214 - protein, 268 aa, Zea mays
MAADERDRERWILPGATALVTGGSKGIGHAIVEELAALGARVHTCSRNAAELEECRRRWAEKGGGRLLQQVTVSVCDVAVRADREALMATVRDVFGGKLDILVNNAAQVVFKPAVECTGEEYARIMATNLESCFHLSQLAHPLLRNASLAGGGSVVHISSTAGLLGFPGAVLYSTAKGGVNQLTRSLAAEWACDKIRVNSVAPGIVMTDMVKNAASSEAVEQETSRIPLRRAGEPAEVASVVSFLCMPAAAYVTGQVIYVDGGRTISA

SEQ ID NO: 16215 - protein, 263 aa, Gossypioides kirkii
AWTKEEDQRLIDYIRVHGEGCWRSLPKAAGLLRCGKSCRLRWINYLRPDLKRGNFTEEEDELIIKLHSLLGNKWSLIAGRLPGRTDNEIKNYWNTHIKRKLISRGIDPQTHRPLNQTANTNTVTAPTELDFRNTPTSVSKSSSIKNPNFNYNEFQFKSNTDSLEEPNCTASSGMTTDEEQQEQLHKKQQHDPCNGQDLNLELSIGIVSADSSRVSSANSAESKPKLDNNNFQFLEQAMVAKAVCLCWQLGFRTSEICRNCQNS

SEQ ID NO: 16216 - protein, 429 aa, Archaeoglobus fulgidus
MKYDYVIIGNSAGGIGCVEAIRELDVDSSILVISAEKYHAYSRALIPYYLDGKIEFEKMYYRPPDFYEKMDVETKLGVRAVGVDVEAKKVLLESGEEVEYGKLLIATGGKPFIPPMEGLGGQSNVFTFLKMDDVLAVEKAIKEAKKAVVLGGGIIGLMASEVLAKKGLDVKVVELADRVLAPVVDETTSRIVERKFEENGVEIILNNTISKVVGEERVEKVILRDGRELEADMLLVAVGVVPNVDIVKNTPIKVNRGIVVNRKMETSVKDVYACGDCAEIYDFVFGANRVLPLWPTAYTGGRIAGFNMVGIEREYNLATSMNAMHFFDYYIINAGLNVPNDSEEFEVIYRLEGDSYRKFALKDGRIAGFIIAGKMERAGIFLKLMEEGIDVSSFKEKLLKDNFGFLDIPEPTRWKLIEDKIKLGVVREI

SEQ ID NO: 16217 - protein, 160 aa, Gloeobacter violaceus
MATVSDITVQTVDGQARSLGRYKGQVLLIVNVASYCGYTPQYAGLEKLYRRYKDAGLRVLAFPCNDFGGQEPGSNAEIAEFCSRYDVSFELFDKVGARGYYKHPLYVRLSEAAEPAGEVSWNFEKFLIAKSGEIVGRYRSGIGPEDPQLVADIERELAKS

SEQ ID NO: 16218 - protein, 169 aa, Datisca glomerata
MQSLQEKASQWSGVKQEDAFAIDNTNLFQKLGLQTFVNLSTNFYNRVYDDEEEWFRSIFASSKKEDAIQNQYEFFVQRMGGPPLYSRRKGHPALIGRHRPFPVTHQAAERWLHHMLLALDSTPDIDVDSKVKMINFFRHTAFFLVAGDELKNQNLQFQCKHGIQQTPAP

SEQ ID NO: 16219 - protein, 230 aa, Arabidopsis thaliana
MDPDAVKSTLSNLAFGNVMAAAARNYQKEVLANEKAQGSNPVNEEVDLDELMDDPELERLHADRIAALKREVEKRESFKRQGHGEYREVSEGDFLGEVTRSEKVICHFYHKEFYRCKIMDKHLKTLAPRHVDTKFIKVDAENAPFFVTKLAIKTLPCVVLFSKGVAMDRLVGFQDLGTKDDFTTNKLENVLLKKGMLSKKKKEEDDEDAEYQESIRRSVRSSENLDSDSD

SEQ ID NO: 16220 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQGQFGTTYLCTEINTGCEYACKTIPKRKLITKEDVEDVRREIQIMHHLSGHKNVVAIKDVYEDGQAVHIVMEPCAGGELFDRIQEKGHYSERKAAELIRIIVSIVAMCHSLGVMHRDLKPENFLLLDKDDDLSIKAIDFGLSVFFKPGQVFTELVGSPYYVAPEVWHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 16221 - protein, 381 aa, Phanerochaete chrysosporium
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGL

SEQ ID NO: 16222 - protein, 122 aa, Glycine max
  misc_feature (113)..(113): Xaa can be any naturally occurring amino acid
IVQSSRHGKVAILDGCIQLTENDEFAYQEMLTHLALCSIPNPKKVLLVGGGDGGILREISRHSSVEHIDICEIDKMVIDAYKKFFPDIAVGYEDPRVHVHIRDGIAFTNSVPXGTYDVIIVD

SEQ ID NO: 16223 - protein, 497 aa, Novosphingobium aromaticivorans
MGAFPQTIYFTGANAPVGEEPDLRGLKVEGDLPAEVRGSFYRAIPDPAFPPRFENDHTLSGDGMVSRLSFNGDGTADFIQKYVETARYKAEKAAGKALFGKYRNPFTDDPEVQGVDRTVANTTPVWHAGRMLMAKEDGRPYRVDPRTLATIGSYDFGGALKSETMTAHVRIDAGTGELFFYGYEADGQASTKVAYCIVGPDGELKREQWFDAPYCAMMHDFTISENYALFPIYPTTADLDRLKAGGEHWHHQPELDSWLGVMPRYGDVSEIKWFKGPKGCHSYHMMNAWEDADGMLHFDACLNNTNAFAFIREPSGIHMGPQDIKGALTRWTVDPRADGGDVVETVIGPPGDFPVIPAKLQGRPYKTGWMLSMNPELQGPPLFAGPVGVSFNLLLRLDGMDTPAPQVTGALALPPMAGFNEPVHVPAADPAKDGWLVFLVDQQVGDNQFVHEAWVVDAGNIGAGAVAKVHIPTRLRPQVHGWWVPQAQLDALEGSAA

SEQ ID NO: 16224 - protein, 790 aa, Glycine max
  misc_feature (101)..(101): Xaa can be any naturally occurring amino acid
MAASVDNRQYGTHINAVVRACGPDFNTPLPSDFDLDSSSDDEDQNDDASYLKELIQKANAETEASLLDPRDEGTADQWIPRNASMVRLTGKHPFNSEAPLXPLRHVLKRCGILARMKGAMYVSFEGAEDLPGGGGSKYGTSVKREMAMDPSRDIILAFMQNGEPLAPDHGFPVRMIIPGFIGGRMVKWLKRIVVTEHECDSHYHYKDNRVLPSHVDAELANDEGWWYKPEYIINELNINSVITTPCHEEILPINSWTTQRPYVIRGYAYSGGGRKVTRVEVTLDGGETWHVCTLDHTEKPNKYGKYWCWCFWSLEVEVLDLLGAKEIAVRAWDEGLNTQPEHLIWNVMGMMNNCWFRVKTNVCKPHKGEIGIVFEHPTQPGNQPGGWMAKEKHLEKSQKPKPTLKKSVSTPFMNTSSKMFSISEVKKHSNPDSAWIIVHGHVYDCTRFLKDHPGDTDSILINAGTDCTEEFDAIHSDKAKKLLEDYRIGELITTGYTSDSSPNNSVHGNSEFTHLAPIKETTTPPSRSVALNPREKIPCKLVSKTSISHDARLFRFALPSEDQLLGLSVGKHIFLCATIDGKLCMRAYTPTSSVDEVGFFDLLIKVYFKGVHPKFPNGGLMSQHLDSLPIGSMLDVKGPLGHIEYTGRGNFMVHGKPRFAKRLAMLAGGTGITPIYQVAQAILKDPEDHTEMHVVYANRTEDDILLREELDEWAKIHNDRFKLWYVVEIAKEGWKYSVGFITESITREHLPKASRDSLALTCGPPPMIQFAVQPNLEKMGYDIKNDLLVF

SEQ ID NO: 16225 - protein, 173 aa, Glycine max
  misc_feature (4)..(4): Xaa can be any naturally occurring amino acid
  misc_feature (24)..(24): Xaa can be any naturally occurring amino acid
  misc_feature (73)..(73): Xaa can be any naturally occurring amino acid
  misc_feature (95)..(96): Xaa can be any naturally occurring amino acid
  misc_feature (136)..(136): Xaa can be any naturally occurring amino acid
GPPXIRSENEADLAAAHEAGYESXLVSRLTLKPGKIASLAKSVRTLANMEDPINEILKRTEVADGLVLEKTSXPLGVLLIIFESRPDALVQIASXXIRSGNGLLLKGGKEAMRSNAILHKVITNAIPDNVGEKLIXLIITRDEIADLLKHDDVIDLVIPRGSNKLVAQIKSST

SEQ ID NO: 16226 - protein, 480 aa, Erwinia carotovora
MNYLPIFADLRQRPVLVVGGGEVATRKIDLLQRAGAEVKIVALALAEPLAAQHQAGQVEWLAQSFTPELLSGVFLVIAATDDAELNAAVFEAANQRHLLVNVVDDQPKCTFIFPSIVDRSPLVVAISSGGQAPVLARLLREKLESLLPASLGTMAEIAGSWRDRIKTRLHSMPARRRFWERLFVGRFASLVSAGQLEQAEGELQQQLVNQQDEQQLPAAARGEVALVGAGPGDAGLLTLRGLQVMQQADVVLYDHLVSADVLDLVRRDAERICVGKRASTHSLPQGEINQLLVKLAQEGKRVVRLKGGDPFIFGRGGEELQAVAQAGITFQVVPGVTAAAGVTAYAGIPLTHRDHAQSVIFITGHCRPDGDSLDWSTLARGRQTLAIYMGTMKAAEISQQLIAHGRSAQTPVAVISRGTRHDQQVQIGTLQELEHLARQAPTPALLVIGEVVDLHHQIAWFGQTTPTVPQDSRPAVVNLA

SEQ ID NO: 16227 - protein, 376 aa, Shigella flexneri
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNEKQKQLLQELQESFGGPTGEHNSPRSKSFFDGVKKFFDDLTR

SEQ ID NO: 16228 - protein, 370 aa, Streptococcus pneumoniae
MNDKLKIFLLLGVFFLAITGFYVLLIRNAGQTDASQIEKAAVSQGGKAVKKTEISKDADLHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 16229 - protein, 680 aa, Clostridium difficile
MSILVTLLGLLVCTTISTVFSKKWSNIPLAIYQIVLGIILSILPFKFSFSFNPEIFVICIIAPLLFSEGQNVSRKELLELRKPILLLAFGLVLITVFAGGIFIHFLIPGMPLSVSFALAAVISPTDLVAVKSITQGLNFPKNMMSILEGESLLNDAAGVVAFKVAVLATVTGVFSIEEAGIQFMITAFGGIIVGSILGYIIIKIRLSLHKWNLEEIPMVIVIQIMTPLFVYFVAEEIGVSGILAVVMAGIAHGIEKEHLQNTTTKLRIISDNTWYVLEYVLNGFVFTLLGFLLPSIYTGLSSKNENMALELTFISTLIVLILFVIRFIWVYLWHNSFIKPKKNPLNNFFVGFLGFKDEEVVKESISKCKYSLIVATCGVHGTFTLATALSIPFYLADKDVFPMRDTVLFISSEVILISLVLATVLLPRLLKNNVQESEPLLSDKEAYKLILKEAILKLSNEKAQEVQPVIHDLNEQLVDSEKGILNTPDNKLISMMIAEADQQGLLAVLKLLEDGKISDRAFKLYRFYITKSRKSVQKSIFKIVKLKISMWIINRKVKKEVKEKITKIVSENKEIIKEFHHAYALSTKTAISFINKNTDEDNRHEALIAIRFYNRYLNWITRKIQNDDKFEARVEYYRVMAIQSQRDSVQQLVETKQISREVAKELLENILYDEMMMIES

SEQ ID NO: 16230 - protein, 198 aa, Methylobacillus flagellatus
MTAMRNAEVSRNTLETKIAVAINLDGTGISRLNSGVGFFDHMLDQIARHGMMDISVECQGDLHIDAHHTVEDVGIALGQAFSKALGDKKGIRRYAHAYVPLDEALSRVVLDISGRPGLEFNVEFTRARIGEFDVDLVSEFFQGFVNHAAITLHIDNLRGKNAHHQAETIFKAFGRALRAAVELDPRMVGIMPSTKGSL

SEQ ID NO: 16231 - protein, 66 aa, Triticum timopheevii
EEDLKQMRNWTKEEFVHILRRQSTGFARGSSKYRGVTLHKCGRWEARMGQLLGKKYIYLGLFDSEV

SEQ ID NO: 16232 - protein, 160 aa, Mycoplasma penetrans
MIKKIYLAGGCFWGIEQYYNLNQKIISTNVGYLNSKIDNPTYKDVCNNITDAVEAVELTYDDQVISLNEIIDLLFKVIDPTSINKQGNDIGRQYRTGIYSRDSNELMAIQEKINELQNNYSKLIQTEVMLVDNYYLAEEYHQKYLEKNPNGYCHINLKAK

SEQ ID NO: 16233 - protein, 590 aa, Unknown
  Azoarcus sp. EbN1
MCGIAGEIRFDGQSPDVGALERMNARQRVRGPDSGGVFVQGALGFGHRRLKIIDLSESAQQPMFDPALGLGIVFNGAIYNHAALRRELETLGYRFYSRGDTEVLLKAYHAWGQDFVQRLNGMFAFAIWERDSGRVVLGRDRLGIKPLYYSAQPGLLRFASSLPALVAAGGVDTTVDAVALNHYLSFHAVVPAPHTILAGVRKLPPATLMTIHTDGRRSERSYWSLAYAHEPGDAARSFEEWTEILLEGLRSAVGRRLVADVPVGALLSGGVDSSLIVGLMAQAGVQGLRTYNVGFEDVGGEKGNEFEYADIVAERFATIHERIFVPEAQLLARLPEAVAAMSEPMVSHDCIGFFLLSEAVSRHSKVVQSGQGADEVFGGYHWYPKLAGSVDPVGDYLAAFRDRDYDEYCRMVGAANRADDCSGAFVAAHFDLPGAIDPVDKALRLDTTVMLVDDPVKRVDNMTMAFGLEARVPFLDHELVELAARIPARHKLAHGGKGVLKEAARQVIPSAVIDRPKGYFPVPGLKYLQGQVLERVRDALTNRAARERGLFRREYVDTLLADPGAHMTPLRGSKLWQLGLLEWWLQTHVR

SEQ ID NO: 16234 - protein, 231 aa, Oryza sativa
MAGGGDELKLLGMWASPYVLRVKLALSLKGLSYDYVEEDLMNKSDLLLSSNPVNKKVPVLIHNGKPICESQIILQYLDEAFPGAGATLLPADPHERAVARFWAAFNDDTLLAASQAASWGKTEEERAEGEKKVVEALERMEVGLRECSKGKPFFGGDTVGYLDVVLGGFLAWVRATDVMRGVKRFDPATTPLLAAWAERFVELDAAKAVMPDMDKMIEFGKVLQARAAATN

SEQ ID NO: 16235 - protein, 287 aa, Unknown
  Synechococcus sp. WH 7805
MSEAPSTACDWIDEHHNGVRYGLQGKVIVDEQSTIQRITVIHSNRYGNGLLLDGCWMTAEHQERHYHEPLVHPALCAANAIDRILVIGGGDGGTARECLRHKEVKHVDLVEIDGRVVELSQKYLGAIGGGCWSDTRFQLTVGDGIAWVSQASDASYDVVLVDGSDPAGPAEGLFNRSFFQHCRRILKPGGVFATQSESPEAFRDVHIETVRMLREVFGYADPLYGWVPMYPSGWWSWTFAASDGPRYRNPDPIRAAAICDGCDIWSPRWQEGAFDAIPAGIERELSA

SEQ ID NO: 16236 - protein, 128 aa, Burkholderia xenovorans
MRLLHTMLRVGDLDRSIAFYTELLGMKLLRRDDYPDGKFTLAFVGYEDERDGTVLELTHNWDTPSYDLGTGFGHLAVEVDDAYAACDRIKAQGGTVVREAGPMKHGTTVIAFVTDPDGYKIEFIQKKK

SEQ ID NO: 16237 - protein, 231 aa, Oryza sativa
MAGEGDDQLKLLGLWVSPYTHRVKLALSFKGLSYEYVEEDLSNKSELLLSTNPVHKKVPVLIHNGKPICESQVIVQYLDEEFPNSGVSLLPSDSYDRAIARFWAAYINDKLMPSWLQSSMGKTEEERAEALKQTLEAVANLETAFKECSKGKPFFGGDTVGYLDVSLSAMIGWMRAGEALHGRRTFDATRSPLLNAWMERFAALDAAKAAMPDNNKLVEFVRVRRAAAANN

SEQ ID NO: 16238 - protein, 586 aa, Caulobacter crescentus
MWRARRGELSNCCVSSHRRLARGRVRRLRRRHRRLVAAQWAVRLHAALAGRDGLRGWPAGGAFAQWQGVRGRRRQRLGARRATGVRLASGRLHPGHEHRGRGPFRSGGRGDPRHGRASRLGQRACAARGASWLSQCGFPGPTWGMVAQPSGRACGAGQQRPPRGGRRGAVMNTTITGGRRQAALGFIFVTAILDVLSLGVMIPVLPNLVKAFGGGDTAAAADWNVLFATTWGVMQFICSPILGLLSDRFGRRPVILTSIFGLGIDFLFMAFAPNLWWLFIGRIFNGMTAASFSTASAYVADVTTPENRAKGFGLMGAAFGIGFTFGPALGGWLWEFDHRAPFLVCAALALTNWLYGFFVLPESLPPERRQPRFDWKKANPIGSLQLLRHHPGLMGLAGVGFLFQLAHNVLPSVFVLYMGFRYGWSPQTIGLTLMASGIASILIQAFVVGPAVKRLGERGVLLIGLFAGFLGFSIYALAPTSLLYLAGLPIFAFSGLIQPGLQGLMTRRVGPNEQGQLQGANAAMMGIASIIGPPLFLIPFAFAVRHDATLHLPGLPILIAAVLMLAATLLAYAKAKPAPAPEPQPA

SEQ ID NO: 16239 - protein, 425 aa, Trichodesmium erythraeum
MINANFLADTDPLVAEIIQKEYGRQQDHLELIASENFTSPAVMAAQGSVLTNKYAEGLPSKRYYGGCEFIDEVEQIAIDRAKQLFGAAHANVQPHAGAQANLAVFLTLLKPGDTIMGMDLSHGGHLTHGSPVNISGKWFKAHHYGVNKETEAIDYDQVLELAKKHKPKLLICGYSAYSQIINFEKFRAIADEVGAYLLADIAHIAGLVATGHHPNPVPHCDVVTTTTHKTLRGPRGGLILTRDSELGKKLDKSVFPGTQGGPLEHVIAAKAVAFGEALKPEFKTYSGQVIENAAALATQLQERKLKIVSGGTENHVMLVDLRSVSMTGKKADKLMSGVNITANKNTVPFDPESPFVTSGLRLGSPAMTSRGMKATEFIEIGDIIAERLQNPEDEGIAQKCRERVASLCKAFPLYPHMMAKVPSLV

SEQ ID NO: 16240 - protein, 420 aa, Agrobacterium tumefaciens
MSEKRVQPLARDAMAYVLAGGRGSRLKELTDRRAKPAVYFGGKARIIDFALSNALNSGIRRIGVATQYKAHSLIRHLQRGWDFFRPERNESFDILPASQRVSETQWYEGTADAVYQNIDIIEPYAPEYMVILAGDHIYKMDYEYMLQQHVDSGADVTIGCLEVPRMEATGFGVMHVNEKDEIIDFIEKPADPPGIPGNEGFALASMGIYVFHTKFLMEAVRRDAADPTSSRDFGKDIIPYIVEHGKAVAHRFADSCVRSDFEHEPYWRDVGTIDAYWQANIDLTDVVPDLDIYDKSWPIWTYAEITPPAKFVHDDEDRRGSAVSSVVSGDCIISGAALNRSLLFTGVRANSYSRLENAVVLPSVKIGRHAQLSNVVIDHGVVIPEGLIVGEDPELDAKRFRRTESGICLITQSMIDKLDL

SEQ ID NO: 16241 - protein, 241 aa, Oryza sativa
MAGGDELKLLGAFPSAYVTRVELALGFKGLSYEYVKEDLANKSELLLSSNPVHKKVPVLIHNGKPISESQVILEYIDEAFTGASLLTRDPYERAVARFWVAYIDDKLKVTIFWNGGVHYIMVPNDTRKDEGGEGGGVEADVRGGRALKDSSKGKPFFGGDTVGLVDITLGSLIAWMKATEVLTGAKIFDPAKTPLLAAWTERFAELDTTKKVLPDVAGYVEYVNKRRQTQAATAAVVASNS

SEQ ID NO: 16242 - protein, 367 aa, Unknown
  uncultured marine gamma proteobacterium EBAC20E09
MSKRDYYETLEVSRDASASELKKAFKKKAMKFHPDRNPDNPEAAEKFKEAAEAYDVLSDPQKKSAYDQFGHSGVEGMGGGGPNFNDININDIFGDIFGDVFGTRSQSRRQRRGSDLQYNLELSLKDAVLGVQKKIKIPSHRECPDCLGSGAAKGTKPVTCMNCNGTGQVRMQQGFFSIQQTCSVCSGTGQVIKEKCGTCGGVGAIKENKTLSVNIPAGVDNGDKVRLSGEGEWMKGGRSGDLYVAIRVKDNPLFERDGRHLYIEAPIPFDVSILGGSIKIPTLEKTISLKIPSNTQTGKVFRIKGEGASIVRNKRRGDILCRVIVETPSNLDKAQLKALSELTKKLEPSKNYPGTDIFLKAISKNKE

SEQ ID NO: 16243 - protein, 235 aa, Oryza sativa
MAGAGDELKLLGMWTSPFALRVKLALSFKGLSYEYAEEDLSNKSELLLSSNPVHKKVPVLIHNGKPICESQVIVQYIDEAFPGAGVPLLPSDPYERAVARFWAAYIDDKLLKSWLQASMGKTEEEKAEALKETFAAVANLEAAFEGCSKGKPFFGGDAVGYLDVTLGALVSWVHAGEALYGMRLFDATRSPLLDAWVDRFAALDAAKAALPDAGRLAEYAKKRQAERAAGEAANN

SEQ ID NO: 16244 - protein, 492 aa, Ustilago maydis
MSSQAVADIGLIGLAVMGQNLILNMNDKGFTVCAYNRTTSKVDDFLANEAKGTNVVGAKSIEEFVAKLKRPRKMILLVKAGPAVDAFIEQLLPHLEQGDIVIDGGNSHYPDSIRRCKELEAKGILFVGSGVSGGEEGARHGPSLMPGGSDAAWPHIKEIFQKTAAQSDGEPCCDWVGQTGAGHYVKMVHNGIEYGDMQLICEAYDILKHGLGLKEGEIGDIFTKWNTGVLDSFLIEITRDILKYNDEDGAPLLTKIMDSAGQKGTGKWTAINALDLGQPVTLIGEAVFARCLSSLKGERTRASKILGGPQIKPFEGNKEQFIADLEQALYASKIVSYAQGFMLMREAAKEYDWKLNNPSIALMWRGGCIIRSVFLKDITAAFRKNPELENLLFDDFFNKAIHNAQEGWRRVVAQAILWGIPTPAFSTALAFFDGYRRELLPANLLQAQRDYFGAHTFRVLPQFASEKLPEGQDIHINWTGRGGNVSASTYQA

SEQ ID NO: 16245 - protein, 309 aa, Xanthomonas campestris
MSGWTLADLPSQRGRVAIVTGASPGGLGYETALALAGAGAHVVLTARNPDRGEAARWALLARHSEAEVRVEALDLASLASVRAFAKRLTTRHAAVDLLINNAGVMAPPQRQTTADGMELQLGSNYLGHFALTAQVLPLLRAASAPRVVNLSSLAHRQARIDFDDLQSERPYRPWKAYGQSKLAMLMFSLELQRRSNTHGWGVRAIAAHPGIARTALIANGPDGAGRRSASGVATGLFTRCIGHSASAGARPTLYAATSPQAQAGGYYGPNGLFELKGDPAPAKIAHQAHDQQVAARLWDTACALTGVAF

SEQ ID NO: 16246 - protein, 153 aa, Bacillus cereus
MANYIKELREKVGHDYVFLNFAGGCVFNKEGEVLLQKRGDFNAWGFPGGAMEIGESAAETAIREIKEETGYDVEINELIGVYTKYFQSYPNGDKAQSIVMCFSCSIVGGDKKVDGDETLDLKFFPLDDMPPLFCKQHEDCLQDLLEKRVGVYR

SEQ ID NO: 16247 - protein, 105 aa, Rhodopirellula baltica
MILIQAIIQPTKLSNVQSALDEAGFSDTIVGDALGYGRQRGQTALFRGNEYKIDLLRKVTFEMVIDDDDLEPVVEIIRNASRTGTEGQIGDGKIFVLPVANVIDI

SEQ ID NO: 16248 - protein, 2136 aa, Oryza sativa
MTTGSSRGTGNETNYVMQKFARAVLNTNNVDCCARVCHGPSVAGLQETLGNGAMSNSINDIENSKCLLVFGYNCADSHPIVARRVLKARENGAKIIVCDPRRIETARIADQHLQLKNGSNMALVNAFGYVLLEEELYDKNYVARFTEGLEAYRQTVKEYAPERVEHLTGISASDVRQAMRTFAAAPSATVMWGMGVTQFGQAVDVVKGLSSLALLTGNLGRPAVGVGPVRGQNNVQGACDMGVLPNMFPGYQDVTDPAVRQKFADAWGIDVNKMDDRVGTRITEVPHLALEGKVKAYYIMGEDPLQTEADLGLVRSGFDALDFVVVQDIFMTKTAEVADVLLPATSWGEHGGVFTCADRGFQRFGQAIQASGNVKRDWEIISLLATEMGYPMHYDDNQQIWDEMRALCPLFYGVTYEKMGEMGHVQWPCPTLDHPGTPYLYKDNQFDTPTGKGQLFAAPWRAPAETPDDDYPLVLCTVREVGHYSCRSMTGNCAALQSLADEPGRVQMHPADADKLGIRDGQLVWVRSRRGKVITRASISERINAGAVYMTYQWWIGACNELTQDNLDPVSKTPETKYCAVTLEAIEDQRWAEDFAASSYQTMKTRLINAVNVLSEARTRSFQHACRGLTHRNRNVRGRTAVHVIIRSRIRIGSAEYLNISGVGAKSDSEAPGTSAEDQSSQDPIKELELGMLQEDIITQGLFRLKYLSIGGFTLYSEQGIARMVDLLTLPNFNVRLQDDGRCSNILILQQILDVTHRQLNIKCLENVVFSEEAKQLELDRMRQFHSLGFEWSLSGMVSSVKQRAVLGNLRPHRNLQSLSIKGYICTEFPDWINKINDTLPDLVKLVFSDINGCNYIPISQLPNLKELEINNMPRLNKIYGTLPNLVKLILSHIERCDHIPVLGNLPNLQELEIYNMPQLHDARIGPCNKLRRLTLVGLPNEATVHLFYDICTHTEVQMVESSHGCDEEMTETVQEFNTLPGCSFRKNEVRRSEELSRGPSTEKGKVKNWFDALLLSIGGARAKKTLASALSHISLVPEESQLSPKLSHGCLEVTSAALPELDYLQIGSCHDLKLHPTPPKSKEYFVKDSSLSLPVDKEDTSSFPSRPYDQYTEGCSHSGQGTAIPPHEHAMQKSIPRLKSKLHIEGSRDQLRQWTELLSTHLDELTITDPLFYDSKYLEEESTVSEHDSLESIYGLPQSCIANLEKINLPPSHQYGLEECSNYDNIVDFVGRIDSQVPYINIGKRDGMDTVCSHRQQLPSGRRSGDQAEERVRRGLATAGGRTAREQACDKKAEEWLTLANEQAGRGAARAPSRRAASAAEERKHAGDKQAEECSRVGGEQAKERQPAAGFHPVYQVHCIMVGTFSVKPIEEGGIFCSSNIPLLYKHYDGQSSSLVIKNLENLKGSLGEVQELAKYQQVRLVWSRSNFIEDSSMAEDKAVLQKLRPHHDLETIEIEGYRGDEFCYWMMNINSSLPNLVTVKLSNIANCQCLPPLGQLANLEVLRISDMPSVRKVDGHVYGTEKPFRKLRELELSTMKNLEEWSTTTLLLTGHNDHQLSRSEEVFPNLQVLLIANCPRMRFVPGFPRSRECTLEKSCSILLSFEQFIGSSNLALIALKINDSGSSSDIVKFLQGCVNLLYLTIDSCIDLITLPEPIKNCHCLRKLEITNCWNFSVLPEWLGEVTFLQKLDIQASKLEYLPQSIQRLTALERLVLNKCNYKLRERCTSGEDKEKIKHIKTIDMNENLIELSLSGLKFGHLHIDQLQNLRELKVSGVEFQHLHLERLQNITELKLSEKRFERLHIDQLQNLKELKFSSVEFGHLHLERLQSITKLELCKKQFEHLHLVQLENLRQLYLFTVKFECVVLHQLQNLEELHLSQIESQKSNKPVCIECSQPLRKLQKIVMTKIINKGLQISVQGGEGDKNLFPGLQHLEMELCENLRFQPSIPRSTHYIISGEIYFDKFNYRRILGSFLFPSFKQVMGTSIPGSTSRMEIKNTSGLSSERWKSIPHLELLNITELTIDKCVDSCPVPKCILGWKSLQKLEIRRCEDIELLPEWLGEMSCLTELIVETYWMEALHPCIRRLTNLQSLTLITCLNRFKERCKSGDDWINIKHIPHIQITDRNGRTEIISPSCT

SEQ ID NO: 16249 - protein, 554 aa, Escherichia coli
MCSIFGVFDIKTDAVELRKKALELSRLMRHRGPDWSGIYASDKAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDFDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFESYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 16250 - protein, 553 aa, Alkalilimnicola ehrlichei
MSDSAVPRLTESAAWQALGARAGDLRGWRPPLKGTQGEQRFRRFSLQLDGLFFDYARQPVDETTRDLLLELARERRLPERIRALFAGEPVNATEGRPALHTLLRAPEGSAFPVHGADARAAVRTELARMTRFVDRVHRGLVHGWDDRPFTDVVNLGIGGSELGAAMAVQALSRFHQREAPRMHFASGSDGVQLEDLIRRLDPATTLFIVASKSFTTSETLLNARAALHWLEACAPEGAHLARHWVGVSANEEGMARFGIPEEQRFRIWDWVGGRYSVASAMGLPVALAVGMRHFQDFLAGMHAMDRHFEEAPLPVNLPVIAGLLQVWSINFLGAHTHCVLPYHQRLARLPAWLQQLEMESLGKRVDSGGRPVDYHTGAVVFGETGFHAQHSFAQLLFQGSCPVAVDFLISREDASGLAVFHGVAQAQALGQGRALMTGRDRATLAGEMIRAGVDEEQRQALLAHREIPGGRPSNTLVFPRLDPYNLGRLIAFYEHRTFVQASIWDINPFDQWGVELGKQLTRALLPAVTGETDPAADLDASSCGLIRILRGAD

SEQ ID NO: 16251 - protein, 236 aa, Oryza sativa
MKGEFVPPWLELLLSTQFFNTCTSHHNSPRNECNLFCIDCQAPEAAFCYYCRSCHHSSHRVIQIRRSSYHDVVKVSELEDILDISDVQTYVINSARVVFLNERPQLRGCGVLAIKSSPSSLSSYNCETCSRVLLDAFRFCSLGCNLIGIKNDVETVVANDGIAHNDKDIEIDGSNGTANTNGTGKGIEICGNNGTIANTGNEDEICSDASKNKEILSSTRVVRHRRKGIPRRAPFF

SEQ ID NO: 16252 - protein, 162 aa, Unknown
  Azoarcus sp. EbN1
MSVPANVFDFETRRLNGAPMPLAEFRGKVLLLVNTASECGFTPQYEALQELHDRFAPRGFSVIGFPCNQFGGQEPGGAEEIAAFCAKNYGVSFPLSEKIDVNGDNAHPLYRHLTSVAPGILGTEAIKWNFTKFLVDRDGQVVARFAPATKPESIARDIEALL

SEQ ID NO: 16253 - protein, 470 aa, Myxococcus xanthus
MSTTTPPGQSALPPEAWAPLLRLSRLAGRPLERFLHIEAASGILLLVAAAIALLWANSPWAESYAHFWHTPLGIRVGDFTFERSLEWVVNDGLMAIFFFVVGMEIRREVHQGELSELRRAALPAAAALGGMLVPAGLYLLLADTPDTRSGWGVPMATDIAFAVGILTLLGSRVPPALRVLLLALAVIDDLGAIIVIAVFYSSGVAITGLLVAALGIVGVFAMQRFGVRSKWAYIVPAFVAWAGVYSAGIHPTIAGVIIGLITPVRTWLGPEGFVTGARTELEHIAQAQPGELSSHHLSETLRRVDAARREAMSPSESLIATLHPWVAFGIMPVFALANAGVPISSEPLDAASWTVALATATGLLVGKPLGVIGACWLALRLRLATLPKGLGMRELLVLGSTAGIGFTMALFIAQLAFTETKLLAAGKLGVLAASGAAAVVALVLGRWLLTTSARPGAARSVDEAERSTAL

SEQ ID NO: 16254 - protein, 303 aa, Methylobacillus flagellatus
MKLAIIGLGKMGGNMARRLLKHGIEVVGFDFNQDAVNQISLTNGMIPASSVEDAVSKLSGEPRKIVWIMLPSGDITENQIKDLVPLLSKGDIIVDGGNSNYKHSQRRGAWLAEHGIEFIDCGTSGGIWGLDNGYCLMYGGSKDAADAVVPIMQALAHADRGWAHVGPVGSGHFTKMIHNGIEYGMMQAFAEGLDLLKGKEEFNLDLAQITELWRHGSVVRSWLLDLTAEALAHDQELSAIAPYVADSGEGRWTVVEAVDQGVAAPVLTLALQMRFASQEDTGYSYKLLSMMRNAFGGHAVKTK

SEQ ID NO: 16255 - protein, 409 aa, Myxococcus xanthus
MSKVLAMILAGGAGTRLEPLTRERAKPAVPFGGRYRIIDFVLSNFANSGVYRMKVLTQYKSDSLNNHLSRAWRMTAFLGHYVEAVPAQMRTGLDWYKGSADAIYQNLNIITDEEPDYIFVFGADHVYRMDTRQMLDFHCTKKAACTVAAIPVPIEQGREFGIIDVGPDGRMRQFLEKPKDPPPMPGNPKMCLASMGNYLFSTDVLVQEVVRDAANEASAHDFGKSIISELYKRAPVYVYDFAQNEVPGQEAKERGYWRDVGNIDVYYQSNMDLVEVDPTFNLYNDRWPIHTQPNNYPPAKFVFADEQNHRVGHAMDTLVAEGCIISGGSVRRSVLSPKVRVNSYSEVEDSLLFENVTIGRRCRIRRAIIDKNVEIPPGMTIGFDPVEDRRRFHVTPGGVVVIPKGMKVT

SEQ ID NO: 16256 - protein, 277 aa, Unknown
  uncultured marine gamma proteobacterium EBAC20E09
MDQYIYDTRKQISIINLELTQECLSAAASKVEDICSKGNKILFVGTKRSASKTIKEEASNIGLPYIDKRWLGGTLTNWKTIRGSIRRLLDIEEMISSGRINKLIKKEAVEIQKEHAKLEASVGGIKDMKGLPDAIFVIDVKYEKIAVLEAKKMGIPIIALVDTNSDPDGIDMIIPGNDDAIRSIRLITKVISDACARGIESAQGFVPKSDSPIIKKVKKEDVQKLDEVMEAPVEETQESDKAEEVLTEEAQKSNKTEESSIDEVDENTTSEDKKEEK

SEQ ID NO: 16257 - protein, 82 aa, Zea mays
  misc_feature (14)..(14): Xaa can be any naturally occurring amino acid
  misc_feature (21)..(21): Xaa can be any naturally occurring amino acid
  misc_feature (47)..(47): Xaa can be any naturally occurring amino acid
MSSWPRMDYATGHXERNLPAXLYCLTRLCLSSKPYYPAGTMGVLTAXLGLMRTLKDTYQLEPASSHASWGLDDNHCLGLIFR

SEQ ID NO: 16258 - protein, 306 aa, Unknown
  Synechococcus sp. WH 7805
MGWTIEDMPDQQGRVALVTGANSGLGLETTRALIGRGCTVLMGCRSARKGEAARALLLEAGGSGLDLFELDLSDLTSVARCARDVADRYGRLDLLINNAGLMAPPRMLSQQGHEMQFAVNHLGHFALTQALLPLMNNRPQARVVTVTSGAQYFGAMAWDDLQGEQRYDRWKAYSQSKLANVMFALELNQRLQASGSAVRSLAAHPGLARTNLQPVSVAATGAWQEALAYRLMDPLFQSAAQGALPQLYAATASAAGGGEHYGPGQLGGMRGAPKQQPVARAAKDQHQRQRLWTVSESLTEHHSAAV

SEQ ID NO: 16259 - protein, 708 aa, Oryza sativa
MVLLLLLLLALPAAAGGLAADGQALLAFKAAVLRDPEGALADWDASTAADPCAWNGVSCGAGSGAGGADRRVVALSLPRKGLVGSLPASPLPASLRHLNLRSNRLFGELPAPLLSAAAGLQSVVLYGNELYGPIPPELGDLPYLQILDLSSNSLNGTLPPAILRCRRLRSLALGWNNLTGALPQGFARGLSALEHLDLSHNHFSGAVPEDIGNLSRLEGTVDLSHNQFSGQIPASLGRLPEKVYIDLTYNNLSGPIPQNGALENRGPTAFVGNPGLCGPPLKNPCSPDAMPSSNPFVPKDGGSGAPGAGKNKGLGKVAIVAIVLSDVVGILIIALVFFYCYWRAVSSKEKGNGGAAGSKGSRCGKDCGCFSRDESATPSEHTEQYDLVPLDQQVRFDLDELLKASAFVLGKSGIGIVYKVVLEDGLTMAVRRLGEGGLQRFKEFQTEVEAIGKVRHPSIVTLRAYYWSYDEKLLIYDYIPNGSLSAAIHGKPGTMTFTPLPWDGRLKIMQGVAKGLSFLHEFSPKKYVHGDLRPNNVLLGSNMEPYISDFGLGRLANIAGGSPFTQSDHAGIEKAQSQQSDASVSPLVGKRSCYQAPEALKTLKPSQKWDVFSYGVILLEMITGRSPVVLLETMQMDLVQWVQFCIEEKKPSADVLDPSLARDSEREDEMIAALKVALACVQANPERRPSMRHVAEIPGSPQWFRLEK

SEQ ID NO: 16260 - protein, 624 aa, Bordetella parapertussis
MCGVAGLIHLDGAAVDPAVLQGMTDAIAHRGPDGEGHWIDGNVGLGHRRLAIIDLSPAGHQPMISADSRYVLSYNGEIYNFRELRAELETAGYRFKSRTDSEVLLYAVIAWGLKALKRFNGMFAFALWDCHERRLILARDRYGIKPLYYAEQGGTLAFGSEQKAILALPGFRRKLDKAALLEYFTFQNIFTSKVLLEDIQILPAGHYAIVEPDRCASISLTQYWDFCFREPDVAATDQEYREELDRLFVQAVKRQLVTDVELGSYLSGGMDSGSIAAVAAAEHPYIKTFTCGFDLNSASGIELGFDERSKAEYMSYCFKTEHYEMVLKAGDMERILPHVACHLEEPRVGQSYPNFFAAKLASRFVKVVLSGAGGDELFAGYPWRYYRAVVNDDFEHYVDKYYNFWQRLLPNSELKRVFAPIAGEVEHVWTRDIFRNVFRHHADQLYRPEDYINHSLYFEAKTFLHGLLVVEDKLSMAHGLETRVPFLDNDLVEFAMRCPIRLKLNNLAEVVKINENETGNKVRKFFEKNRDGKTILREVMNHRLPADISKAEKQGFSAPDASWFKGESLEFVRRKLLDGHSPLYEIMDAATVRELVNEHLGGIRNRRLLIWSLLSVDAWMRQTF

SEQ ID NO: 16261 - protein, 180 aa, Rhizobium gallicum
EFDAFPALEQLPLWGFDGSSTMQAEGRSSDCVLKPVAVYPDPARSNGALVMCEVMMPDGVTPHPSNSRATILDDEDAWFGFEQEYFFYENGRPLGFPEQGYPAPQGPYYTGVGYKNVGSVAREIVEEHLDLCLAAGINHEGINAEVAKGQWEFQIFGKGSKRAADQIWMARYLLLRLCEK

SEQ ID NO: 16262 - protein, 493 aa, Clostridium thermocellum
MADGKGKVYLVGAGPGDEELLTVKAADVIKKADVIVYDRLISDGILSKIPDNAEKIYVGKNAGNHPVPQHEINKILLAKALEAKIVVRLKGGDPFVFGRGGEELEFLHQNGIPFEVVPGITSAIAAAAYAGIPVTHRDFCSSLHIITGHVKDGGNPDIDYESLVKLKGTLIFMMSVASFPQIAQGLIEAGMESDMDAAVIENGTMPNQRKFVSKLCDIPKVIAENQVKSPAIIIVGKVCSLSEKLDWFSKLPLYGCNVLVTGPKKTSERLAGKLRGLGAHVVEYPCIETEPLDFDIDIREHSWIIFTSSLGVTIFFKKLYENKLDSRYLYNKKIAAVGSQTAEELLKHGICADFVPGKFDGRHLAEELLQSGKISPEDKVVIFRAKDGTQAIVDIFENNNIHYTDISVYETKCIENERIDISGFNYITFTSESCVKGFAHSFKNTIDYSKINAICIGEQTAKATRAYGMNTIISDVATVSSMVEKIIEMHCAK

SEQ ID NO: 16263 - protein, 238 aa, Oryza sativa
MAGGGGAGELKLLGHWASSYVTRVKLALHLKGVSYEYVEEDLRNKSDLLLASNPVHKTVPVLIHNGNPIRESQIIVQYIDEAFSGAGDSLLPADPHERAVARFWAAYIEDKLVAPWEKVFRAKTEEERAAWMKQMFVAVEALEGGLKECSKGKGCFFGGDSVGYVDVVLGGGVSFVHANDVITGGKLFDAAKTPLLAEWLGRFGELDAAKAVLQDVDRAVEYTKVLYARNAATNAANN

SEQ ID NO: 16264 - protein, 449 aa, Myxococcus xanthus
MAQTPPTSEARPRPPVPTLFRVALAPIQAFFRLEAASGILLALCAVAAMVWANSPWAATYSAVFDARMTVGLAGVHAGFTIREFINDGLMTLFFFVVGMEIKRELSSGELRTFSRAVLPLIAAMGGMIVPAALYAAFNQGTPAQAGWAIPMATDIAFSIGCLTLVKTRVSHGLVVFLTALAIFDDIGGILVIALFYGSGLHVSWLVGALGVLAVLACLNHFQVRNGVAYALAGAALWYTMHHGGIHATLSGVVLGLFMPARPLRPGRHVLEELRLYVDRALQTAMDEATRGAQILYLEERLEELEPPLNRFVHLWHVPVAYGIVPLFALANSGISLEGMGWADLLRPLPLGIIAGLFVGKQVGIFLFTWGSLKLGVADRPGGATLPQLHGVAVVAGIGFTVALFVAGLAFPTQPELLTEAKLGILVGSLLSAVVGYALLRFVAKPAVPA

SEQ ID NO: 16265 - protein, 180 aa, Rhizobium etli
EFDAFPTLEQLPLWGFDGSSTMQAEGRSSDCVLKPVAIYPDPARTNGVLVMCEVMMPDGVTPHPSNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEK

SEQ ID NO: 16266 - protein, 237 aa, Oryza sativa
MAAEDELKLLGFWASPYVCRVKLALHLKGLIYDYVEEDVFTNKSELLLSCNPVHAKVPVLIHNGKPICESQVIVQYIDEVFPDAGVTLLPADPHDRAAARFWAAYIDDKLLPPWVHAYRGKTDEEKAERMKQTLAVVDALETAMEECSKGNAFFGGDTVGYVDVALGGLLSWLHGTEELCGTKILDAAKTPLLSAWARRFGELDAANAALPDVGRLVEFCKMRHVELEAAEAAAARN

SEQ ID NO: 16267 - protein, 234 aa, Oryza sativa
MAGGGDELKLLATWFSPFASRVKFVFHLKGLSYENIEEDLKNKSDLLLKSNPVIKKVPVLLHNGKPLCESMVIVEYLDETFAAVGPSVVPADPYERAVARFWVSYIDNKLVAPWFQVFRGKTKEEKAEGLKQMFEATAVMEVAFRECSKGRPFFGGDAVGIVDVALGSQLGWLRASETLSGIKLFDPAKTPLLLAWAERFLALDAAKASMPESGRLLAYAKMRQAETDAANASK

SEQ ID NO: 16268 - protein, 356 aa, Hordeum vulgare
MALLTDLLNLDLSGSTEKIIAEYIWIGGSGMDLRSKARHLPGPVTHPSKLPKWNYDGSSTGQAPGEDSEVILYPQAILKDPFREGNNILVMCDCYTPRGEPIPTNKRYNAAKILSNPDVAKEEPWYGIEQEYTLLQKDINWPLGWPVGGFPGPQGPYYCGIGADKSFGRDIVDSHYKACLFGGVNISGINGEVMPGQWEFQVGPTVGISAGDQVWVARYILERITEIAGVVVTFDPKPIPGDWNGAGAHTNYSTESMRNDGGFKVIVDAVEKLKLKHKEHIAAYGEGNERRLTGKHETADINTSSWGVANRGASVRVGRETEQNGKGYFEDRRPASNMDPYVVTSMIAQTTILWKP

SEQ ID NO: 16269 - protein, 230 aa, Oryza sativa
MAGRNNHELKLLGTWPSPFVVRVRLALGLKGLSYEYVEQDIRDKSELLVVSNPVHKKVPVLIHGGKPVCESQIIVQYIDEAFPGAGASLLPSDPHERAVARFWATYIDDEFATKFRAMGEAKEEEEKDEAAAQVFAALETLEEAMKGKVFFGGDSAGYVDVALGGFLGWIKAAEALAGVAFLDGARTPLLAAWAARFSALEAAKEAIPSVERLREFHVAMHAAAATVAGN

SEQ ID NO: 16270 - protein, 180 aa, Rhizobium gallicum
EFDAFPALEQLPLWGFDGSSTMQAEGRSSDCVLKPVAVYPDPARTNGALVMCEVMMPDGVTPHPSNSRATILDDEDAWFGFEQEYFFYENGRPLGFPEQGYPAPQGPYYTGVGYKNVGSVAREIVEEHLDLCLAAGINHEGINAEVAKGQWEFQIFGKGFKRAADQIWMARYLLLRLCEK

SEQ ID NO: 16271 - protein, 90 aa, Unknown
  Synechocystis sp. PCC 9413
  misc_feature (6)..(7): Xaa can be any naturally occurring amino acid
KKVEAXXRPFKLDEVKIALVNSGVVGMTVSEVRGFGRQKGQTERYRGSEYTVEFLQKLKVEIVVEDNQVDMVIDKIIAAARTGEIGDGKN

SEQ ID NO: 16272 - protein, 264 aa, Oryza sativa
MAGKDDDVKVLGVVVSPFAIRVRIALNIKGVSYEYVEEDIFNKSELLLTSNPVHKKVPVLIHGGKPISESLVIVQYVDEVWAAAPSVLPADPYDRAVARFWAAYVDNNVSTVLYTVLAMAMSPKLFDEQLLVISLVVLQMFPGMAGVLFAATEEERAAKAEETLAALAQLEKAFAECAGGKAFFGGDSIGYVDLVLGSNLHWFEALRRLFGVALLDAGKTPLLAAWAKRFVEAEAAKGVVPDAGVAVELGKKLQARAAAASTAA

SEQ ID NO: 16273 - protein, 352 aa, Streptococcus pneumoniae
MNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEF

SEQ ID NO: 16274 - protein, 242 aa, Oryza sativa
MAEELKLLGSLSGVSPYVIRAQMALAVKGLAHDYLPEDLTRKSKLLLDSNPVHKSVPVLIHNGKPVCDSLVIVEYVDEAFPGGAAALLPADPYHRAVARFWAAFIDSKVFPPCLAILKTAAAEAEEKAAKVKETVEALQLVEGAFGECSKRKPFFGGDAVGYLDVVLGCYLCWFEGVSEIAGGVSPPLLDASRTPQLAAWAARFRSAADAVGCSVPRVDKVEAYLNNVLKPKWSAAAAASSH

SEQ ID NO: 16275 - protein, 209 aa, Oryza sativa
  misc_feature (107)..(107): Xaa can be any naturally occurring amino acid
  misc_feature (123)..(123): Xaa can be any naturally occurring amino acid
MGRRPARCYRQIKNKPYPKSRYCRGVPDPKIRIYDVGMKKKGVDEFSHCVHLVSWEKENVTSEALEAARIACNKYMTKSAGKDAFHLRVRVHPFHVLRINKMLSCAXGADRLQTGMRGAFGKXPQGTCARVDIGQVLLSVRCKPNNAVHASEALRRAKFKFPGRQKIIESRKWGFHQVQPLRYIYPYHLWETKYRTFLFVCRLDHISLC

SEQ ID NO: 16276 - protein, 149 aa, Myxococcus xanthus
DALKNPAALLALMWHYAGDGRGHKDMVILPYKDRLLLMSRYLQQLVMESLGKETDLDGQVVNQGIAVYGNKGSTDQHAYVQQLREGVLNFFATFIEVLKDRDGGSQEVEPGVTSGDYLLGFLLGTRRALYEKDRESLTLTVPDVSARTL

SEQ ID NO: 16277 - protein, 139 aa, Oryza sativa
MAATALSSQVRLPMSLRVATAPAPARVSVLPASNKLGDRLRMQATYNVKLITPDGEVELQVPDDVYILDQAEEEGIDLPYSCRAGSCSSCAGKVVSGEIDQSDQSFLDDDQVAAGWVLTCHAYPKSDVVIETHKEDDLI

SEQ ID NO: 16278 - protein, 135 aa, Buchnera aphidicola
MNEILKILNNIRTLRVHSRECSLEILEEILEKFKVVINERKKEEKKIKEEIAQRAIKLKKYREMLIADGINPNELLTKTNSIKSSEKRKRPKRPAKYKYINKNGDFKTWTGQGRTPSVIKNAILERKKILEDFLL

SEQ ID NO: 16279 - protein, 421 aa, Ehrlichia canis
MVRYILDHNLQDIDVEVFDCISGELNRQNSQLQLIASENFVSKAVLEAQGSIFTNKYAEGYPGKRYYCGCHFADIVENIAIERLCKLFGCKFANVQPHSGSQANQGVFAALLKPGDTVVGLSLDCGGHLTHGSAPSISGKWFNAVQYQVDRNTGLLDMDEIEKLVLEHKPTLLIAGSSAYPRTIDFKRFREIADKVGAYLLADIAHYAGLIAAGEFPSPFEYAHVVTSTTHKTLRGPRGAVIMTNYEDIHKKIQSSIFPGMQGGPLMHVIAAKAVAFGEALKPDFKDYAKQIIKNSRVLVEVFKERGLNIVTDGTDSHIVLVDLRPKGVTGKDAVLALERLGIICNKNAIPFDTEKPFVTSGLRFGSAAETSRGLQESEFREIGNMVCDVIDNLKASDIVKASVEQDVIKKVKELTFAFIS

SEQ ID NO: 16280 - protein, 392 aa, Arabidopsis thaliana
MSSPEKKRKTTKKPSPTPQSTTPNPSLPDDLVVSCLARVSRLYYPTLSLVSKSFRSLIASPDLYKTRSLLGRTESCLYVCLQEKDSDPNPRWFTLCLKPNRTLTNDITEKKKKKKKKKKMSSGYVLAAIPVLHSRPAYWSGLVAVGSNIYNIGGPIDKAHSSIVSVLDCQSHTWHEGPGMRVERRYPAANVVEGKIYVTGGCKDCSNSSNWMEVFDPRTQTWESVSSPGAEIGGCSIHKSAVVEGEILIANSHGLIYKPKEGRWERMKWDMDIGWVWYSYCVVENVLYYYYKGVFKWYDTMARLWRDLKGVKGLPRFARCGGKMADYGGKMAVFWDKIVTSDDGCKNKMILCAVIALERRNSEEIWGKVEWHDAVLTVPLSYEVVYALSPTV

SEQ ID NO: 16281 - protein, 158 aa, Escherichia coli
MHCHSAFSFSNFLTSCSLSRFSFLAHRLQYLLRVAEPLPNSDRRGSMKLVTVIIKPFKLEDVREALSSIGIQGLTVTEVKGFGRQKGHAELYRGAEYSVNFLPKVKIDVAIADDQLDEVIDIVSKAAYTGKIGDGKIFVAELQRVIRIRTGEADEAAL

SEQ ID NO: 16282 - protein, 881 aa, Phaseolus vulgaris
MAASVEHRPFTSHQHGVVRSFKSYPDVPRPKKLPLPQPLSDSTNDNDEEAAVWKELVLKSSAGVEPSIFDPRDDGTSDQWIKRNASMIRLTGKHPFNAEPPLPRLMQHGFITPSPIHYVRSHGPVPHARWEDWTVEVTGLVTRPTCFTMEQLVNDFPSHEFPATLVCAGNRRKEQNMVKQSIGFNWGAGGVSTSVWRGVSLRSLLKRCGIYSRAKGALHVCFEGAEDLPGGGGSNYGTSLMREVALDPSRDIILAYMQNGELLSPDHGFPVRMIIPGFIGGRMVKWLKRIVVSNQQSQSHYHYKDNKLFPSHVDAELANEEDWWYKPEYIINEVNINSVITTPSHQEILPINSWTTQMPYSMRGYAYSGGGRKVTRVEVTLDGGETWQVCSVERLEKPNKYGKYWCWCFWSLEVEVLDILGAKEIAVRAWDEAQNTQPEKLIWNTMGMINNCWFRVKTNVCKPKKGEIGIVFEHPTQPGNQSGGWMAREKQLEKSSESNPILKKSVSSPFMNTATKSYSLSEVRRHNNRDSAWIIVNGHVYDCTRFLKDHPGGEDSILLNAGTDCTEEFEAIHSDKAKKMLEDYRIGELMTTDYTSDSSSSNNSVHGNSETTHLAPIREVALNPREKIPCKLLSKTSISHDVRLLRFALPAEDQVMGLPVGNHVFLCATVDEKLCMRAYTPTSSVDEVGFFDLVVKVYFKGVHPNFPNGGIMSQHLDSLPIGSVVDVKGPLGHIEYTGRGNFLVHGKPRFAKRLTMLAGGTGITPIYQVVQAILKDPEDRTEMYVVYANRTEDDILLKEELDEWAKKHDRLKVWYVLQANIREGWEYSVGFITESILREHVPLASPDTLALTCGPPPMIQFAVQPNLEKLGYDIQNDLLVF

SEQ ID NO: 16283 - protein, 209 aa, Zea mays
MDPSGPGPSSVVGAGGGEAPAVAPQRPAQLSRYESQKRRDWNTFLQYLRNHRPPLTLARCSGAHVIEFLRYLDQFGKTKVHAAGCAYYGQPAPPGPCPCPLRQAWGSLDALIGRLRAAYEESGGTPESNPFAARAVRIYLREVRDSQAKARGIPYEKKKRKRTQQAAAEASTSSSAAAAAGGSGSGSGRAAAASSAAQAGGSSAAPSTT

SEQ ID NO: 16284 - protein, 130 aa, Ralstonia eutropha
MMTRPRIALIAHDHKKDDIVAFATRHREFLSQCELLATGTTGGRLIDEVKLDVTRMLSGPWGGDLQIGAQLAEGRVRAVIFLRDPMTPQPHEPDINALVRACDVHNVPCATNVATADLLIAELSRVEAQP

SEQ ID NO: 16285 - protein, 645 aa, Arabidopsis thaliana
MLKTLLVQWLVFFFFFLIGSVVTAAEDDGSLSLCNCDDEDSLFSYETILNSQKVGDFLIAIAYFSIPIELVYFVSRTNVPSPYNWVVCEFIAFIVLCGMTHLLAGFTYGPHWPWVMTAVTVFKMLTGIVSFLTALSLVTLLPLLLKAKVREFMLSKKTRELDREVGIIMKQTETSLHVRMLTTKIRTSLDRHTILYTTLVELSKTLGLKNCAVWIPNEIKTEMNLTHELRPRIDDENENEHFGGYAGFSIPISESDVVRIKRSEEVNMLSPGSVLASVTSRGKSGPTVGIRVPMLRVCNFKGGTPEAIHMCYAILVCVLPLRQPQAWTYQELEIVKVVADQVAVAISHAVILEESQLMREKLAEQNRALQVARENALRANQAKAAFEQMMSDAMRCPVRSILGLLPLILQDGKLPENQTVIVDAMRRTSELLVQLVNNAGDINNGTIRAAETHYFSLHSVVKESACVARCLCMANGFGFSAEVYRALPDYVVGDDRKVFQAILHMLGVLMNRKIKGNVTFWVFPESGNSDVSERKDIQEAVWRHCYSKEYMEVRFGFEVTAEGEESSSSSSGSNLEEEEENPSLNACQNIVKYMQGNIRVVEDGLGLVKSVSVVFRFQLRRSMMSRGGGYSGETFRTSTPPSTSH

SEQ ID NO: 16286 - protein, 569 aa, Methylobacillus flagellatus
MTNLSTTTSSMESFAALFEESLARQEMRSGEVITAEVVSIDDDFVIVNAGLKSESVIPASEFRNDRGELEVNVGDFVKVCIESLEDGYGSTKLSREKAKRLAAWQELEEAMNESRIIKGMVNGRVKGGLTVMVNSIRAFLPGSLVDLRPVKDTTPFENKEWDFKVIKLDRKRNNVVVSRRAVLEETMGADREALLESLKEGAVVKGIVKNITDYGAFVDLGGIDGLLHITDLAWRRVKHPSEVLTVGEEVEAKILKFDQEKNRVSLGIKQLGDDPWVALGRRYPVGTRLFGKVTNLTDYGAFVEIEPGIEGLVHVSEMDWTNKNVHPAKIAQLGDEVEVMILEIDEDRRRLSLGMKQCQANPWDDFAATHKKGDKVSGQIKSITDFGVFIGLPGGIDGLVHLSDLSWNQPGEEAIRNFKKGDELEAVVLSIDVEKERISLGVKQLDSDPFSAYTALNDKGAIVKGTVKSIEAKGAVIALDNEVEGYLRASEVSRDKVDDISTVLKEGDEIEARITNIDRKNRSIALSIKAKDIADEADALQKFSNDAGSAGTTNLGALLKAKLDGKNNE

SEQ ID NO: 16287 - protein, 183 aa, Mycoplasma penetrans
MYQDCFAKILFSYEEIKDVIKKLSFELNAYYKSFENSDVVVIPILDSSVIFAGHLLPLLDFSTIFKTVKMTFLGHKSVSKNSNIKVIANFDPLEIKGHKILILDTIIDTGVRLQKVCDFIKNCDVEEIKTCTLFNKISDYKDKYKPDWIGTNIPNEWVAGFGLDSRDKYRNFKHLGVVKIEKR

SEQ ID NO: 16288 - protein, 283 aa, Oryza sativa
MVVGAGGGDELKLLGVWDSPYVNRVQIVLNLKGLSYEYVEEDLMNKSDLLLGSNPVHKKVPVLIHNGKPIAESRVIVEYLDEAFAAGAGGSTGASVLPSDPYERAVARFWAAYVDDKVGSPWYTILFARERGEKVEAAARAISALETVEAGAFRDHSSEGKTTNAAAAPFFGGDSIGFVDVVLGSYLGWFRVIEKMIGVRIMDAARTPRLAAWAERFEAADAVRGVLPDDVDKVIDFLQACSCTRVGVLLSTSWIALFRLLCRAGKNVPSCFVYLGPNGILSL

SEQ ID NO: 16289 - protein, 249 aa, Arabidopsis thaliana
EFYACKTIDKRVLIDALDRECIETEPRIMAMLPPHPNIIRIFDLYETEDSLAIVMELVDPPMTIYDRLISAGGRLSESESASYAKQILSALAHCHRCDVVHRDVKPDNVLVDLVSGGVKLCDFGSAVWLGGETAEGVVGTPYYVAPEVVMGRKYDEKVDIWSAGVVIYTMLAGEPPFNGETAEDIFESILRGNLRFPPKKFGSVSSEAKDLLRKMICRDVSRRFSAEDALHLVFTLTNTQVIRLDSNVY

SEQ ID NO: 16290 - protein, 157 aa, Streptomyces avermitilis
MATPDFIRTIRASAGHQLLWLPGVTAIVLDDDGRVLLGRRSDTRTWSVIGGIPDPGEQPAACAVREVYEETAVRCVVERVVLVQALEPVTYDNGDTCQYMDITFRCRAVGGEARVNDDESLEVGWFPLDALPELNEFGLLRIKQALSDGPTWFDPMT

SEQ ID NO: 16291 - protein, 236 aa, Oryza sativa
MKGEFVPPWLELLLSTQFFNTCTSHHNSPRNECNLFCIDCQAPEAAFCYYCRSCHHSSHRVIQIRRSSYHDVVKVSELEDILDISNVQTYVINSARVVFLNERPQLRGCGVLAIKSSPSSLSSYNCETCSRVLLDAFRFCSLGCNLIGIKNDVETGLANDGIAHNDKDIEIDGSNGTANTNGTGKGIEICGNNGTIANTGNEDEICSDASKNKEILSSTRVVRHRRKGIPRRAPFF

SEQ ID NO: 16292 - protein, 636 aa, Bordetella parapertussis
MCGIFGALWHQGKSVSAIEQQLQVGIARQQHRGPDGHGTWIDPQGRLGLAHVRLSIIDLVSGAQPMRGNSGNVITYNGEIYNYIELRRELGEDSFETTSDTEVILRAYEKWGERCVDRLEGMFAFAIWDAKRGEMFVARDRFGIKPFYYACVQGGFYFGSEVKALTPFLNRVETDANALHDYFAFQFCLGEKTLFAGVRQLKPAHCGYVGRDLELKQRQYWEVQYDLDWDHTEKYFVEQVREKLQHSVDMHMRSDVEVGAYISGGVDSSLVAAMARHGRRSSRFQGFTGKFALGDAFDESRYAQALADEHDILLHQVDITEDDFVNDIAKVIYHLDQPVAGPGSFPQYAVSRLAKDHVKVVLGGQGSDEMFGGYARYLIAYWEQCIKGALDGTMHDGNYIVTYESIIPNLRTLRNYKPLIQEFMAEGIFDSRDKRYYRLINRSNTFGNVVNWGMFEGIASSFDDFKQIFWGKNVGKESYFDSITHFDFKTLLPALLQVEDRMSMAHGIESRVPFLDHKLIELVATVPANVKFQNGELKRLLRVAFQDMLPQAIRERKDKMGFPVPLQVWMRKGGKAREFILDTFRSQNARSRAYLAPGFDIEKMMEQEGLFSRNIWAFLSLELWQQQFHDVHRQTI

SEQ ID NO: 16293 - protein, 318 aa, Triticum aestivum
  misc_feature (245)..(245): Xaa can be any naturally occurring amino acid
MGKASKDKRDIYYRKAKEEGWRARSAFKLMQIDQEFNIFHGVKRAVDRCAAPGSWSQVLSRNLYLPAKLSSDGKDGGLPLIVAIDLQPMAPIEGVIQVQGDITNARTAEVVIRHFDGCKADLVVCDGAPDVTGLHDMDEFVQSQLILAALTIVTHVLKVGGKFVAKIFRGKDTSLLYCQLKLFFSQVTFAKPKSSRNSSIEAFAVCENYSPPEGFKEKDLYHLLEKVGTPSGADDLDCRSGWLEXGPNKVYIPFLACGDLSGYDSDRSYPLPSTEGGTYQSLDPVQPPIAPPYKTALEMKKASSHGAGADTSKSSLDP

SEQ ID NO: 16294 - protein, 78 aa, Mesoplasma florum
MAKEAEMEFEGTVVEVLPNAKFKVQLENDIVIDAHVSGKIRMHYIRILPGDKVTVVISPYDMTRGRITYRKIAKKAEV

SEQ ID NO: 16295 - protein, 211 aa, Oryza sativa
MAGDGELKLLGMWTSAFVLRVRFVLNLKSLPYEFVEENLGDKSDLLLASNPVNKTVPVLLHAGRPVNESQVILQYIDEAWPDRPPAVLPSDPYERAVARFWAAYVDDKADAALETLEGALRECSGGKPFFGGDGVGLVDVVLGGYLGWFTAIKKLIGRRMIDPARTPALAAWEDLFRATDAARGVLPDDADKMLEFRQTALALGASKKITL

SEQ ID NO: 16296 - protein, 196 aa, Oryza sativa
MLQQRNPPFVFAQCFYVLQEVFSHPWRGIITCVNREVYASRVEIRRSSYHDVVKVSELEDILDISDVQTYVINSSRVVYLTERPQLRSCGVSNTKLSSSQTYKCEICSRTLLDDFRFCSLGCNFAAIKRDNEKNVAQNGIASNANDVKIGTNNGSTNAGSANEISSDANNYRNEIPSSTRVIRHRRKGIPRRAPFF

SEQ ID NO: 16297 - protein, 491 aa, Bifidobacterium longum
MSTTDAPKKPRETDDVPVPATLRKSLKNRHIQLIALGGAIGTGLFYGSSESIALAGPSILLAYLVGGFAIFMIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 16298 - protein, 120 aa, Archaeoglobus fulgidus
MRRLPTREVVEMKMVVAVIRPEKLECVKKALEERGFVGMTVTEVKGRGEQKGIRLQFRGREVEVDLLQKTKVEVVVSDDAVDEVVEAIVSSARTGKFGDGRIFVIPVEKSVKIRTGEEEV

SEQ ID NO: 16299 - protein, 444 aa, Oryza sativa
MEARRVSANPRPSCVRRVLARKRRRPEATANSARKLQRREISALPCRAFSASTTRERFRNIQLQEEFDTHDPKEMGSLLPYLMKRSEIIEIVGASDIIFALSQSGVCAAFSRVSNQRICFLNGRPDEVIRSLFYNKNNDSLITVSVYGSENFSALRCRTTRIEYIRRGKPDAGFPLFETESLKWPGFVEFDDVNGKVLTYSAQDSTYKVFDLKNYTLLYTISDKNVQEIKIRKKGCIPLDILSIEDGKRLKSFKHLLHRNKKVDFIEQFNEKLLIKQEGENLQILDVRNFQSIEVSRSEFVTPSAFIFLYEMQLFLTFRSRSVSVWNFRGELVTSFEDHMLWHPDCNTNSIYITSNQDLIISYCKADPNDPSSEENACSINISEILTGKCLAKIKAGNLNKQRVSKFQSTPSEALGDITALYYDEEREEIYTGNRLGLVHVWSN

SEQ ID NO: 16300 - protein, 274 aa, Bifidobacterium longum
MDRMKEQAKRFGTTYIADDVSSIEACESDSVKPTYRVTLSDDSQLEASSLIIATGSSFRKLGVPGEQELSGHGVSYCATCDGFFFRNKPIVVVGGGDSAFEEALFLTRFGSSVTLIHRRDSFRASQIMVDRAKANPTITLMTNTVVTSITGTSSPTQNTGAPIAIPGLTLKRPAVAPASVSSIAVRNMVTGEESTLDTNAVFVAIGHTPATDFAAGVVDRDDDGYVVVQGASTVTSAPGIFAAGDCVDRTYRQAISAAGMGCRAALDTQAYLTD

SEQ ID NO: 16301 - protein, 890 aa, Phaseolus vulgaris
MAASVGNRQFATHMNGVVRSCGQDLKPSLPLDFDLDSSSSDDDENDDASYLKELVRKANAETEASVMDPRDEGTADQWVARNASMVRLTGKHPFNAESPLQRLMHHGFITPVPLHYVRNHGPVPKANWEDWTVEITGLVKRPTRFTMDRLVREFPHREFPATLVCAGNRRKEQNMVKKTIGFNWGSAGTSTSVWRGVPVRHVLRRCGILTRGKGALHVSFEGAENLPGGGGSKYGTSISREMAMDPSRDIILAYMQNGEPLAPDHGFPIRMIIPGFIGGRMVKWLKRIVVTEQECESHYHYKDNRVLPSHVDPELANEEGWWFKPEYIINELNINSVITTPCHDEILPINSWTTQRPYVVRGYAYSGGGRKVTRVEVTLDGGETWHVCTLDHPEKPNKYGKYWCWCFWSLEVEVLDLLGTKEIAVRAWDEGLNTQPENLIWNLMGMMNNCWFRVKTNVCKPHKGEIGIVFEHPTQPGNQPGGWMAKEKHLEQSQEAKPSLKKSVSTPFMNTASKMFSVSEVKKHSSPDSAWIIVHGHVYDCTRFLKDHPGGTDSILINAGTDCTEEFDAIHSDKAKKMLEDYRIGELITTGYTSADSSPNNSVHGNSEFIHLAPINEITTIPPLPPRSVALNPRQKIPCKLVSKTSISHDVRLFRFEMPSKNQLLGLPVGKHIFLCATIDGKLCMRAYTPTSSVEEVGFFDLLIKVYFKDVHPKFPNGGLMSQYLESLSIGSMLDVKGPLGHIEYTGRGNFTVNGKSRFAKRLAMLAGGTGITPIYQVAQAILKDPEDLTEMHVVYANRTEDDILLREELDTWAKEHCERFKVWYVVETAKEGWGYGVGFITEAIMREHLPEASSDSLAMTCGPPPMIQFAVQPNLEKMGYDIKNDLLVF

SEQ ID NO: 16302 - protein, 890 aa, Glycine max
MAASVDQRPYPGLHNGVVRPLKPGPDIPRPKKLPQAPPPLSDSSSDEEEDTTLNLKDLIRKGTTEVESSIFDPRDDGTSDHWIQRNSSLVRLTGKHPFNSEPPLPRLMHHGFITPVPLHYVRNHGPVPRARWEDWTVEVTGLVTRPTCFTMEQLLHDFPSREFPATLVCAGNRRKEQNMVKQSIGFNWGAAAISTSVWRGVPLRTLLKSCGIYTRTKGALHVCFEGAEDLPGGGGSKYGTSILREVALDPSRDIILAYMQNGEPLSPDHGFPVRMIIPGFIGGRMVKWLKRIIVTTDQSQNYYHYKDNRVLPSHVDAELANAQAWWYKPDYIINELNINSVITTPCHEEILPINSWTTQMPYFIRGYAYSGGGRKVTRVEVTLDGGETWQVCTLDCPEKPNKYGKYWCWCLWSVEVEVLDLLGAREIAVRAWDEALNTQPEKLIWNVMGMMNNCWFRVKTNVCRPHKGEIGIVFEHPTQPGNQSGGWMAKEKHLEKSSESNPTLKKSVSSPFMNTTSKTYTMSEVRRHNNADSAWIIVHGHVYDCTRFLKDHPGGTDSILINAGTDCTEEFEAIHSDKAKQMLEDYRIGELTTTCYNSDSSSSNPSVHGSSDTIPLTPIKEVITPMRSVALNPREKIPCKLISKTSISHDVRLFRFALPSDDLLMGLPVGKHIFLCATVDEKLCMRAYTPTSSVHEVGYFDLVVKVYFKGVHPKFPTGGIMSQHLDSLPIGSVLDVKGPLGHIVYTGRGNFLVHGKPRFATRLAMLAGGTGITPIYQVVRAILKDPEDCTEMHVVYANRTEDDILLKEELDEWAKKYDRLKVWYVIQASIREGWEYSVGFITESILTEHIPNASPDTLALTCGPPPMIQFAVQPNLEKLGYDTQNNLLVF

SEQ ID NO: 16303 - protein, 445 aa, Leptospira interrogans
MIRLETRFASSFIQSSKLEPFLEKSESARLTLHSSQGQGKEYLGWLYLPKELKNSEIERMTQVAERLRNSSEVIVVIGIGGSYLGSRAVLEATLPFFKKPSIGNPEIIFAGHHLESRYFSELIEYLEDKNFSINVISKSGTTTEPAIAFRLLWELLRKKYGSSASSRVVATTDSSKGVLKKFADSEKLDTFTIPDNVGGRYSVLTPVGLFPLAVAGISISKFILGFQNILNDIHSITDPTRNPATYYSALRNYFLSEGRYIEVLANFNPSLRYVSEWWKQLFGESEGKENKGIFPASMDFTTDLHSLGQYIQEGKRILFETVLSPSEVCSNLTLKPTQDNLDSLNFLSGNTLGYVNEQARLGTLLAHADGGVPCLELVFPDISPQSLGELMYFFEYSCAISGYSLGVNPFDQPGVEAYKKNMFALLNKPGFEQEGETLRKRISRN

SEQ ID NO: 16304 - protein, 905 aa, Fusarium oxysporum
METSTTTTLLQQERIPENSEPISTHIHTHSLPPTPPGTAKPSRIGSFHDLQELSSVESPRLDHIKPYPLPPKFSPKSVLKEDLKTPDNFVERDPRLIRLTGVHPFNVEAPLSDLYDEGFLTSENLHYVRNHGHVPRCEDDDILDWEFEISGLVENPIKMNVRDLINDYQQLTYPVTFVCAGNRRKEQNIVRKTKGFSWGPAGLSTALWTGVAIGDLLSAAKPKRGARYVCFEGADKLPNGYYGTSIKLNWCMDPNRGVMVAHKMNGNPLPPDHGKPVRIVIPGQIGGRSIKWLKKITITQEPSDNWYHIYDNRVLPTMISPEESANLPEVWKDEKYAIYDLSTNSAICYPAHEEKVPFTDAPASYKVRGYAYSGGGRRITRVEVTLDKGKSWRLANIRYPEDDYRNAPEGDTLYGGRVDMWWRETSFCWCFWDLDIPLDELKSADDIMMRAMDESMNVQPRDMYWSVLGMMNNPWFRIVIHKEDHALRFEHPTHATLKIKGWMERVKEAGGDLTNGYWGEKAPGEVQEVVVKEPEKQICMTNPQINRKITIEELKAHSGEEEPWFVVKGEVYDGTPYLSGHPGGAASIFGAAGQDATEEFMAIHSENAKAMLPTYHIGTLDEESRAILSGDATKTNDDADREVFLQAKTWSKAILDKKTSISPDTKIFSFKLNHEAQKIGLPTGQHLMMRLRDPATREAIIRSYTPYSDGSDCGRLDILIKIYYDTPQRKGGVMTQALDALPIGHWVDFKGPTGKFVYHGNGLCTINEKERRVRRFIMVCGGSGITPIRQVLRAVIDNPKDTTPCLVFNGNRSVNDILCMEELEELEAANPSRCRVVNALSNPPPEWNGLKGFVNQALVPEYMDLPKASGEGDELLLVCGPPPMVKAVEASFLGMGFKSDDFVFF

SEQ ID NO: 16305 - protein, 77 aa, Liriodendron tulipifera
MKEQKLIHEGLITESLPNGMFRVRLDNEDLILGYVSGRIRRSFIRILPGDRVKIEVSRYDSTRGRIIYRLRNKDSND

SEQ ID NO: 16306 - protein, 216 aa, Xanthomonas campestris
MLGIGAFKQRMPRPGEALPGREQALPLHNTHLVNGHPLRGEFIGLAQVQFGLGCFWGAERKFWNVPGVYTTAVGYAGGQTPNATYSEVCSGQTGHTEAVLVVFDEQAVSFAQLLRTFWESHDPTQGMQQGNDVGTQYRSAIYCTTQAQYDAALASRDAYQQQLTAAGYGAITTEIRFPAPTFYYAEDDHQQYLAKHPNGYCGLGGTGVSCPIGLDA

SEQ ID NO: 16307 - protein, 893 aa, Leptosphaeria maculans
MSVTTQQPAVVPLPSSPRLPIESHAGPRSTQLPPSPPETVNGDDPKSITSTPAEPDFPLPPPANPKPQVLDIDKPTPDAHVPRDPRLIRLTGVHPFNTEPPLTDLYNEGFLTSPELFYVRNHGAVPEVQDEECLDWEFSIEGMVANPLKITLRQLLEEYENVTYPVTLVCAGNRRKEQNVVRKSKGFAWGAAGVSTALFTGVVMKDVIERAKPLRKAKYVCMEGADKLPNGYYGTSVKLNWVMDPNRGIMLAHKMNGENLSLDHGKPLRAVVPGQIGGRSVKWLKKLIVTAEPSDNWYHIYDNRVLPTMVDPDEAAKNPKWWMDERYAIYDLSPNSAIAFPAHEEKVVLASAENSYNVRGYAYSGGGRRITRCEVSLNKGKNWRLANIDYAEDKYRDFEGRELFGARLDMDWRETSFCWCFWNLDIATAELRDANDILVRAMDEAMCIQPRDMYWSVLGMMNNPWYRITIHHEGDVLRFEHPTQPALIPGGWMERVKKAGGNLTNGQWGEQIEGQELENTAVEEVKEIKMTKDGVNRIVELDELKWHESAEYPWFVVNDEVYDGTSFLEGHPGGAQSIISAAGLDASDEFMAIHSETAKAMMPAYHIGTLSPTASKQLSLEEPTSKQASSSSLRPTFLDSRTWSKALLSSKTKVSWDTRIFRFKLDHASQTLGLPTGQHLMIRLRDPVTREAIIRSYTPISQISEQGFCDVLIKIYADAPGREGGKMTKALDSIPCGHWVDMKGPIGKFEYLGKGVCSINGNERRVRSMKMICGGSGITPIYQVLRAILQDSADSTHCTVLNGNRLEEDILCREDLDRFAEENGERCTLVHTLTQAAEGWTGRRGRIGEELLKEFCGTEEDGLVLVCGPEGLERSVKGLLSGMAWRDDDVIFF

SEQ ID NO: 16308 - protein, 900 aa, Lotus japonicus
MAASVDNRQYSTLNGVVRSFTPNNTYLHDPKPSFPAVNLDLDASSSDDDDEKDDASILKDLIRKGNAEIESSVLDPRDQGTADNWISRNSSMVRLTGKHPFNSEPPLPRLMHHGFITPVPLHYVRNHGPVPKARWDDWTVEVTGLVKTPTRFSMDRLVRDFPSRELPVTLVCAGNRRKEQNMVRQSIGFNWGSAGVSTSVWRGVSLRHILRRCRIQTRSRGALHVCFEGDEDLPGGGGSKYSTSIRREVAMDPSRDVILAYMQNGEVLAPDHGFPVRVIIPGFIGGRMVKWLKRIVVTEEECDGHYHYKDNRVLPSHVDAELANEEGWWYKPEYIINELNINSVITTPCHDEILPINAWTTQRPYTLRGYSYSGGGRKVTRVEVTLDGGETWFVCALDQQEKPNKYGKYWCWCFWSLEVEVLDLLGTKEIAVRAWDEALNTQPENLIWNVMGMMNNCWFRVKTNVCKPHKGEIGIVFEHPTQPGNQPGGWMAKEKHLEISQQDSRPILKKSVSSPFMNTFTKMYSLSEVKKHNSPDSAWIIVHGHVYDCTRFLKDHPGGADSILINAGTDCTEEFEAIHSDKAKKMLEDYRVGELITTGYTSDSSSPNNSLHGNSEFKHLAPIKEITTMSLPPLPRRKVALIPREKIPCKLISRTSISHDVRVFRFALPSEDQQLGLPVGKHIFLCATVDGKLCMRAYTPTSGVDEVGYFELVVKVYFKGVHPKFPNGGAMSQHLDSLPIGSDLDVKGPLGHIEYTGRGNFLVHGKHRFAKKLAMLAGGTGITPIYQVAQAILKDPEDHTKMYVVYANRTEDDILLREELDTWAKKYEDRFKVWYVVETAKEGWGYSVGFVTEGVMREHLPEAGDDALALACGPPPMIQFAVNPNLEKMGYDVKNDLLVF

SEQ ID NO: 16309 - protein, 555 aa, Arabidopsis thaliana
MKSFCDNDDNNHSNTTNLLGFSLSSNMMKMGGRGGREAIYSSSTCSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 16310 - protein, 160 aa, Lotus tetragonolobus
KGPLGHIEYTGKGNFIAHGEPKFARRLAMLAGGTGITPIYQVIQAVLKDPDDRTEMFFAVYSNKTESDILLREELDAWAKKHSDRFKVWYVVDKAGNDWAFSTGRVNESIMRVHLPGPSDALALACGPPPINSAYGWQPSLENIGYKKDDVPVFMATTQS

SEQ ID NO: 16311 - protein, 391 aa, Brassica oleracea
MAMAAAAVIVPLGILFFISGLVVNLLQAVCYVLIRPLSKNTYRKINRVVAETLWLELVWIVDWWAGVKIQVFADDETFNRMGKEHALVVCNHRSDIDWLVGWILAQRSGCLGSALAVMKKSSKFLPVIGWSMWFSEYLFLERNWAKDESTLKSGLQRLNDFPRPFWLALFVEGTRFTEAKLKAAQEYAATSQLPVPRNVLIPRTKGFVSAVSNMRSFVPAIYDMTVAIPKTSPPPTMLRLFKGQPSVVHVHIKCHSMKDLPESEDEIAQWCRDQFVAKDALLDKHIAADTFPGQKEQNIDRPIKSLAVVVSWACLLTLGAMKFLHWSNLFSSLKGIALSALGLGIITLCMQILIRSSQSERSTPAKVAPAKPKDKHQSGSSSQTEVEEKQK

SEQ ID NO: 16312 - protein, 902 aa, Phytophthora infestans [sequence omitted]

SEQ ID NO: 16313 - protein, 530 aa, Xanthomonas campestris
MLDANLKTQLTAYLERVTRPIQINASIDDSAGSREMLDLLEELVLLSDKISLDIHRDDNQRKPSFALTTPGQDISLRFAGLPMGHEFTSLVLALLQVGGHPSKAAAELIEQVQHLEGDYQFETYFSLSCQNCPDVVQALNLAAVLNPRIKHVAIDGAWFQDEVEARQIMSVPTVYLNGELFDQGRMTLEQIVAKLDTNAAKRDAAKIAAKEAFDVLVVGGGPAGSAAAVYAARKGIRTGVAAERFGGQVLDTMSIENFISVPETEGPKMAAALEQHVRQYDVDIMNLQRAEQLIPAGADGLIEIKLANGASLKSKTVILSTGARWRQMNVPGEDQYKNKGVAYCPHCDGPLFKGKRVAVIGGGNSGVEAAIDLAGIVAHVTLVEFDDKLRADEVLQRKLRSLHNVRIITSAQTTEVLGDGQKVTGLVYKDRTGGDIQHIELEGVFVQIGLLPNTEFLRGTVALSPRGEIIVDDRGQTDVPGVFAAGDATTVPYKQIVIAMGEGSKAALSAFDHLIRTSAPATADSVAQAA

SEQ ID NO: 16314 - protein, 444 aa, Oryza sativa
MKQTLDVHRSLRPPMPMAQQQMDEFWRDRQKEIEMTKDFSEHMIPMARLKKIVSSQKGNMMMTFDMPAFLSKMCELFVQELAARAWACAQSHNRCIILDMDIAEAVASTESYDFLVDILHNHSVKQKSTPCSSTKRCRLVDQPSTSHIPHQHLLPQFAPTYTLAIPITPSLMPLISQCTPSSFPSLPQEKFPLMAPTPIVNRSMLFINNIARGLGLQGNNINAVANNNILDNIVGCSSPAVLASMMNPALLGPSGAPLNPPNSQSYNCTMDIINSNDACGSNNSSVIVANQANIAPSGHFYPIALQSSCSTFLHSNNNDTITAILEGVDISDIMHVTSDVDAATKVFSGQEEQHEKETNVEWHHQNEIYESIDIRIINATTRDGNKCSISWDELGMADDSLLDNFLEELQVRKDDVSDTRIAFNKDPFLDDAVLSNPSTSNGNK

SEQ ID NO: 16315 - protein, 73 aa, Cucumis sativus
PSAGGTATSINNARTYINNLIQHVKRGTPRRPGRPTETYIFAMFDENKKSPELEKHFGLFFPNKQSKYPINFN

SEQ ID NO: 16316 - protein, 272 aa, Unknown
  Candidatus Desulfococcus oleovorans Hxd3
MQEIRIAAVTCACPAGQVDRNLETTARWVGKAAARGAGIVCFPELNVSGYCLDAALYREAAGRYNDVVGALSRMATAFDIVILAGTVAEAAGGRVTACHLVISPNGSAGGYTKLHIAPPEKQLFVPGRKVPLFEAKGAVFGVQLCYDAHFPELSTAMALKGADILFVPHASPRNTPEEKLASWMRHLPARAYDNGVFVAACNQAGENGAGQGFPGVAVALDPSGKVMAQTTSPDSMIVADCSPSTLNTVRNHPMRYFLPGRRPELYGSGDGS

SEQ ID NO: 16317 - protein, 507 aa, Glycine max
MTFSLSFTTLLSLLSVILLHVNAFPVHFNHPIHHRHPRFAAHNYRDALTKSILFFEGQRSGKLPPNQRMSWRRDSGLSDGSAMHVDLVGGYYDAGDNVKFGFPMAFTTTMLSWSVIEFGGLMKGELQNAREAIRWGTDYLLKATAHPNTIYVQVGDAKKDHACWERPEDMDTPRSVFKIDANTPGSEVAAETAAALAAASLVFRRSDPTYSKILVRRAIRVFQFADKYRGSYSNALKPYVCPFYCSYSGYQDELLWGAAWLHKATKNPMYLNYIKVNGQILGAAEFDNTFGWDNKHAGARILLSKEFLVQRVQSLHDYKGHADNFVCSLISGTSLSSTQYTPGGLLFKMSDSNMQYVTSTSFLLLTYAKYLTQSHMLVNCGGITVTPRRLRTIAKKQVDYLLGDNPLKMSYMVGYGPRYPRRIHHRGSSLPSIAVHPGKIQCSAGFSVMNSQSPNPNILVGAIVGGPDRHDRFPDQRSDYEQSEPATYINSPLVGALAYLAHSFGQL

SEQ ID NO: 16318 - protein, 308 aa, Nicotiana tabacum
GTRLDEEGCIEESGHISEKKRRLSVEQVKALEKNFEVENKLEPERKVKLAQELGLQPRQVAVWFQNRRARWKTKQLERDYGVLKSNFDALKHNYESLKHDNEALLKEILELKSKVYTENGESKGVAVKEEAMESESDDNKVIEQSKPNDNDNNNNNFLENFEEDDEEEEINFENFNVAAAATSTNIFGDNFKDGSSDSDSSAILNEDNSPNAAAISSSGAFLISTNGNGNGNGSSTSLNFCFQFTESSSKSNLGDGQKGNNNYYQPQQYVKMEEHNFFNGEESCSTLFTDEQAPTLQWYCPEDWNWKE

SEQ ID NO: 16319 - protein, 322 aa, Mycoplasma penetrans
MKKIAILTSGGDASTMNKCLSTFITYASKYNCEVVFVKNGYKGIYDNEFVKPDYTETKSWWSLPGTKIYSSRFPEILDEQVRKQMVDNLHKNSIDTLVVIGGDGSYKGARLLSKSGIKVIGLPGTIDNDIASTSYSIGFDTSLNAIVNSIKEIKSCMDSHANVAMIEIMGRHCIDLTVFAGIATEADIIITPESFYTPQQLLAKINEKRKTNSRGIIILYVELLLGTENIPTVEEYIKYIQANSKESVKKNILGYLQRGGNPTAMDMIRASLMTEHALKMISENQYNKIIGVDEFKVVSYDLETAINMKNPSRKDLIDKFFN

SEQ ID NO: 16320 - protein, 628 aa, Bordetella parapertussis
MCGVLGAWWRHHDEHEDARFAAGLRKLAHRGPDDRGSEHFAAPHGRLSLGHTRLAVIDLSAAGHQPMHADADRLAVVFNGEIYNYRELRSELRQIDAIFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGRAGEPMAWDDPASQECRPIGFQEAAEELRARFLDNVRLHLRSDVPIGAALSGGIDSSAIVCAMRWLEPDLPIQTFSFISDDAHRSEERWVDLVNQHCGATGHKIHIAPHELLDDLDDLIRVQGEPVGSTSIYAQYRVFKLAREHGVVVTLDGQGADELLGGYGGYPTERLASLLETSRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALSLPERYLVSDSGQTKHIFRKAMRGIVPDLILDRDDKIGFATPEQQWMQATAPQMRQWLVDAADIPFLRNAEVTAQFDAMIAGATPFSWQAWRWVNFQRWMQHATVLP

SEQ ID NO: 16321 - protein, 513 aa, Streptomyces clavuligerus
MGAPVLPAAFGFLASARTGGGRAPGPVFATRGSHTDIDTPQGERSLAATLVHAPSVAPDRAVARSLTGAPTTAVLAGEIYNRDELLSVLPAGPAPEGDAELVLRLLERYDLHAFRLVNGRFATVVRTGDRVLLATDHAGSVPLYTCVAPGEVRASTEAKALAAHRDPKGFPLADARRVAGLTGVYQVPAGAVMDIDLGSGTAVTHRTWTPGLSRRILPEGEAVAAVRAALEKAVAQRVTPGDTPLVVLSGGIDSSGVAACAHRAAGELDTVSMGTDTSNEFREARAVVDHLRTRHREITIPTTELLAQLPYAVWASESVDPDIIEYLLPLTALYRALDGPERRILTGYGADIPLGGMHREDRLPALDTVLAHDMATFDGLNEMSPVLSTLAGHWTTHPYWDREVLDLLVSLEAGLKRRHGRDKWVLRAAMADALPAETVNRPKLGVHEGSGTTSSFSRLLLDHGVAEDRVHEAKRQVVRELFDLTVGGGRHPSEVDTDDVVRSVADRTARGAA

SEQ ID NO: 16322 - protein, 310 aa, Saccharomyces cerevisiae
MGKSSKDKRDLYYRKAKEQGYRARSAFKLLQLNDQFHFLDDPNLKRVVDLCAAPGSWSQVLSRKLFDESPSSDKEDRKIVSVDLQPMSPIPHVTTLQADITHPKTLARILKLFGNEKADFVCSDGAPDVTGLHDLDEYVQQQLIMSALQLTACILKKGGTFVAKIFRGRDIDMLYSQLGYLFDKIVCAKPRSSRGTSLEAFIVCLGYNPPSNWTPKLDVNTSVDEFFQGCFLNKLCISDKLSHWNEEERNIAEFMACGSLQSFDSDATYHDLPSSVAGTSSSLDPVQSPTNPPYKKALELKRSGKLTRSV

SEQ ID NO: 16323 - protein, 168 aa, Triticum aestivum
  misc_feature (113)..(113): Xaa can be any naturally occurring amino acid
  misc_feature (118)..(118): Xaa can be any naturally occurring amino acid
  misc_feature (151)..(151): Xaa can be any naturally occurring amino acid
DATAPVAGAEAVVAGAGEQAGISAVIPGWFSEISPMWPGEAHSLKVEKVLFQGKSDYQNVMVFQSSTYGKVLVLRRIIQVTERDDCAYQEMITTCPFAPSKDPKEVWLLGGGXGVLLXVQRHTPWDQIDICEMINGGNSQTIFPQPTVGLXPRVSLHIGDGFLKNLRR

SEQ ID NO: 16324 - protein, 697 aa, Bdellovibrio bacteriovorus
MKTTVTTSVGGKQITIETGRLAKQADGAALVSSGNNMVLVTATSSKKASELDFFPLTVEYIEKFYATGKIPGGYFKREAKPTNDAVLIARLIDRPIRPVFPEGYRHETQIVATVLSADGAFPLEILASLGASAALHCSDIPFNGPTAAVQIARVDGQFVANPTPQQMEKSDMDMIVAGTRNGLLMVEGETKFISEADALAALKFGHQSLIPLLNAQDELREKAGSVAKRAFTAPSIDADFKAKAESLLRPKIAAALSIKEKQDRYAAANEAAAEAEKALLADIADKELLKQRKKELNSIVEDLKYQEARSMILDRAVRIDGRDVKTVRPIANEVGILPRAHGSGLFTRGETQVLGTVTLGTADDEQMVDSLLGLQKRKFMLHYNFPPYSVGEVGRMSGTSRREIGHGNLAERAIKAVLPDFEKFPYTIRIVSEVLESNGSSSMGTVCSGIMALLDAGVPLKGNVAGVAMGLIKEGDRVAVLTDILGDEDHLGDMDFKVAGSPAGITALQMDIKIDSVSFEVMEQALAQAKEGRAHILNEMEKVMKVPRGQISEFAPRIETIKIKPDKIREVIGSGGKVIRGITEATGVKIEIQDDGTINIASADPEATKKAIAMINDIIAEAEVGKTYKGRIVKIAEFGAFVEILPNTQGLLHISEISNERVRAVSDVLKEGEIIDVKVLEVDRSGRVKLSRKALLQ

SEQ ID NO: 16325 - protein, 178 aa, Archaeoglobus fulgidus
MKKFSRKTEETEVEVVLGEELKVDTGIAFLDHMLKTLSRHSGIKLRVKAKGDLEHHVIEDVAIALGKALAGVDKKGLERFGDAIVPMDDAVAICGLDFSGRGVLVVEGTFGDGEMREEDFLHFLDTLCRNAGLNVYLSVKGSNSHHKMEAAVKAVAISLKKALTKNGNDYRSAKGVLD

SEQ ID NO: 16326 - protein, 164 aa, Caulobacter crescentus
MPHAGLCLYRREAPSRRSAMRYLHTMIRVRDLDASLRFYCKGLGLQEMYRTENEKGRFTLVFLAAPEDVELAKARKAPLVELTYNWDDEEYGGGRNFGHLAYRVDDIYETCQRLMDMGVTINRPPRDGHMAFVRSPDNISIELLQDGDLPPAEPWVSMPNVGAW

SEQ ID NO: 16327 - protein, 414 aa, Bacillus cereus
MVDHLKRQDEKVFAAIEAELGRQRSKIELIASENFVSEAVMEAQGSVLTNKYAEGYPGKRYYGGCEHVDVVEDIARDRVKEIFGAEHVNVQPHSGAQANMAVYFTILEQGDTVLGMNLSHGGHLTHGSPVNFSGVQYNFVEYGVDAESHRINYDDVLAKAKEHKPKLIVAGASAYPRVIDFKRFREIADEVGAYLMVDMAHIAGLVAAGLHPNPVPHAHFVTTTTHKTLRGPRGGMILCEEQFAKQIDKSIFPGIQGGPLMHVIAAKAVAFGEALQDDFKTYAQNIINNANRLAEGLQKEGLTLVSGGTDNHLILIDVRNLEITGKVAEHVLDEVGITVNKNTIPFETASPFVTSGVRIGTAAVTSRGFGLEDMDEIASLIAYTLKNHENEAALEEARKRVEALTSKFPMYTDL

SEQ ID NO: 16328 - protein, 358 aa, Comamonas testosteroni
MNHQEQAIYPRNTWYVAATAAEVTDKPLGRQICGERMVFYRALEGKMAAVEDFCPHRGAPLSLGRVCEGKLVCGYHGLEMGCDGRTVAMPGQRVRGFPAIKSYPVEERYGFVWVWPGDKDAADAALIPDLQWHDSPEWAYDGGLFHIKADYRLMIDNLMDLTHETYVHASSIGQAEIDETPCKTEVIGDSEVVTSRFMENIEAPPFWKMALRSNGLADDVPVDRWQVCRFTPPSHVLIEVGVAHAGKGGYDAADEHKVYSMVVDFITPETDGSMWYFWGMARKFNPGDASVTAAIKQGQHKIFSEDLEMLELQQRNLEDYPQRQLLKLNIDAGGVQSRKIIERLIDEEKNESGVAALA

SEQ ID NO: 16329 - protein, 1176 aa, Neurospora crassa
MANTSLDMASSTSPSPSPESTTTPRKRIVVVGLGMVGIAFIEKLIKLDTQRQYEIVVIGEEPHVAYNRVGLTSFFSHREVEQLYLNPLEWYKQHLQTSSLTHHLSTAALSLSPATKSLTISPPPSTPSLTTLPYDHLILATGSSALLPTSTPGHDASGVFVYRNIADLQSLITWSSDTQIKGSTGVVVGGGLLGLEAAKALMDLQVFGRVVVIERNGWVLSRQVDGEAGALVLEGVRGLGVEVLTRKRVKEVECDESKDEGEKEKKRVKGIRFEDGEYLACSTICFAIGIKARDELAREAGITCAERGGGGIVVDDSLQTSAPDVYAIGECASWKGQTFGLIGPGVEMADVLAFNFSQAHLHTPRVFKRPDLSTKLKLLGVEVASFGDFFADRDGPKELPPKLRRELKKSGGKAEVKALTYKDPFLSVYKKYIFTSDGKYLLGGMMIGDTTDYVRLVPLVKTHKELDVPPSQLILGAKKSGDDNGDDDLPDDTQICSCHNVTKADLVAPLKSGECTSLGDLKSCTKAGTGCGGCMPLVTSIFNRTMASLGTEVKNNLCPHFPEYSRADLYNIISVKRLRTLPDVMREAGADADSLGCEACKPAIASIFASLWNDHVMSPAHHGLQDTNDRFMGNIQRNGTFSVVPRVAAGEITPEKLIVIGEVAKEYNLYTKITGGQRIDMFGAKKQDLLKIWKKLVDAGMESGHAYAKSLRTVKSCVGTTWCRYGVGDSVGMAVRLEERYKGLRGPHKIKGGVSGCTRECAEAGNKDFGLIATEKGFNILICGNGGTTPKHSVLLAKDVPPTNVIPIIDRFLMFYIRTADKLQRTARWLEALPGGIDYLKEVILEDRLGICASLEAQMQELVDSYFDEWAEALNNPAMQERFKQFANTDEGQPPMEVEIDRGQERPVMWPREDEGGSAKADFKGLRDKWSSTTWQPVLEASYFQGADDLPNGISASIKRGDTQLAVWRIKGKYYASQQMCPHKRTFALSDGFVGTDPSPSSCSSSALPPSPPSTPPRSSSPVTSPPQSPTSSATPATTASSSCTTNPSGPASPWISCPFHKRNFSLTSGSCKNDNELSIATFDVEERDDGMVYIKLPPVDELDRELGTKKWMVKKGEAGEGQLRELDELNKSKGVEGKKGRRGRKPGASEAGKEVGKKLVEAVGGGGCGGPGLEW

SEQ ID NO: 16330 - protein, 407 aa, Zea mays
MAAPTTSRRGPGGARNMDDENLTFETSPGVEVVSSFDQMGIKDDLLRGIYGYGFEKPSAIQQRAVLPIINGRDVIAQAQSGTGKTSMISLTVCQIVDTAVREVQALILSPTRELASQTERVMLAIGDHLNVQVHACIGGKSIGEDIRRLENGVHVVSGTPGRVCDMIKRRTLRTRAIKLLVLDEADEMLSRGFKDQIYDVYRYLPPELQVVLISATLPHEILEMTSKFMTEPVRILVKRDELTLEGIKQFFVAVEKEEWKFDTLCDLYDTLTITQAVIFCNTKRKVDWLTEKMRTNNFTVSAMHGDMPQQERDAIMGEFRSGATRVLITTDVWARGLDVQQVSLVINYDLPNNRELYIHRIGRSGRFGRKGVAINFVRKDDIRILRDIEQYYSTQIDEMPMNVADLI

SEQ ID NO: 16331 - protein, 418 aa, Vibrio angustum
MAAIAVFISIINHKIGRFQTTIAITGWSIAISLILLALTSFGYISIDKENALIELIQHIKFEDFLLKGVLGFLLFAGALNIDLDHLKDQKFEITFLALAGTLFSTFFIGIVLWLIFSLIGIELNFIYCCLFGALISPTDPIAVLAIVKKLKAPQRISTQIEGESLFNDGVGLVIFVTIFEVAFGKTAPTVSGTALLFIREALGGIAFGAVLGGIFHYLIKGSSDNMMRLILTMLIPTFGYVLGEHLEVSAPLAMVVSGILIGNITRKYISEQSANQMAHLWELVDEILNAVLFLLIGFVMITFSFHSIDIIAVIIAIPLVLLSRYLSIRLSYIGFTRYRQYNPESVKILTWGGLRGGLALAMAMAIPAHIYLPSHPDVSVKEIIVLMTYAIVIFSILIQGSTITPMIMKAKAVDNKPF

SEQ ID NO: 16332 - protein, 490 aa, Staphylococcus aureus
MTSKSSPLIFERSREGRYAYSLPKSDIKTNSVESLLDDKFIRKNKAEFPEVAELDLVRHYTELSNKNFGVDNGFYPLGSCTMKYNPKINEKVARIPGFSESHPLQDEDQVQGSLEIIYSLQEELKEITGMDEVTLQPAAGAHGEWTALMIFKAYHENNGEGHRDEVIVPDSAHGTNPASASFAGFKSVTVKSNERGEVNIDDLKRVVNENTAAIMLTNPNTLGIFEKNIMEIREIVHNAGGLLYYDGANLNAIMDKVRPGDMGFDAVHLNLHKTFTGPHGGGGPGSGPVGVVKELASYLPKPMVIKDGDKFKYDNDIKNSIGRVKPFYGNFGIYLRAYTYIRTMGATGLKEVSEAAVLNANYIKARLSKHFEIPYKQYCKHEFVLSGVRQKEFGVRTLDMAKRLLDFGVHPPTIYFPLNVEEGMMIEPTETESKETLDYFIDTLISIAEEAKNDPDKVLEAPHTTVIDRLDEATAARKPILKFENLKQEK

SEQ ID NO: 16333 - protein, 145 aa, Unknown
  Azoarcus sp. EbN1
MTETLTIACPHCHVLNRLPGGRLSDDPNCGKCHQALFTSHPVELDAASFDVHAGHGDLPLLVDFWASWCGPCRTMAPAFEEAAAKLEPHVRLGKVNTEEAQDLAARYAIRSIPTMVLFRAGREVARQSGAMNTGQILQWAKAQGL

SEQ ID NO: 16334 - protein, 950 aa, Chromobacterium violaceum
MSLTELFNRHEFLARHIGPSDAERAEMLAAVGAPSIDALVDQTLPADIRLNRRLDLPSPQPEAEALAALKAVASKNVVNKSFIGLGYYPVLTPTVILRNVLENPGWYTAYTPYQAEIAQGRLEALLNFQQMVIDLTGLEMANASLLDEATAAAEAMAMAGRVSKSKSTRFFVDSRVLPQTLDVMKTRAKYFGFELVQGHPEEAGNGDYFGALFQYPGEAGDLLDLTPHIAAVKAKGGVVAVAADVMALVALKSPAEMGADIALGNTQRFGVPMGFGGPHAAYFAFKDEMKRSAPGRIIGVSIDAKGKTALRMALQTREQHIRREKANSNICTSQVLLANIAGLYAVYHGAEGVRRIAARIHRLAAIFAHAVKEAGGKLVFDRFFDTVQVDAPKADAIYAAALAAGYNLRRVGKTVLGVAFHEAATESDLAKLIELFTGKPADIAALDAAALDAIPAALKRESAILTHPVFNTHHSEHEMLRYMKKLENRDLAMNHSMISLGSCTMKLNATSEMIPITWPEFANMHPFAPREQTVGYLELIEGLQKQLKAITGFDAISMQPNSGAQGEYAGLLAISRYHESRGEAHRNICLIPQSAHGTNPATAQMMNMQVVVVKCDEAGNVDVADLKAKAEQHAANLAALMITYPSTHGVFEQGIKEICEIVHAHGGQVYMDGANLNAQVGLTRPADIGADVSHMNLHKTFCIPHGGGGPGMGPIGLKAHLAPFIANHVVAPVPGAVEGQTAVSAAPFGSASILPISYMYIAMMGAEGMKQATENALLSANYLATRLSEHFPVLYTGANGRVAHECIIDLRPLKAASGVTEVDVAKRLMDYGFHAPTMSFPVPGTLMIEPTESEPKAELDRFIAAMAAIRAEIDRVQSGAWPADNNPLVNAPHSKADIAGDWDRPYSREQGLFPLPYVLENKFWPSVNRIDDVYGDRNVVCSCPSTESYM

SEQ ID NO: 16335 - protein, 246 aa, Pseudomonas putida
MNAKIWLVGAGPGDPELLTLKAVRALQQAAVVLIDDLVNPAVLAHCPQARVIAVGKRGGCRSTPQAFIQRLMLRHARQGRCVVRLKGGDPCIFGRGGEEALWLRGHGIEVELVNGITAGLAGATQCGISLTSRGVSRGVTLVTAHTQDDSALNWAALAQGGTTLVVYMGVARLEQVRQGLLDGGMAPGMPVAMIENASLLQQRAHRSDVRRMVEDAHGFGLRSPAVLVIGEVVGEQQILRLDAIAG

SEQ ID NO: 16336 - protein, 192 aa, Xylella fastidiosa
MNMLNVLRFPVLALALAFVSSGVLADVGSLLDLDYRPLAGKETVNLQRLYGGKVLLVVNTASKCGFTPQYEGLEALHQKLSPLGFAVLGFPSNDFKGQEPGDEQQIQEFCTLTYGVKFPMFQKVHVKGDEVTPLYQRLTQTTGVAPGWNFHKYLIARDGHVVAQFDSRTRPDDPILLEAIKRELAKSVQVVH

SEQ ID NO: 16337 - protein, 216 aa, Cryptococcus neoformans
MGRRPARCYRYCKNKPFPKSRYNRGVPDPKIRIYDLGRKKASVDDFPFCCHLVSDEYEQLSSEALEAARICANKYIVKNAGKEAFHMRVRVHPFHVIRINKMLSCAGADRLQQGMRGAWGKPYGSVARVNIGQVIMSIRCRDSNKAVIIEALRRARYKFPGRQKIIVSKKWGFTPLDRAEYEALKANKQVINDGAYVQFLKPKGPLLKNLRTAERA

SEQ ID NO: 16338 - protein, 149 aa, Triticum aestivum
MDFGDHQQGGSDSQQQLQERRKRQRRHTPEQVQKLEESYKKSDHPSEIECAQLGRELGLETKQVRSWFQNHRTQIRIEHERLENRFLRWENMSLRSEIMAVREALKNSATCPNCVGVAKDCIDQQELNRENARLNAGLLHCTTSFQEEP

SEQ ID NO: 16339 - protein, 591 aa, Bacillus subtilis
MTDTLSKRGPDDSNVWGEHHVLFGHKRLAVVDIEGGRQPMACTYKGDTYTIIYNGELYNTEDLRKELRARGHQFERTSDTEVLLHSYIEWQEDCVDHLNGIFAFAVWDEKRNLLFAARDRLGVKPFFYTKEGSSFLFGSEIKAILAHPDIKARVDRTGLSEIFGLGPSRTPGTGIFKGIKEIRPAHALTFSKDGLNIWRYWNVESEKHTDSFDDTVANVRSLFQDAVTRQLVSDVPVCTFLSGGLDSSAITAIAAGHFEKEGKAPLHTYSIDYEENDKYFQASAFQPNDDGPWIEKMTEAFGTTHHKCVISQKDLVDHLEEAVLVKDLPGMADVDSSLLWFCREIKKDFVVSLSGECADEIFGGYPWFHTADVESGFPWMRSTEERIKLLSDSWQKKLNLKEYVNAKYEETLAETPLLDGETGVDKARRQLFYLNMLWFMTNLLDRKDRMSMGASLEVRVPFADHRLVEYVWNIPWEMKMHDNREKGILRKALEGILPDDILYRKKSPYPKTHHPEYTKGVSEWLKTIRSQKDSVLHTLLDRKQLDQLLETEGSSFKVPWFGQLMKGPQLIAHLAQIHTWFEAYRIDIDER

SEQ ID NO: 16340 - protein, 225 aa, Zea mays
KGYPVPVAKEERPAPGGDPCPRCGSRDTKFCYYNNYNTSQPRHLCKSCRRYWTKGGSLRNVPVGGGTRKSSSSSSSSSAATTTTTTTSTSPGAAPKATKRSKNSKRRRVAPAPDPAAPGTDASTADVASTAPSAATVAASEKPSATEHAAAAVATEKPPAAPPVSVGAFADTSPAPDAGSGGVRELLPHPSRFEWPSGCDLGPPYWGWGTSVLADTDPALFLNLP

SEQ ID NO: 16341 - protein, 161 aa, Brassica napus
MSTSASALLTPSTFSTVISQKNPNSISFHGLRPLRLGGSSSSSLPKLSTTAGRRSSSAVVRAELSPSVVISLSTGLSLFLGRFVFFNFQRENVAKQVPEQNGKTHFEAGDDRAKEYVSLLKSNDPVGFNIVDVLAWGSIGHIVAYYVLATSSNGYDPSFFG

SEQ ID NO: 16342 - protein, 356 aa, Cryptococcus neoformans
MLLSLRSSLSRNIIGQSRHLPTISFSVTSSRIRNMSSQAATSSATVAVCQLRSTSDPVHNLKISEKVIRNAVAAGAKACFLPEASDFINPSKTESRKFSHPLPKHEYTIGLQRLAKELGIVISVGVHEGPEDESEERVYNTHVLIGKDGGILASYRKIHLFDVELSKPPAPDGTPRPPQRTGESERILAGQAVTPPVEVEGIGNIGLEICYDIRFPELSIILTRLGAEVLLFPSAFTVKTGRDHWGTLCRATAIQYQSYLIASAQYGAHNSKRTSWGETLAFDPWGRQLGRLRSVDDTPPPKEGEEGDKGVEKLYEDSGEFFLCEIDGTKVKETRGQIPLAIQKRSDIYGVVGEGA

SEQ ID NO: 16343 - protein, 422 aa, Agrobacterium tumefaciens
MLNRLSHNTVSDTVIADAIAEELDRQKTQIELIASENIVSADVLAAQGSVLTNKYAEGYPGKRYYGGCEFVDKVEQVAIDRLKQLFGAEFANVQPHSGAQANQAVFLALLQPGDRIMGLSLAHGGHLTHGSPVTMSGKWFDVVSYEVDPETHLIDMEKVREKALETKPKLIVAGASAYPRQIDFAGFREIADEVGAYLMVDMAHYAGLIAGGHYPNAVPHAHVTTSTTHKTLRGPRGGVILTNDADLAKKLNSAVFPGNQGGPLMHVIAAKAVAFGEALRPEFSDYAGQVIANAQALAKVLIQGGLGIVSGGTDSHMVLVDLRPKGVTGKIAEIALERAGLTCNKNSIPNDPEKPFVTSGIRLGSSAGTTRGFGVLEFEKIGALILRVIDALATNAEGDSAVEAEVREEVAALCEAFPIYVS

SEQ ID NO: 16344 - protein, 438 aa, Prochlorococcus marinus
MSTNFSVPEPTPQLVKVAESAKEASISLGQSTNKQRCEALTEMANALNDNADEILKANVQDLERSEKEGLNKSLLSRLQLTKTKLKGCIDGVLKVSNLADPIGKRQLHRELNENLILERVTVPLGVLGVIFESRPDALIQIASLAVRSGNGALLKGGSEAKDTNQAIMDSLDKGLRKANVGSGALSLLTTRQESLGLLRLDKFVNLIIPRGSNELVQFIQENTRIPVLGHADGICHLYVDNSVDIDKAISIALDSKIQYPAACNAIETLLIHEDIAEMFLKKGLPIFSSEGVTLKGDTKSQALGVKNKADESDWSKEYLDLILSIKIVRNVNEAIEHIRKYSSRHTEAIVTEDKMVAEKFLSSVDSAGVYHNCSTRFADGFRYGFGAEVGISTQTLPPRGPVGLEGLVTYRYYLRGDGDLVKDFASGDRSFSHIDLPL

SEQ ID NO: 16345 - protein, 177 aa, Zea mays
PTRPFFFFFAEKLKHFIIWNGVFDFREQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAEEEIKNAAAAEEETTNAAAAVDGS

SEQ ID NO: 16346 - protein, 194 aa, Streptococcus mutans
MRQAKIERNTFETKIKLSLNLDTQEPVDIQTGVGFFDHMLTLFARHGRMSLVVKADGDLHVDSHHTVEDVGIALGQALRQALGDKVGINRYGTSFVPMDETLGMASLDLSGRSYLVFDAEFDNPKLGNFDTELVEEFFQALAFNVQMNLHLKILHGKNNHHKAESLFKATGRALREAVTINPEIKGVNSTKGML

SEQ ID NO: 16347 - protein, 184 aa, Avicennia marina
MASKESADNNPGLHTSLDEATKGYFLQQTMLRVKDPKVSLDFYSRIMGMSLLKRLDFPEMKFSLYFLGYEDTSSAPSDPVERTSWTFGQKAVLELTHNWGTESDPEFKGYHNGNSDPRGFGHIGVTVDDVHKACERFESLGVEFVKKPRDGKIMDVAFIKDPDGYWIEIFDTRTIAKSTADAAV

SEQ ID NO: 16348 - protein, 104 aa, Streptococcus mutans
MTKVVTDATFEAETAKGLVLVDFWATWCGPCLMQAPILEQLSEELDEDELKIVKLDVDENPNTAQNFGIMSIPTLLFKKDGEVVKQVAGVHTKDQIKAIVAELA

SEQ ID NO: 16349 - protein, 99 aa, Nostoc punctiforme
MATYKVTLKTPDEEKTIEVSEDDYILEIANEENDMDLPYSCNAGSCSTCAGKLISGTVDQSDQNFLDDDQIDAGWVLTCVAKPTSDCVILTNQEDELNG

SEQ ID NO: 16350 - protein, 328 aa, Cytophaga hutchinsonii
MKKIAVYTSGGDAPGMNACIRAAVRAGHYHNLEVYGIVRGYDGMINGNFIELDNRAVSNIIQKGGTILKSARSEEFRSPEGRRKAFDQIQKFGIDGLVAIGGNGTFTGAELFYNEYQIPCVGAPGTIDNDLYGSDFTIGYDTAVNTCLAAIDKIRDTADAHERVFFIEVMGRDTGYIAVRSAISGGAEMAIIPEFPYDKNVVINRLKHGTSDTKASHIIIVAEGHQEGRASMIARDIKEALPQLDCRVTTLGHVQRGGGPSAADRVLASRLGLATVEGLLEGRANVMAGIIDHKVVYTPFIDTITKRKPINEDLLSLAEKLNGRSYKV

SEQ ID NO: 16351 - protein, 689 aa, Magnaporthe grisea
MPEKGLSAQIKSRPGTVYQLYLVQRRFVSSNLQMAASMEERHDDLLMQRMPSEEDEQDFEEVDELIDPKSPEELDILGLLLLTCPSLGLQVYWFLLQSSGTPYLRSLGLDGASISIIWALGPIFGAFVQPILGSLSDEIHHPLCRRKPFMMGGSLLVMLSTLAMACAQELTPDPLATPWQPRALAVVCLVVILLALSAYSVGVRAIVVDNCPPSQQFAAAAWSMRWNVLGSATLSTVGFVAVGRHPDTDPAVTFRTLACVAAVCSAATVGLVCWFAPREATPRFRSPGSFGLRKVLSLCAPGALVRRWRRLPPLTNKVCNIQLLGWCGWFPMLYYMSSYAYETAMLEISSVQATQRGLATKSVETQAKSYPLYASLFFSFGTLSSTLVLTLVNASSCPKITLPRIWFLSQVLATASLLLTFLLCSTHASLALICFMGATWTVTMWVPFALINAELAELRTGVAGVQGLHNMAVSLPQIASALVCAAVLGALRLAGVDGGAVWLLRLAAVPVAWSAWLIWRLDGLLDAASPEQGYLVLANFYISFLKPPFRPQLHLSPCSELPHPPSPCRPQGAGPKGNYWGSPYPVYTLPGKEAQFQVPGCYHFIVKPSKDCTSYEMKKHEVTKDCPRYKDLPWEITVEPALVPPLHGPGIKIRKKAPASAKVPEPKPKGRSSSSGGKDETTSITTDQA

SEQ ID NO: 16352 - protein, 280 aa, Pseudomonas aeruginosa
MSQVNMRDMLKAGVHFGHQTRYWNPKMGKFIFGARNKIHIINLEKTLPMFNEALTFVERLAAGKNKILFVGTKRSAGKIVREEAARCGMPYVDHRWLGGMLTNYKTIRQSIKRLRDLETQSQDGTFDKLTKKEALMRSRDLEKLERSLGGIKDMGGLPDALFVIDVDHERIAITEANKLGIPVIGVVDTNSSPEGVDYVIPGNDDAIRAVQLYLNSMAEAVIRGKQALPPAPTSSSRKRRPNPPKADSGTFRRPTVRRKGLGPLFATFEFLSGRPGTKVF

SEQ ID NO: 16353 - protein, 448 aa, Staphylococcus aureus
MSHRYIPLTEKDKQEMLQTIGAKSIGELFGDVPSDILLNRDLNIAEGEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDETAAVAVQYPNFYGSIEDLKKIHSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 16354 - protein, 216 aa, Xanthomonas axonopodis
MLGIGAFKQRLPRPGEALPGREQALPLHNTHLVNGHPLRGEFTGLAQVQFGLGCFWGAERKFWNVPGVYTTAVGYAGGQTPNATYSEVCSGQTGHTEAVLVVFDDHAVSFAQLLRTFWESHDPTQGMQQGNDMGTQYRSAIYCTTQAQYDAALASRDAYQQQLTAAGYGEITTEIRFPAPTFYYAEDDHQQYLAKHPNGYCGLGGTGVSCPIGLDA

SEQ ID NO: 16355 - protein, 612 aa, Triticum aestivum
  misc_feature (466)..(466): Xaa can be any naturally occurring amino acid
MAALVTSQLATSGTVLGITDRFRRAGFQGVRPRSPADAALGMRTVGASAAPTQSRKAHRGTRRCLSMVVRATGSGGMNLVFVGAEMAPWSKTGGLGDVLGGLPPAMAANGHRVMVISPRYDQYKDAWDTSVVSEIKVVDKYERVRYFHCYKRGVDRVFVDHPCFLEKVRGKTKEKIYGPDAGTDYEDNQQRFSLLCQAALEVPRILNLDNNPYFSGPYGEDVVFVCNDWHTGLLACYLKSNYQSNGIYRAAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPAIIWXASGALNQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGVIGEEIAPLAMENVAAP

SEQ ID NO: 16356 - protein, 707 aa, Haloferax mediterranei
MPRNLRFLSVVNHVTKQVPTTCMRCAVGCGHVHLGSENAYGLETVRGDPSHPVNNGLACGRGIRESADPAGEWLTRPLVREDGELVQTSWSDAMARVGATIRTAVATDPDEVAVLGSGQQTNEAAYALGKLARAGIGTRNYDANTTLCMASAVTAYYRAFGSDAPPPTYDDIPNAETHLVWGANPAVAHPVMFRWIRQSRTDGRLVVVDPVETKTAAVADDHVSVAPGGDLALARAILRHIVDTDQIDESFVRSNTEGFDDVVSALPSVTDAAARAGVSLDTVEELAALLDAPTLIYWGMGVNQSVRGTATAGALVNLCLASGNLGPGTGPFSLTGQANSMGTRVCPRKNVSGHRPFEHPDHRRAVAEAWDVPVSRLPDDSGPGPVGILDSSPSVVWTVATNPLAGFPDATAAREVLRDSFLVVQDAFRSDTVELADVVLPAASWGESEGTPMNMERTVSRIRAATETPPGVRQDLDIIADVAARVAPGLLPRPPVSPSAIFDEFAALTEGTDADCSGISYTRLDGERAVRWPAPERNSDAGYRYYDPSTSRWRFPTPSGKARFSTLDGEPLPEPVDGDYPLTLTTGREADGYNTGVRSRSDTPEEPVARSTPRPSDTYHDAVADTDGELRTTVVSRRASVSVTLDRDDAVPPGLVWLSIHHPMTNQLTSPAVDPQSNEPNFKQCAVRFVHPDAPAKADFLAAEVSD

SEQ ID NO: 16357 - protein, 566 aa, Heliobacillus mobilis
MRILMIQPNYHCGGAEIAGNWPPSWAAYIGGTLKAAGYTNIKFIDAMTEDLPDDVLAEIIRKNQPDVVLASAITPMIYKAQDTLRVAKESNPNCKTVLGGIHPTFMYSQILSEAPWIDYIVRGEGEEIVVNLMNVIAAGTDIKDRKDVLGIAYLEDGKVVATPAHPPIKDLDSLTPDWSILDWDKYIYIPLNTRVAVPNFARGCPFTCRFCSQWKFWRTYRVRNPKKFVDEIETLVKDHKVGFFILADEEPTINRDKFVAMCQELIDRKLDVHWGINTRVTDILRDAHLLPFYRKAGLVHISLGTEAATQMNLDRFRKETTMEENKRAIDMIKANGMVAEAQFIMGLENETVETIEETFQLARYWDADMVNWNMYTPWPFSELFEELGDKVEVRDYSKYNFVTPIMQPDHMDREDVLKGVLRSYARFYMRKSFLDYPFIKDPWKRKYMMGCLKAFLKMTASKRFYDIGRVKRKGLSTEVDLGFDESKIVSKEEIAKLKTTRPDLKADMDFGTISACGAPKQVSLNNVSACGAPKDLEISACGAPRDLPSLDSQQDDNTATRGMMKI

SEQ ID NO: 16358 - protein, 530 aa, Xanthomonas axonopodis
MLDANLKTQLTAYLERVTRPIQINASIDDSAGSREMLDLLEELVLLSDKISLDIHRDDNQRKPSFALTTPGQDISLRFAGLPMGHEFTSLVLALLQVGGHPSKAAAELIEQVQHLDGDYQFETYFSLSCQNCPDVVQALNLAAVLNPRIKHVAIDGAWFQEEVEARQIMSVPTVYLNGELFDQGRMTLEQIVAKLDTNAAKRDAAKIAAKEAFDVLVVGGGPAGSAAAVYAARKGIRTGVAAERFGGQVLDTMSIENFISVPETEGPKMAAALEQHVRQYDVDIMNLQRAEQLIPAGADGLIEIKLANGASLKSKTVILSTGARWRQMNVPGEDQYKNKGVAYCPHCDGPLFKGKRVAVIGGGNSGVEAAIDLAGIVAHVTLVEFDDKLRADEVLQRKLRSLHNVRIITSAQTTEVLGDGQKVTGLVYKDRTGGDIQHIELEGVFVQIGLLPNTEFLRGTVALSPRGEVIVDDRGQTDVPGVFAAGDATTVPYKQIVIAMGEGSKAALSAFDHLIRTSAPATADSVAQAA

SEQ ID NO: 16359 - protein, 493 aa, Colwellia psychrerythraea
MSSEIGIKLWSFTGKMKILHLSWMAFFITFMVWFNHAPLLAVIADSLGLSSSEIKTLLILNVALTIPARIIIGMLTDKYGPRLTFAVLLAVCSLPCFMFALSQNFEQAALARFLLGFIGAGFVIGIRLVSEWFPANELGTAEGLYGGWGNFGSAAAAMSLPLIALYIGKTFGVEDAWRYAVALTGLMSLLFSFIWYANVSDTPKGATYFKPTQTGAMEVTSVGDFYLLLLMKLPMYGALALLTWKLSPQGVSLLSSNMTIIAYVSLVILFIAEVWKTYQVNGHLFKEEVPEIHQYQFKQVAVLNVLYFATFGSELAVVSMLPLFFAETFSLDMVYAGMLASLYAFMNLMSRPGGGWLSDKYGRKKTLLILTAGLALGYLAMALIDSSWPLVLAVITAMACSFFVQAGEGAVFAAVPLIKRRLTGQIAGMTGAYGNVGAVVYLTVLSMVSYQTFFLVIAATAVLGFVTLLFMQEPKGSITEIREDGTVELIQVK

SEQ ID NO: 16360 - protein, 403 aa, Enterococcus faecalis
MTDFEDKQVANNETMEDAMNSVQEVSVGDIVKGEVLAIEDKQVVVGIEGAGVEGVVPAKELSTLPVEDVHELVKVGDVLDLVVITSIGKDKENGSYLLSKRRLDAKKVWEEIEQDFQAGKVIEAPVTNVVKGGLVVDVGVRGFVPASMVEDHFVADFSEYKGQTLAFKIIEIEPSENRLILSHKAVVEAEKESKKEELLSSLHDGDVVEGKVARLTDFGAFIDLGGVDGLVHVSEIAHQHVGKPSDALTVGEDVQVKILSINPEEGRISLSIKETLPGPWTDIETKAAAGTVLDGTVKRLTSFGAFVEVFPGVEGLVHISQISHKHIATPHEVLHEGDQVQVKVLEVNPEEHRIALSIKALEPKPESQEEPKEEQEYELPEENTGFTMGDILGDALSDAKEEE

SEQ ID NO: 16361 - protein, 1023 aa, Oryza sativa
MRLHYHHLAVVLLAAVAAAATAAAGGEADALLAVKAALDDPTGALASWTTNTTSSPCAWSGVACNARGAVVGLDVSGRNLTGGLPGAALSGLQHLARLDLAANALSGPIPAALSRLAPFLTHLNLSNNGLNGTFPPQLSRLRALRVLDLYNNNLTGALPLEVVSMAQLRHLHLGGNFFSGGIPPEYGRWGRLQYLAVSGNELSGKIPPELGNLTSLRELYIGYFNSYSGGIPPELGNMTDLVRLDAANCGLSGEIPPELGNLANLDTLFLQVNGLAGGIPRELGKLASLSSLDLSNNALAGEIPATFADLKNLTLLNLFRNKLRGDIPEFVGDLPSLEVLQLWENNFTGGIPRRLGRNGRFQLLDLSSNRLTGTLPPDLCAGGKLETLIALGNSLFGAIPASLGKCTSLTRVRLGDNYLNGSIPEGLFELPNLTQVELQDNLISGGFPAVSGTGAPNLGQISLSNNQLTGALPAFIGSFSGVQKLLLDQNAFTGEIPPEIGRLQQLSKADLSGNSFDGGVPPEIGKCRLLTYLDLSRNNLSGEIPPAISGMRILNYLNLSRNQLDGEIPATIAAMQSLTAVDFSYNNLSGLVPATGQFSYFNATSFVGNPGLCGPYLGPCHPGAPGTDHGGRSHGGLSNSFKLLIVLGLLALSIAFAAMAILKARSLKKASEARAWKLTAFQRLEFTCDDVLDSLKEENIIGKGGAGTVYKGTMPDGEHVAVKRLPAMSRGSSHDHGFSAEIQTLGRIRHRYIVRLLGFCSNNETNLLVYEYMPNGSLGELLHGKKGGHLHWDTRYKVAVEAAKGLCYLHHDCSPPILHRDVKSNNILLDSDFEAHVADFGLAKFLQDSGTSECMSAIAGSYGYIAPEYAYTLKVDEKSDVYSFGVVLLELITGKKPVGEFGDGVDIVQWVKTMTDSNKEHVIKILDPRLSTVPVHEVMHVFYVALLCVEEQSVQRPTMREVVQILSELPKPTSKQGEEPPSGEGAVFDLVVPAESAEANEAKEQQQQQLNSPSSPPPDLISI

SEQ ID NO: 16362 - protein, 72 aa, Porphyromonas gingivalis
MSKQTAIEQDGVILEALSNAMFKVELQNGHVITAHISGKMRMHYIKILPGDKVKVEMSPYDLTKGRISFRYK

SEQ ID NO: 16363 - protein, 1084 aa, Magnaporthe grisea
MSSRTLALSRHVARIGQSHSSQVRLLSSSRSLLNRSGLDSSRQQTWGKSSQAGAVARQSCLRRYQSTSAQASGIWGEDVLRQKDFPKIHSLQDFSDRHIGPDAQEEVEMLKALDPPMESMDAFVGEVIPEDVRLSKPMGVWRKQTEQEISSNISAHCRDSPPPCFIGKGYYNTLTPEVIKRNILESPAWYTSYTPYQAEVSQGRLESLLNFQTMVSDLTGLPVANASLLDEGTAAAEAMTLSINSLPSSRVKRAGKTMLVASSMNPMTIKVMEGRAEGFGVKIEKVAIPSPEFNERLEQLGDDVVGVMIQYPDDLGGLADYRDVAKRVHDKGVLLSCATELLALTLFTPPGEWGADIAFGSSQRFGVPLGGGGPHAAFFAVSEKHKRKIPGRLVGVSKDRRGERALRLALQTREQHIRREKATSNVCTAQALPANVAAMYAVYHGPEGLKAIAEGIVRKAKYVQAALAQLGFSVAETKAIDGVVAWDTVVVDMGSRETLQKFLESTKDKFQLRELTTPGRFSITVDESTTQEDINSLLGELSSYAPNKGVSPQQFTDSFTKAVSAELPGHFKRSSPYLQHPVFNSHHSETELLRYIYHLQSKDLSLVHSMIPLGSCTMKLNGSVEMTTLSMPAWSQSHPASNDQPVWADMLSSLNDMLKKVTGMSEVTLEPNSGAQGEFAGLRAIRAYHKSRGDDKRDICLIPVSAHGTNPASAAMTGMRVVPIKCDVKTGNLDVEDLEAKCEKHRDELGAIMVTYPSTFGVFEPRIREVCDIVHRHGGQVYMDGANMNAQVGLCSPGDIGADVCHLNLHKTFCIPHGGGGPGSGPVCAKSHLGPFLPNAAVREAEIKAVSLSGSKSGEEASSFAVSSAPHGSASILPISWSYMALMGPDGLKKATEVAILNANYLLARLKPHYPILYTNDKGRCAHEFILDARPFSKTAGVEAIDIAKRLQDYGFHAPTMSWPVANTLMVEPTESESKAELDRFADALISIRAEIRDIEEGRQPKTGNVLKNSPHPLHDIIGGDGNGGAGWDRPYTREQAAYPLPWLREKKFWPTVARVDDTFGDLNLFCTCPPVVDTTGDVN

SEQ ID NO: 16364 - protein, 338 aa, Unknown
  Pseudomonas sp. ACP
MNLQRFPRYPLTFGPTPIQPLARLSKHLGGKVHLYAKREDCNSGLAFGGNKTRKLEYLIPEALAQGCDTLVSIGGIQSNQTRQVAAVAAHLGMKCVLVQENWVNYSDAVYDRVGNIQMSRILGADVRLVPDGFDIGFRRSWEDALESVRAAGGKPYAIPAGCSDHPLGGLGFVGFAEEVRAQEAELGFKFDYVVVCSVTGSTQAGMVVGFAADGRADRVIGVDASAKPAQTREQITRIARQTAEKVGLERDIMRADVVLDERFAGPEYGLPNEGTLEAIRLCARTEGMLTDPVYEGKSMHGMIEMVRNGEFPEGSRVLYAHLGGVPALNGYSFIFRDG

SEQ ID NO: 16365 - protein, 135 aa, Vibrio vulnificus
MSELTKTLLNIRSLRAFSRELTLEQLEEALDKLTTVVAERQEAEAEERAAKAEQEAKLAAIAEQIAKDGIDVEALISALAGETKVKSKSKRAPRPAKYKYVDTNGEEKTWTGQGRTPSAIQAQLDAGKSLEDFEI

SEQ ID NO: 16366 - protein, 187 aa, Unknown
  Azoarcus sp. EbN1
MTEQEMPAARETAILAGGCFWCLEAVFKDVEGVEAVTSGYTGGRVDSPSYRQVCEGGTGHAEAVRIVFDPEVIGYRDLLEIFFVIHDPTSLNRQGNDVGTQYRSAIFATTDEQLHEALALIEEMGEMRVYPSAIVTKVERAGTFWPAEDVHRDYYARNSDQSYCQYVVAPKIAKFRENFASRRKQGG

SEQ ID NO: 16367 - protein, 235 aa, Alkalilimnicola ehrlichei
MATPLRPTTPEYIQHNQQVLEDRHSDFQHIVIAEDPDYGRLLYLDDDLQISEADQPYNQAMVDPLARHGSLGRVLILGGGDGGVLREAISRGAREAILVDIDRAVIDLCRRYLPQLCGDAFDAPQARVVVDDALAWLHREDEYDGIIYDLTMEPFSPDQSRTRFIDQVLAHAGRRLRPGGTFSMQCCGANEPALREEIRQGLARRFRTWEDTTVSIPSYDVDWVFAWARHPRLGA

SEQ ID NO: 16368 - protein, 219 aa, Actinidia deliciosa
ETGRHVRMLTHEIRSTLDRHTILKTTLVELGRTLALEECALWMPTRTGLELQLSYTLRHQKPVGFTVPIQLPVINQVFSTNRAAKISPNCPVARLRPLAGKYMPGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPM

SEQ ID NO: 16369 - protein, 72 aa, Methylobacillus flagellatus
MAKEDRIEMQGEVLENLPNATFRVKLENGHVVLGYISGKMRMHYIRILPGDKVTVEMTPYDLSRARIIFRAK

SEQ ID NO: 16370 - protein, 464 aa, Salmonella typhimurium
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAAFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLILSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 16371 - protein, 589 aa, Helianthus annuus
MCGILALLGCSDDSQAKRFRVLELSRRLKHRGPDWSGLYQHGDNYLSHQRLAVIDPASGDQPLYNEDETVVVTVNGEIYNHMELREKLMGHKFKTGSDCDVIAHLYEEHGENFVDMLDGMFSFVLLGTRDNSYLVARDAIGITSLYIGWGLDGSVLISSGLKGLNDDCEHFEVFLAGHLYSSKIRGFRRWYNLPWFSESIPSTPYDPLVLRCAFENAVIKRLMTDVPFGVLLSGGLDSSLVASVTARHLAGSKAAKQWGAQLHSFCVGLEGSPDLKAAREVADYLGTLHHEFHFTVQDGIDAIEDVIYHIETYDVTTIRASTPMFLMSRKIKSLGVKMVISGEGSDEIFGGYLYFHKAPNKEEFHQETCRKIKALHQYDCLRANKSTSAWGLEARVPFLDKEFINVAMSIDPEAKMINMDQKRIEKWILRRAFDDEEKPYLPKHILYRQKEQFSDGVGYSWIDGLKSHAEQHVTNKMMLNAERIFPHNTPVTKEAYYYRMIFERFFPQNSAKLTVPGGASVACSTAKAIEWDASWSNNLDPSGRAALGVHNAAYKKNSGSISSANLAPSIADNVPRMMDITGPELVIRS

SEQ ID NO: 16372 - protein, 441 aa, Clostridium thermocellum
MPTLLMITPENLEIKRFRAYQLNNFMQLTMPYLAGFVPKEYDIRLLDEHTEPIIFEKFDLVAITVNTPNAPYAYAISKKFRELGSWVALGGPHVTLNPEEAALHCDTIFIGEAEETWPQFLNDFLCKKAQKVYTSSRAPSLAGLPIPRRDLIVGNRFISGAVFASRGCPHNCSYCSLKKIYHNTFRTRPVDEVIKDIASMPNKYFVFWDDNFFADPSYTKALLKDLAKLNKKWAAQVTAHSCEDEELLRLAKSAGCLYLFLGLESFSEQGLKDANKSFNKIEQYGKIADKLHRHGISIQAGIVFGFDSDTPDVFETTLKACNDIGIDGVTASILTPFPGTGIYDQYKNEGRLLDVGWNYYNGKTRVAYVPKQMSPEELLNGYNEFRRKFYSWKSIIKRICKSRVNIFYNLAMNYGYRQAYRNFAKLDIGDSKGMNIFEQLI

SEQ ID NO: 16373 - protein, 357 aa, Vibrio vulnificus
MSKQQKILFIDRDGTLIVEPPVDFQVDRLDKLKLEPFVIPSLLSLQDAGYRLVMVTNQDGLGTDSYPQEDFDAPHNMMMEIFESQGVKFDDVLICPHFEKDNCSCRKPKLGLVKEYLQAGKVDFQNSFVIGDRQTDLQLAENMAIRGIQYNPETMGWKQILKDLTVKARVAEVVRTTKETDIKVFVNLDEQGGNAISTGLGFFDHMLDQIATHGGFQMVCKVEGDLHIDDHHTVEDTALALGQALKEALGDKRGIGRFGFSLPMDECLAQCALDLSGRPYLKFDAQFSREQVGDLSTEMVVHFFRSLTDTLACTLHLSSAGNNDHHIIESLFKAFGRTLRQAIKVEGTELPSSKGVL

SEQ ID NO: 16374 - protein, 255 aa, Rhizobium leguminosarum
MALPDFSMRQLLEAGVHFGHQTHRWNPKMKPYIFGDRNNIHIIDLAQTVPMLSRALQVVSDTVARGGRVLFVGTKRQASEIIADSAKRSAQYYVNSRWLGGMMTNWKTISNSIQRLRKLDEILNGEAQGFTKKERLNLEREREKLDKALGGIRDMGGTPDLMFIIDTNKEKIAIDEAKRLGIPVVAIIDSNCDPDLIDYPIPGNDDASRAIALYCELISRAAIDGIARQQGSSGRDLGASSEVPVEPALEEAAEG

SEQ ID NO: 16375 - protein, 318 aa, Zea mays
MGTLVGHVAPGAGFLLIGLWQLFSHTRLFLLRPSSYSAPVWFPVPGVRHLELILIIIGTVLSILMELVIGPAKHQPFDDDGTIPSDHLHNFEHASISLALLVFAAVTIHLDRARAPMRDAVSQLVAAAAFAQQLLIFHLHSADHMGVEGQFHWLLQTAIAVTLATTLLGIPYPRSFAVSLVRSASLVFQGVWFVVMGVMLWTPALIPKGCFLNFEEGHDVVRCRTDDALDRAKSLVNLQFSWYLTGTVVFVVLFYLQMAKLYPEEPQYLPLVKGGGSGSDGRFSIGDDDHDDEDDVEAAKRGGFGHVVSGTRPVEIER

SEQ ID NO: 16376 - protein, 323 aa, Mesoplasma florum
MKRIGVLTSGGDAPGMNNAIAGVVKAAEAQGIEVYGVRDGYKGLINGWFEKLDSKFALEIISKGGTVLGSARLPEFKEESVRQKAVDQLKAHDIEALVVIGGDGSYMGAQRLTEMGINCIGLPGTIDNDIVSSDYTIGFDTALNTVIESVEKVRDTMQSHNRAAVIEVMGNGCGDLVTYAAIATQAEIFSPSESKLTVEQICEQAKKFAEANHRSLIILISEKQLDANELAKKVEEASGYVTRATILGHVQRGGRPSGMDRYLAFTAAIYAVEKLIEGKGGLYIGLSENKLVARDIESTLNMPKPDKTEFIEKIRLLNAKISK

SEQ ID NO: 16377 - protein, 436 aa, Haloferax mediterranei
MGLVKMTRWRTLVLATAAFNLSFLIWFSFAPFTGQIAAEFGLSLTDLGILASAHLVGPPGRILTGWLSDRFGASTVFGIVLAYVGIFSMASAFATSYEVFFVERVVVASAGITFVVGIQHVSQWFPEEELGTAEGIYAGIGNAGAAGGALILPRAFGNWSGPLFSTGWRAAFFYTGVVAILMAIVYVVFGQDAATKARAAATSESATLSTWVHTATRYGVVALALGYVMSFGLEISMNGWLPTYFREGFGSNLVIASTFAATFSLAAGLLRPIGGYVSDRLVRDQRDILPFFAGRYREQWTVLCMTFIVVSMTGLTFAGQTGNVLLTVAAGFLVGMSCAFTEGAIFAQVPAMFPNRSGAAAGIVGGIGTFGGIGFPLVYSFAAAEGMIHTGYVIVAALMIPILALNAFISRPHIASRAHVDGFFDGSRFESSQSDD

SEQ ID NO: 16378 - protein, 649 aa, Candida glabrata
MAPVTLDPKVTADTSRYSGVQSNSGFAYGEITFGEYVFRRLLSCGTKSVFGVPGDFNLALLEHLYDDSVADALRWVGNCNELNAAYAADGYSRYTNKIGCLITTYGVGELSALNGVAGSFAEDVKVLHIVGVASSQTSCKNTDNKNVHHLIPALNDSNFVSPNHKTYYEMVKDRVCCAAEYLEDIDVACDMLDKVIEDMYRYSKPGYLFIPADFADMMVSTRNLVARPTITLEQAIAPLVGCGESQLEAIVAKVAQLIYNSSNPCILGDVLTDRYGVSQQLNSLISHCQMWNFSTVMGKSVIDESNPYYKGLYNGRECSSSVIEDFSKCDLILHFGIERNEINNGHYTIDYNEHIGANVVEFHSDYIRFFNSKTKEEDMIRGVNFVHVLNRLQPAIQADKLSFNYQECSTTSNADSKIDSQSSNEITQEFLQDIMPQYLNPGDVLVCETGSVQFGVRDYRFPSNVKYVSQGFYLSIGMALPASLGVGIGMQDYPMSHIPNPEEIEYEPKLILFEGDGSAQMTIQELSTMLHNNVKMEIFLWNNDGYTIERAIKGPTRSYNDIAPWNWTKMFEAFGDGLGSKHKTRNQVYSTREEFLTRLREKKDTKHNDPACQIELLEVKMGVLDFPEQLKCMVSAAMYNKKKEQSMSN

SEQ ID NO: 16379 - protein, 370 aa, Arabidopsis thaliana
MASQTPNLECRMYEAKYPEVDMAVMIQVKNIADMGAYVSLLEYNNIEGMILFSELSRRRIRSVSSLIKVGRIEPVMVLRVDKEKGYIDLSKRRVSEEDIQTCEERYNKSKLVHSIMRHVAETLSIDLEDLYVNIGWPLYRRHGHAFEAFKILVTDPDSVLGPLTREIKEVGPDGQEVYTLFSGIVLAVTKVVPAVTEEVKDALVKNIRRRMTPQPMKIRADIELKCFQFDGVVHIKVEAMKNAEAAGNEDCPVKIKLVAPPLYVLTTQTLDKVRQSSILHYDLLGLEQGIEILNKAIAACTETIETHKGKLVVKEGARAVSERDEKMLTEHMAKLRLDNEEMSGDEDSGDEEEDTGMGEVDLDAGAGIIE

SEQ ID NO: 16380 - protein, 969 aa, Unknown
  Fusarium sp. IFO 7772
MALSAAGFPGALPDWTNLNILQRNNLPARAHFYSYPDQASALSFDRDQSFFHSLNGTWKFHYDPSPFDAPIWETANTTSWDDIEVPGMWQLQGYGNPHYTNIDYPFSVTPPNVSYVNPAGSYWRQFEVPEDWEGDQIRLRFEGVDSAFHVWVNGEDVGYGQGSRDPSEFDITDYLSPGKANDLAVRVYQWSDGSYIEDQDQWWLSGIFRDVYLIPFDKSSIVDYQVDSELSDSFDEGSFKVNVTIQGKEGDLAIRLLSPTGSVVDDWKRVFIRHIQKETVCQKVGLRRVEIKESNFYVNGKPIILYGVNRHEHHHLTGRTISYENMRNDLLLMKRSNINAIRTAHQPPHPDFFDVADELGFYVIAESDLECHGFRSFEDTEEKAAQWLSDNSDWEDAYVDRARQLVERFKNHVSVIIWSLGNECFYGRNHAAMSKWIKERDPSRIIHYEQDHEAKSTDMYSQMYSEPDYMREFMKNHTDKPLILCEYAHAMGNGPGGLEDYVDLFRTEPLSQGGLVWEWSNHGILKKEENVTYYAYGGDFGDVPNDGDFIMDGLVLSDHSPMPSLKEYAKIIQPISVKLAKNESAMTIINHYDFSDLNHLEASWHVVADDLKTEPRSLSLPRVPAGENRTVALPSGFKSTSKESWITVEFKLKEERLWAPKGHLIAWDQLHIQRPTSKARDTTSLARRTKLSYKSGNASFGFDLLQGNVTWNINGVDIFQRGPELTFYRALTQNDAASTGDGPIWEKEKIHMMYSQVKDITWRAEDDGAVVHYKVWVGAKTQAWGVEADMIYKIPASGPHLQLQARGEFVGRNESHVLPRIGLTAVLPESFDNVAWFGRGPGESYKDSKQGSRIGQYESTVPDLFTYYDYPQENGNREDLRWLKIGNKDVTLDTRRNKDEAFSFTARRYMPYDLDEAKHPHDLKPLNMTVLHLDYDNNGLGSATVWVRPFEKYRCYAKPFDFTFDFSVV

SEQ ID NO: 16381 - protein, 266 aa, Cryptomeria japonica
MAAMAKLSSPAFAGQMVNGDFARQLRALNVGERVNMRRGATKAPVSSSPWYGPDRVKYLGPFSGEPPSYLTGEFPVTTGGTPPVCQPDPETFAKNRELEVIHARWAMLGALGCVFPELLSRNGVKFGEAVWFKAGSQIFSEGGLDYLGNPSLVHAQSILAIWACQVILMGAVEGYRVAGGPLGEITDPLYPGGSFDPLGLADDPEAFAELKVKEIKNGRLAMFSMFGFYVQAIVTGKGPLENLADHLADPVNNNAWAYATNFVPGK

SEQ ID NO: 16382 - protein, 241 aa, Cucumis sativus
LERRMWRDKMRLKRLKEQSKVKEGIDIVKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPTGVEEWWPQLGLPKDQGPPPYKKPHDLKKAWKVGVLTAVIKHMSPDIAKIRKLVRQSKCLQDKMTAKESATWLAI

SEQ ID NO: 16383 - protein, 438 aa, Triticum aestivum
MIFQDFLQLSCLPAWNRAARPGFWRQFTVREGRSPAQAVVAQDTQTQISEVMIIIQVCSTGVDEVLMKDEFAKLSKTLVQGAATCSPPLPLTTIVVQDHVGISNVAPADCPLIPLLAPEVDQSEEGAVDKTRIHDHISNLRFSLSPTAFFQVNTLAAERLYTLAGDWANLNSDTLLFDVCCGTGTIGLTLAHRVGMVVGIEMNESAVVDAQRNALINGIKNCRFVCGKAEDVMGPLLTEYLGSPQRHIAASESNSEVNGTGKKEDIVGGAENNGKSTESLTEKNESGEINEDLDDGVSKELEGGHEQCNEVVRNQNSEEASSLVNEESVDVKAADCSEHSKTREEGSSISKNDVLAATACQFKNFVAIVDPPRAGLHPTVIKEKNKGHRGWRNMSSAGLARQRTKSMPNSEPFVPKRAMAVDLFPHTSHCEMVMLFER

SEQ ID NO: 16384 - protein, 454 aa, Zea mays
  misc_feature (56)..(56): Xaa can be any naturally occurring amino acid
  misc_feature (75)..(75): Xaa can be any naturally occurring amino acid
  misc_feature (111)..(111): Xaa can be any naturally occurring amino acid
  misc_feature (123)..(123): Xaa can be any naturally occurring amino acid
  misc_feature (147)..(147): Xaa can be any naturally occurring amino acid
MALVQFNGALVPQLGEKPRLLSSSPAIAKATYSDARFLTPKTGSRGRGKQLLSPSXSLHSQTSSEQLNHVPSSRXFRQKRGSRFYRFRAEADFYSVLGVSRNASKSEIKSXAYRKLARSYHPXDVNKDPGAEQKFKDISNAYEVLSXDDEKRSIYDKYGEAGLKGAGMGTGDYSNPFDLFESLFEGFGGMGGKGWGCRAARNRPMQGDDESYNLVLNFKEAVFGVEKEIEITRLEGCNTCDGSGAKPGTKATTCKTCGGQGQVVSSTRTPLGIFQQVSTCNTCGGTGEFSTPCNTCGGDGRVRRTKRISLKVPAGVDSGSRLRVRSEGNAGRRGGPPGDLYVFIDVLSDPVLKRDGTNILYTCKVSYIDAILGTTVKVPTVDGTVDLKIPSGTQPGTTLVMSKKGVPLLGKSNARGDQLVRVQVEIPKRLSSDEKKLIEELANLNKAQTANSRR

SEQ ID NO: 16385 - protein, 278 aa, Triticum aestivum
MSSRTCCSGLPATPRRQAGHHTLPLPAACGLALAPEFGSYGRRGRPPPLCCTSTARTRVVASCSVPRRNVVTTLLSASTLLLLGPRQITLAETTGGAFREYIDTFDGYSFIYPKGWIQVKGAGADIFFRDPVLLDVNMSVDISSPSSSAYKTVEDLGPPEKAAEGVLKQYLTEFMSTRLGVRRESNVLSASSKVADDGKLYYEVEVNIKSYASNNELAVMPKDRVQSLEWDRRYLTVLGVENNQLYALRLQTPGRLLSEEEGDLRRVMDSFRVTKIQA

SEQ ID NO: 16386 - protein, 112 aa, Caulobacter crescentus
MKLIIAVVKPFKLDEVREALVAAGVEGLTVSEVKGYGRQKGQTEIYRGAEYQVNFVPKVKLEAVVDDASAAKAVEAIKGAAATGKIGDGKVFVLNVEEAVRIRTGETGSAAL

SEQ ID NO: 16387 - protein, 75 aa, Pinus koraiensis
MKKQNLIHAEGLVTESLPNGMFRVLTDNGCQILTHISGRIRRNSVRILPGDRVKVELSAYDLTKGRIIYRLSNKS

SEQ ID NO: 16388 - protein, 242 aa, Brachypodium sylvaticum
MDAGTMGSASDAPTTGEHRMGTTIVGVCYDGGVVLAADSRTSTGMYVANRASDKISQLTDNVYVCRSGSAADTQVISDYVRYFLHQHTIQSGQPATVKVASNLVRLLAYQNKSMLQAGMIVGGWDKYEGGQIYSVPLGGTILRQPFAIGGSGSSYLYGLMDHEWKEGMTQEEAEKFVVKVVSLAIARDGASGGVVRTVTINAEGVKRSFHPGDKLPLWHEEMEPQNSLLDILAAGNPDPMDH

SEQ ID NO: 16389 - protein, 636 aa, Gibberella zeae
MGDIIPQSIPRTSRAWAVPGSTNIIPAKFPSASPKPTSSDPQEIATSVVNAFNKALQSKDYPALSQLFTDDGFWRDHLALTWSFRTVQGPSNILSFLKTSSESKNGFRLAKIGLDTTSALRKPQAIPIDGKGEVQGIQFFFTIETVLGTGLGIARLAEVDGQWKIFTFYTRINDLKGHEETVNDHRPRGVEHGGMPGRKNWAQRRAETAEFKKDDPPVLIIGAGQAGLTAAARLKMLGVEALAIDQNDRVGDNWRKRYHQLVLHDPVWYDHMPYLQFPPQWPIFTPKDKLAQFFEAYATLLELNIWMKTSLIDTKWDEATKTWTVTVERKNDDGTTEKRTLHPRHIIQATGHSGKKNMPDMKGISDFKGDRLCHSSEFSGAKENSQGKKAIVVGSCNSGHDIAQDFLEKGYHVTMVQRSTTHVVSSKAITDIGLKGVYSEDGPPVDDADLLIHGLPIPVFKALSVETTKKQAECDKDLLDGLDRAGFKVDAGPDAAGLLMKYFQRGGGYYIDVGASQLIADGKIKVKHGQEIETVLPHGLRFADGTELEADEIVFATGYQNMRTQSRTMFGDAVADKVNDVWGFNEEGEMRTIWQKSGLPGFWFHGGNLAMCRYFSKLLALQIKGLEEGLYTYDDI

SEQ ID NO: 16390 - protein, 354 aa, Amanita muscaria
MANQYHNDLLAPYLALDQGGKFHAEYVWIDGDGGLRSKTTTVDQKVTDISQLRVWDFDGSSTNQAPSGNSDVYLRPSAIFKDPFRGGENILVLSETYNNDGTPNRTNHRHHTAKVMELAKDEIPWFGIEQEYTLFDADGSPYGWPKGGFPGPQGPYYCGAGTGKVFARDLIEAHYRACLYAGVNISGINAEVMPSQWEFQVGPCEGISMGDHLWMARYLLIRVAEQWGVKVSFHPKPLQGDWNGAGAHTNYSTLAMREPGGMKYIEAAIEKLAKRHDEHIAVYGEDNEMRLTGRHETGHIGTFSSGVANRGASIRVPRHVANKGYGYLEDRRPASNIDPYRVTGIIIETTILDK

SEQ ID NO: 16391 - protein, 461 aa, Desulfovibrio desulfuricans
MKRTQILDALNASAPCDDIRICGWVRTRRDAKGFSFLELNDGSCLTNIQVIVDEETDAYRSVGEATTGASVDIRGQLVESPGKGQKWEVRAATMTLLGKADPETFPLQKKRHSDEYLRTIAHLRPRTNKFGAAFRIRAEASYAVHSFFRENGFFNVHTPILTGSDCEGAGEMFRVTTLPAVGASAPAEGSVFDGDFFGKECSLTVSGQLEAEIMAQSLGKVYTFGPTFRAENSNTPRHAAEFWMVEPEMAFADLEDDMQLAEDMVKYVISHVMKHCAADLDLFCKFVDKELSARLENILAHPFARVSYTEAIEILKASGRKFEYPAEWGADLQTEHERYLAEEHFKKPVAVYDYPKEIKAFYMRLNDDGKTVAAMDLLVPRIGELVGGSQREERLDVLEARIKELGQNPDDYWWYLELRKFGTAPHAGFGMGFERLLMLLTGIGNIRDVIPFPRTPRHLEF

SEQ ID NO: 16392 - protein, 434 aa, Pinus taeda
MERLNTAAAQASSSLYGVNMAEYGDAGVSSMMGLITQHEPEQSENIMSTRIPSSFSSFHGHADCLLSAAMFQGSQGDHKLNPQPGMNQQLVSEQSIMSDSSMPLVKTKACSGLRNQFEFHREQPGNCYTDQSSNIPLSPIVTSLASQARGEARMIPSLDANSAHFNVDNEEHAIKSKILAHPQYPSLLGAYIDCQKIGAPPEAVARLDALTREHQDPQRRTVSIGMDPELDQFMEAYCEILTKYHEELAKPFKEAMLFLKKIETQFNSLGKGTIRISSPADDDEKTEGGGSSEEVEDGSGGETDFQEVDHHAVEDRELKNHLLRKYCGYLSSLKQEFMKKKKKGKLPKDARQKLLDWWSLHDKWPYPSETEKIALAECTGLDQKQINNWFINQRKRHWKPSEDMHFMVMNSHSPHSAALYVERHMMTEGYHLDC

SEQ ID NO: 16393 - protein, 429 aa, Pinus taeda
MEHLNAAAAQASSSLYGVSMSEYGDVGVSSMMALMTQHEPHESESTMTTSMPSSFSSFHGHAECLLSAAMFQASQGDHKLKRQHGMDQLVSEQAVMSDSSMPSVKTEGCSSLRNQFEIRREQSGNCYADQSSNAPLVTSIASQAGGVAARMITSLEADSPHFNEADAIKSKILAHPQYPNLLGAYIDCQKIGAPPEVASRLDALSHEYENQQHRSSLSIGMDPELDQFMEAYCEMLTKYHEELTKPFKEAMSFLKKIEAQLNSLGKGTIRISPSAENDEKTEGGASSEEVEDGSGGETDFQEVDHHAVEDRELKDHLLRKYSGYLSSLKQEFMKKKKKGKLPKDARQKLLDWWTVHYKWPYPSETEKIALAECTGLDQKQINNWFINQRKRHWKPSEDMQLMAMDGQSPHGATMYVERHLMTEGYHLDC

SEQ ID NO: 16394 - protein, 470 aa, Pinus taeda
MEHMNTTAQSSSSLYGVHMVEYGGDVGVGSMMALMTEHHPESESIMTSIPIPSSYSSYSHGHGHGHGHGHGHGQSECLLSAAAMFQTSRPCQGSNKFEPANAHIGGGGGGGRGAGHFVMEQFIPEQAVISDSSISSVKTEVCSGSGGQFELIRRKEEGRCGRAYAEPSFVVTPLVTSLPPQQQEGRMVTSLAVDMDSSCSCKPNEADAMRAKIIAHVHYPRLVAAYIDCQKVGAPPEVVLELDDLSHKCQTQHCVPTISVGADPELDQFMEAYCEMFIKYQEELTKPFKEAMAFLKKIENQLGTLTKGTIRTSSLDQGDERGDGAASSEEEDGSGGEVEFHEVDPHAEDRELKDQLLRKYSGYLSSLKQEFLKKKKKGKLPKEARQKLLDWWTRNYKWPYPSESQKIALAESTGLDQKQINNWFINQRKRHWKPSEEMQFVVMDSPNPHNAAFFLEGHLRTDGTAFSMDC

SEQ ID NO: 16395 - protein, 315 aa, Eubacterium acidaminophilum
MENVYDLAIIGSGPAGLAAALYGARAKMKTIMIEGQKVGGQIVITHEVANYPGSVREATGPSLIERMEEQANEFGAEKVMDKIVDVDLDGKIKVIKGEKAEYKAKSVILATGAAPRLAGCPGEQELTGKGVSYCATCDADFFEDMEVFVVGGGDTAVEEAMYLAKFARKVTIVHRRDELRAAKSIQEKAFKNPKLDFMWNSAIEEIKGDGIVESAVFKNLVTGETTEYFANEEDGTFGIFVFIGYIPKSDVFKGKITLDDAGYIITDDNMKTNVDGVFAAGDIRVKSLRQVVTACADGAIAATQAEKYVEANFEE

SEQ ID NO: 16396 - protein, 709 aa, Solibacter usitatus
MLEPHTTKAVEPGSPFPLGATLVDGGVNFAIYSKQAAGVFLLLFDSADGAATDVIPLTARDKLVWHACVKGVRAGQLYGYKVSGEYRPDLGLRFNEAKLLLDPYARAVTGKFRNVDNLLLAYAAQPASADLTQDTRDNSAVVPKGIVIDDGFDWQGVGAPKSALEQLVIYEVHVKGFTAHPSSGVSAPGTYLGFIEKIPHLTRLGVNAVELMPVHEHYVDDFLVDRGLTNYWGYNTIGFFAPEVSYGSQREAGCQVAEFKTLVRELHRAGIQVILDVVYNHTAEGNEMGPSMSFRGLDNVSYYCLTGPAEAPRRYYMNYTGCGNSMNFDSPAVIRLVMDSLRYWVEAMHVDGFRFDLASVLGRGADGSFRSTSGFFDAVAQDPVLSRAILIAEPWDTGTYQLGNFPIDWSEWNGKFRDTVRCFAKSDSGQLSQMGWRLTGSADLYGSEGRSAYNSVNFVTCHDGFTLHDLVSYNGKHNEGNGENNQDGTNDNNSWNCGAEGDTTDSGILSLRRQLMRNHACYLMFACGTPMMLGGDEFARSQQGNNNAYCQDNAIGWFDWSLVERNGDLVEFFRKAIAFTRRFPVLQRRKFLLGDDLDADGVADLTWFSPDLGTPAWSDANARVLCYQLDTSDCGDTCDADRLFFILNSDFDSQWVKLPPLAAGHTWFRAIDTSLAAGEDFAENGTEVRVEPDDHYIANARSTVVLLAR

SEQ ID NO: 16397 - protein, 108 aa, Prochlorococcus marinus
MSEYNIKVKFGGKTFMFSCPEDQDIISAANMNGIDLPNSCCTGVCTSCASRILEGIVEQEDAMGLNDDLREKGFALLCVAYPKSDLHVVIGDQVEDDLYNDQFGKYQK

SEQ ID NO: 16398 - protein, 438 aa, Picea mariana
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYHLELSKPFKEARTFLNKMETQLNCLSKGAIRSFPSGYCDEREDGGGSSEEEFSCGEIEVHEVDPRAEDRELKDQLLRKYSGYFSSLKQEFLKKKKKGKLPKEARQKLLEWWNVHYKWPYPSETDKVSLAESTGLDQKQINNWFINQRKRHWKPSEDMQFVVMDSLNPHGASFYMDGADC

SEQ ID NO: 16399 - protein, 327 aa, Magnaporthe grisea
MAPPAATSPIASHAHPLDVKNGKHQHNADSAAAAAAKLHDLATDWNQFSFSPIRESQVSRAMTSRYFADLHAHAETDVVIVGAGSCGLSAAFHLATARPDLRITLVEAGVAPGGGAWLGGQLFSAMVMRKPAHLFLDRLGVAYEDEGSFVVVKHAALFTSTLLSKVLALDNVKLFNATAVEDLITRREGGDNAGVRVAGVVTNWTLVSMHHDDQSCMDPNTINAPVVISTTGHDGPFGAFSAKRLVSMKQIEQLGGMRGLDMQSAEDAIVKRTREIVPGLIIGGMELSEIDGANRMGPTFGAMVLSGVKAAEEAMAVYDTRKKQNAY

SEQ ID NO: 16400 - protein, 189 aa, Legionella pneumophila
MTIPDKIKAVYEKSTCLYTSNEVEAALDRMAIKIHETLQDKNPVIICVMVGGLVPLGNLLHRLDFPLEVDYVHATRYRGDLTGGDILWKVRPSSNLAGRTVLVVDDILDGGITLAAIINEIKAMGAAEVYSAVLVDKYRKRVPNGLQKADFVGLQVEDHYIFGYGMDYHEYLRNAPGIFIVHPDHEANK

SEQ ID NO: 16401 - protein, 156 aa, Citrus reticulata
GEFPGDYGWDTAGLSADPETFAKNREPEVIHSRWAMLGALGCVFPEILSKNGVKFGEAVWFKAGAQIFSEGGLDYLGNPNLIHAQSILAIWACQVVLMGFVEGYRIGGGPLGEGLDPLYPGGAFDPLGLADGPDQFAELKVKELKNGRLAMFSMFG

SEQ ID NO: 16402 - protein, 1241 aa, Aspergillus nidulans
MDDLQSLEHLSLISRITNELQNHLGVSDKVLAEYIIEQHLKCSSFAEFKSALEAMGGDLFPMSLMESVDRLVLTMHPRYKNKNKKDRGDEHVENGASDDMDALNALEKKARVFKGLAVPDQEPGWAEEEYMEVGNKNGLGVDEHDAKDSAMDDTFAMLEGLAGKARAKTTTITESRPVSKRKRSRSRSPEYDDYSRRRRRDRYRSRSRSRSRSPAYNKRDEDPVDEFGRSTGGRSSNDDEYRDGRSERRRRRRADEDYFRKPPPVELDDSPVLYKIYDGRVTGVKDFGAFVNLVGVRGKVDGLVHVSAMQEGTRVNHPSDLVSRGQPVKVKVISIQGSRIGLSMKEVDQETGQDLVPQKRLASGANMERLDGMPSDDRYGNLSADVPVIEESDGRSMKNRKRLTSPERWEIKQLIASGAVSAADYPDIDEEYHATLTGEGTFEEEEDIDIEVRDEEPAFLAGQTKMSLELSPIRVVKAPDGSMNRSAMAGTNLAKERRELRQQEAQDKAAEQAAGVDLNAQWQDPMASERKFAADLRSTQQTGTDEAVPEWKRVTMGKTPSFGKRTNMSIKQQRESLPVYKFRQQLLEAVAENQLLIVVGDTGSGKTTQVTQYLAEAGWANKGIIGCTQPRRVAAMSVAKRVAEEVGCKLGAEVGYTIRFEDCTSPETKIKYMTDGMLQREVLLDPDLKKYSVIMLDEAHERTIATDVLFGLLKTTLKRRPDLRLIVTSATLDADKFSEYFYGCPIFSIPGRTFPVEIMYSKEPESDYLDAALITVMQIHLTEPPGDMLLFLTGQEEIDTACEILYERMKALGPSVPELVILPVYSALPSEMQSRIFDPAPPGGRKVVIATNIAETSITIDNIYYVIDPGFVKQKAYDPKLGMDSLVVTPISQAQAKQRAGRAGRTGPGKCFRLYTEAAYQSEMLPTTIPDIQRQNLSHTILMLKAMGINDLLHFDFMDPPPTNTMLTALEELYALSALDDEGLLTRLGRKMADFPMEPALAKVLIASVDMGCSEEMLSIVAMLSIQSVFYRPKEKQQQADQKKAKFHDPHGDHLTLLNVYNAWKRSGFSNAWCYENFIQARQIRRAQDVRQQLLGIMQRYHHKIVSCGRNTTKVRQALCTGFFRNSARKDPQEGYKTLVEGTPVYMHPSSAMFGKPAEHVIYHTLVLTTKEYMHCTTGIEPKWLVEAAPTFFKVAPTDRLSKRKKAERIQPLHNRFAGEDDWRLSAQRRQGRGGGGGTWG

SEQ ID NO: 16403 - protein, 89 aa, Oryza sativa
MPSIQKALPPELADNVIRLYRECLRRARFIGHQKHNTGLIVSMVREQFKKNMHETDPEKIQKMKDDAARGLINHILYESEKMTGRKFSS

SEQ ID NO: 16404 - protein, 1044 aa, Pichia angusta
MTCSVPPLPEDISPRAAKKKLVIVGLGMVGLSFLEKLLSNDSKLNEYSIMVYGEEPYLAYNRVGLTEYFQHREFKNLLLSPEEFYQLRGEKWNYAIDEKVVDIDRRARIITTDKGNRASYDVLVLCTGSAAILPTDLLPPLTRKSYREMGCFVYRTIDDLYSMIDYCQGAKKTRAIVVGGGLLGLEAAKALYDMESFEDITIVHRSHWLLSQQMDQKGGSLLTSKVKELGITCRTGTTVSELLFDEDQNLKGVKYDNGQIEECSLLCYTIGIKPRDELTSCGLNAGSRGGFKVNNMLQTSDENIYAIGECASWNNMTFGLIAPGYEMADILAFNLTQGKLHQPKEFSEPSMGTRLKLMGVDVASFGDFFADRNGPKWLLADTTKKFVDLVFEDPIDATYTKLLFTKDGKYMLGGILVGDTSNYTKFSAMIRKPLPKSPSELLIGKSGEDDMEMLSDETQICSCHNITKGKLVEAVKNGCSSLADVKKCTKAGTACGGCEPTVKIIFEKELKKLGGKVSNNLCVHFDYSRVDLFSLIMVKNFRSFRRVMEELGNDPSSSGCEICKPTIGSILSTLYNRHLLKKEVHGLQDTNDRYLGNIQRDGTFSVVPRMSAGEITPEKLVSIGKIAKKYGVYTKITGAQRLDLFGVKKSDLLKIWKDLNEAGFESGQAYGKSLRNVKSCVGSTWCRYGIGDSVGLAVRLEERYKGIRSPHKMKGGVSGCVRDCAEFHSKDFGLCAVSGGFNIYVGGNGGMKPRHAQLLATNVRPDEVIPILDRYLMFYITTADRLQRTARWLENLDGGIEYLKDVIIRDKLGICKDLEAQMRHVVAGYYDEWAKAVSEEKENPIFKQFVNTPENQDCVEIVNERGQPRPAMWPEKAANQKFNEIRWSSVSWQEVCECSDLPLAEAGSSATVLVGDTQIALFRTSKNELYCSQNMCGHKRAFVLNQGLLSEDSDKNCYISCPMHKRNFYLKSGACKNDEALSIATFEVKEENGKVYAKLPPLKELDEVLGTSKWKVTSQETEAKQVRKITTEKNLVDKAILLDW

SEQ ID NO: 16405 - protein, 374 aa, Zea mays
MAIPLVLVVLPLGLLFLLSGLIVNTIQAILFVTIRPFSKSLYRRINRFLAELLWLQLVWVVDWWAGVKVQLHADEETYRSMGKEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDDDVSKWCKDIFVAKDALLDKHLATGTFDEEIRPIGRPVKSLLVTLFWSCLLLFGAIEFFKWTQLLSTWRGVAFTAAGMALVTGVMHVFIMFSQAERSSSAKAARNRVKKE

SEQ ID NO: 16406 - protein, 276 aa, Mesorhizobium mediterraneum
WGFDGSSTMQAEGHSSDCVLKPVAIYPDPARTNGVLVMCEVMMPDGVTPHASNKRATILDDEGAWFGFEQEYFFYKDGRPLGFPESGYPAPQGPYYAGVGYSNVGSVARQIVEEHLDLCLAAGINHEGINAEVAKGQWEFQIFGKGSKKAADQMWMARYLMQRLTEKYGIDIEYHCKPLGDTDWNGSGMHANFSTAHMREVGGKAYFEALMAAFDKNLMDHIAVYGPDNDKRLTGKHETAPWNRFSYGIADRGASIRVPHSFINNGYKGYLEDRRP

SEQ ID NO: 16407 - protein, 276 aa, Mesorhizobium tianshanense
WGFDGSSTMQAEGHSSDCVLKPVAVYPDPARTNGVLVMCEVMMPDGVTPHASNKRATILDDEGAWFGFEQEYFFYKDGRPLGFPESGYPAPQGLYYTGVGYSNVGSVARQIVEEHLDQCLAAGINHEGINAEVAKGQWEFQIFGKGSKKAADQMWMARYLMQRLTEKYGIDIEYHCKPLGDTDWNGSGMHANFSTAYMREVGGKDYFEALMAAFDKNLMDHIAVYGPDNDKRLTGKHETAPWNRFSYGIADRGASIRVPHSFINNGYKGYLEDRRP

SEQ ID NO: 16408 - protein, 309 aa, Brachypodium sylvaticum
MMARGGGGSLDLGLGLGLGLASQGSLTSSTTTASSSPGSHQQGQHWHAALSSVVAADAGAAARSEFPSSYQQQRYNQQRHQEGRTSTSPESGAALSGVSGGGGGIKRALERTGSGVSRGAAISDEDEDGDGAGAGGRKKLRLSKDQAAVLEECFKTHSTLNPKQKTALANRLGLRPRQVEVWFQNRRARTKLKQTEVDCEYMKRWCEQLADQNKRLEKEVAELRALKAASAPAAQQQSAATLTMCPSCRRVATTQQQQCHPKPNAQAAAGNVVPSHCQFFPSTAAAGDRSTRQATWNSAPPPLVTRELF

SEQ ID NO: 16409 - protein, 276 aa, Mesorhizobium ciceri
WGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLLQRLTEKYGIDIEYHCKPLGDTDWNGSGMHANFSTAYMREVGGKAYFEALMAAFDKNLMDHIAVYGPDNDKRLTGKHETAPWNRFSYGIADRGASIRVPHSFIKSDYKGYLENRRP

SEQ ID NO: 16410 - protein, 323 aa, Allium sativum
MGSDSIAQNVTELIGNTPLVYLNHVVGGCRARIAAKLEIMEPCSSVKDRIALSMINDAEEKGLITPGVSTLIEPTSGNTGIGLAFIAAAKGYKLIITMPASFSLERRIIIKAFGGQLVLTDPLLGIKGCIQKAEEIAAKTPNSYVLQQFSNPANPKIHYETTGPEIWNGSGGKIDAFVAGIGTGGTITGTGRYLKEQNPNIKVYGVEPAESAVLNGGKPGPHKIQGIGAGYIPPVLDVSLIEETLPISGDESIEMAKLLAVKEGLLVGISSGAAAVAAVRIAKRPENEGRLIVVVFPSFGERYLSSVLFESIKKEAENMIYES

SEQ ID NO: 16411 - protein, 400 aa, Arabidopsis thaliana
MKRQAKPPEKKTKRTTNASSPTPSSSSPSLSSLPDEIVENCLARISRSYYPTLSIVSKSFRSIISSTELYVARSHLRNTEECVYVCLSDKSFEFPKWFTLWVNPNQANSMVEKKRKKKKTIGKLLVPIPSSNLSPVSKSAIAVGSEIYVIGGKVDGALSSAVRILDCRSNTWRDAPSMTVARKRPFICLYDGKIYVIGGYNKLSESEPWAEVFDIKTQTWECLSDPGTEIRNCTIYRIAEIEGKIHFGYTQKTYAYDPKQGEWECCEGEVAFPRSQCVMESVLYTFANNYTWEDDYGCKWWSTDGYGEKVKGLESLLEIHKRNGGSSDNTTKLVACGGKLLLLWEGYMKHNPNNRKKIWCAVIALEKRDGGKVWGIVEWVDVVHIVPTSCKLLHCLVVSV

SEQ ID NO: 16412 - protein, 276 aa, Mesorhizobium loti
WGFDGSSTMQAEGHSSDCVLKPVAVYPDPTRTNGVLVMCEVMMPDGVTPHASNKRATILDDEGAWFGFEQEYFFYKDGRPLGFPESGYPAPQGPYYTGVGYKNVGDVARQIVEDHLDLCLAAGINHEGINAEVAKGQWEFQIFGKGSKKAADQMWIARYLLLRLTEKYRIDIEFHCKPLGDTDWNGSGMHANFSTAYMREVGGKAYFESLMAQFDKNLMDHIAVYGPDNDKRLTGKHETAPWNKFSYGIADRGASIRVPHSFVQNDYKGYGEDRRP

SEQ ID NO: 16413 - protein, 439 aa, Bacteroides thetaiotaomicron
MTILRTMRNFSSMNIAASILLFVAAIAAAIIANSPVAPVYQEFLLHELHLQIGNFNLLSHGGENLRMIEFINDGLMTIFFLLVGLEIKRELLVGELSSFRKAALPFIAACGGMLFPVIVYMSICPPGSAGSQGLAIPMATDIAFSLGVLSLLGSRVPLSLKIFLTAFAVVDDIGGILVIALFYSSHVSYGYILIAALLYVLLYFIGKRGTTNKIFFLVIGVVIWYLFLQSGIHSTISGVILAFVIPAKPRLDVGKYIEHIRHTIAGFPVVESGSIVLTNEQIAKLKEVESASDRVISPLQSLEDNLHGAVNYLILPLFAFVNAGVVFSGGGELVGSVGMAVAAGLLFGKFAGIYFFTWLAIKIKLTPMPPGMTWKNLSGIALLGGIGFTVSLFIANLSFGANYPVLLNQAKFGVLSGTILSGLLGYIVLRIVLPVRKRK

SEQ ID NO: 16414 - protein, 276 aa, Bradyrhizobium japonicum
WGFDGSSTQQAEGHSSDCVLKPVAVFPDAARTNGVLVMCEVMMPDGKTPHASNKRATILDDAGAWFGFEQEYFFYKDGRPLGFPSSGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFVNNGYKGYLEDRRP

SEQ ID NO: 16415 - protein, 323 aa, Oryza sativa
MEAEAAAKRARESGDAAAAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPAQELFEKPFFQSVARALRPGGVVCTQAESIWLHMHIIEDIVANCRQVFKGSVNYAWTTVPTYPSGVIGFMLCSTEGPTVDFQHPIFNIEDNEFSTKSKGPLKFYNSEIHSASFCLPSFAKRVIGSKAN

SEQ ID NO: 16416 - protein, 276 aa, Rhizobium tropici
WGFDGSSTMQAEGRSSDCVLKPVAIYPDPARTNGALVMCEVMMPDGVTPHPSNSRATILDDEDAWFGFEQEYFFYQDGRPLGFPESGYPAPQGPYYTGVGYKNVGDVAREIVEEHLDLCLEAGINHEGINAEVAKGQWEFQIFGKGSKKAADQIWMARYLLLRLCEKYGIDIEFHCKPLGDTDWNGSGMHCNFSTKFMREVGGKAYFEALMAQFDKNLEAHISVYGPDNHLRLTGKHETAPWNKFSYGVADRGASIRVPHSFIKNDYRGYLEDRRP

SEQ ID NO: 16417 - protein, 321 aa, Brassica napus
VRLHALRQRQPGKHFSEYAARFYAAEVLLALEYLHMLGVVYRDLKPENVLVRDDGHIMLSDFDLSLRCTVSPTLIKTFDSDPSKRGAFCVQPSCMMEPTTSCFSPRSIFSNKSKKNNKTRSKTQTDVSRSHSGSLPELVAEPNTRSMSFVGTHEYLAPEIIKGEGHGSAVDWWTFGIFVHELLYGKTPFKGSGNRATLFNVVGEQLKFPESPATSYAGRDLVQALLVKDPKNRLGTKRGATEIKQHPFFEGVNWALIRCGTPPEVPRQMEVEPPPKYGPIDPVGFGSNSKRMMGPPPVSAASVGAGGDTKAGGKFLDFEFF

SEQ ID NO: 16418 - protein, 276 aa, Rhizobium tropici
WGFDGSSTMQAEGRSSDCVLKPVAIYPDPARTNGALVMCEVMMPDGVTPHESNSRATILDDEDAWFGFEQEYFFYQDGRPLGFPESGYPAPQGPYYTGVGYKNVGDVAREIVEEHLDLCLEAGINHEGINAEVAKGQWEFQIFGKGSKKAADQIWMARYLLLRLCEKYGIDIEFHCKPLGDTDWNGSGMHCNFSTKFMREVGGKAYFEALMAQFDKNLDAHIAVYGPDNHLRLTGKHETAPWNKFSYGVADRGASIRVPHSFIKNDYKGYLEDRRP

SEQ ID NO: 16419 - protein, 276 aa, Rhizobium etli
WGFDGSSTMQAEGRSSDCVLKPVAIYPDPARTNGVLVMCEVMMPDGVTPHPSNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTDWNGSGMHCNFSTKYMREVGGKAYFEALMAQFEKNLMDHINVYGPDNDKRLTGKHETAPWNKFSYGVADRGASIRVPHSFVKNDYKGYLEDRRP

SEQ ID NO: 16420 - protein, 247 aa, Ralstonia eutropha
MSVTMREMLEAGCHFGHQTRFWNPKMAPFIFGHRNKIHIINLEKTLPMFQDALKYVRQLAANRGTIMFVGTKRQSREILAEEAGRAGMPYVDARWLGGMLTNFKTVKTSIKRLKDMEAAKEAGALDTMSKKEALMFEREMIKLEKSIGGIKEMGGIPDAIFVVDVGYHKIAVTEANKLGIPVIGVVDTNHSPEGIDYVIPGNDDSSKAVALYVRGVADAILEGRANAVQEVVEAARGGDDFVEVQEG

SEQ ID NO: 16421 - protein, 463 aa, Pasteurella multocida
MNLAETPTKSGFNRNAIIFLFDIVIFFILLNVLPFDAKANKGLALLVFIAVLWLTEALHVTVTALLVPLLAIGLGLVATKNALAAFADPTIFLFFGGFALATALHIQKLDRMIANKIMALARGKLFVASIYLFSITAFLSMWMSNTATAAMMLPLAMGVLSQMDREANHNTYVFILLGIAYSANIGGMGTLVGSPPNAIVASQLKLTFSDWLQYGLPIMLILMPLMIGTLYLVFKPKLNVRFEKHFEVIEMNKSRIITLCIFVTIALCWVFSSQINPMLSNLLGLEKKMASFDSVVALLAAVVICSTGVATWKQIQDNTDWGVLMLFGGGLTLSAVLRDSGASKILADGIVFLIEGGHFYLIGLLVAAFIIFLTEFTSNTASAALLVPIFISIAQSLGMPELGLALIIGLGASCAFMLPVATPPNAIVFGTGEIRQSEMVRVGVLLNIVCIFVIATVGYLFWL

SEQ ID NO: 16422 - protein, 131 aa, Unknown
  Synechocystis sp. PCC 6803
MFLLHTMIRVGDLDKSLQFYCDILGMNLLRKKDYPSGEFTLAFVGYGKESENAVIELTHNWGTDKYDLGNGFGHIALGVEDIYSTCDKIRDKGGKVVREPGPMKHGTTVIAFVEDPDGYKIELIQTSSKKD

SEQ ID NO: 16423 - protein, 319 aa, Geobacter metallireducens
MKKIGILTSGGDCSGMNAAIRAAVRTAIRLNIEVVGFRKGYLGLMKGDAIPLDTKAVSGILHRGGTFLQSARSPEFKTPEGQQKAIDNLKELGVEGLVVLGGDGSLTGALALHRLGLPVVGIPSSIDNDIPYTDMALGVDTALNNIIYAVDCIKDTASSHARAFVIEVMGRNSGYLASISAIATGAEFALVPEREYDLAEICQQLRARFEEGRDNAIIILAEGAGHAREISDSIKDAIGFETRITVLGHYQRGGAPTVFDRLLASRFGKRAVELLISGNSGVMVGLSCNAILATPLEDVIKGEKRPQDEVLRLAEVLGV

SEQ ID NO: 16424 - protein, 350 aa, Xanthomonas campestris
MDVAVPALPLHCTFEAADWQRLARHWHAVALSSEVSEAPFKATLLDEPLVLYRLGSELVAARDVCPHRGVPLSMGTADGGGVVCAYHGLRFGAGGRCNHIPASPSQNIPARMRLHTYAVAERYGLIWVCLAKPAGVSDADIQIPPMPGWDEDGFQQIVCPAFDIGGSAARQLEGFIDVAHFAFVHTATFAQPDKREVPAYTTTETPTGFNADYLSTVANYSVDMPLPDVAPDFQWLRHFEVHLPFTATLTIHFPVPGKRLVIMNAASPVSKHATRLLVPIARNFDTHLPVEDVHAFNLRVFEEDRAMVEAQRPEYLPLDPLLEVHIPADRSSIAYRRGLRSQGYSDFFLR

SEQ ID NO: 16425 - protein, 208 aa, Triticum aestivum
  misc_feature (42)..(42): Xaa can be any naturally occurring amino acid
  misc_feature (54)..(54): Xaa can be any naturally occurring amino acid
LSTVYSGLTGYIFGPKQITLAEPPGGHFGDKLTPFGGNPLNXPKGWIQVKRAGXKIFFRDPVLLDVNMSVDISSPSSSTYKTVEDLGPPEKAAEGVLKQYLTEFMSTRLGVRRESNVLSASSKVADDGKLYYEVEVNIKSYASNNELAVMPKDRVQSLEWDRRYLTVLGVENNQLYALRLQTPERLLSEEEGDLRRVMDSFRVNKIQA

SEQ ID NO: 16426 - protein, 102 aa, Brassica napus
VIVVVAQGLKGELRVEEKKSQWGPLFDVEDPRSKLSPYKGKFLDVNQALEVARFDIQYLDWRARQDLLTIMLLHDKVCFSHSPLLSLSKSKWILECMPLTKS

SEQ ID NO: 16427 - protein, 78 aa, Huperzia lucidula
MKKQKLIDMEGVVTESLPNTMFRVCLDNGCQVLTHVSGRMRRNYIRILPGDRVKVESSPYDLTKGRITYRFHTKSSND

SEQ ID NO: 16428 - protein, 482 aa, Unknown
  Synechocystis sp. PCC 6803
MQFNVAIMTKRTFGVIGLAVMGENLALNVESRGFPIAVFNRSPNKTEKFMAERAVGKDIKAAYTVEEFVQLLERPRKILVMVKAGGPVDAVINELKPLLEEGDMIIDGGNSLYEDTERRTKDLEATGLGFVGMGVSGGEEGALLGPSLMPGGTPAAYKELEPILTKIAAQVEDPDNPACVTFIGPGGAGHYVKMVHNGIEYGDMQLIAEAYDILKNGLGLSNEQLHEVFGQWNQTDELNSFLIEISTDIFAKKDPETGGHLIDYILDAAGQKGTGRWTVMSGLELGVPIPTIYAAVNARVMSSLKEERVAASGQLSGPSKTFSGDVEAWIPKVRDALYCSKMCSYAQGMALIAKASQEFGYDVNLPEIARIWKGGCIIRAGFLDKIKKAFKDNPQLPNLLLAPEFKQSILDRQGPWREVLMLANEMGIAVPAFSSSLDYFDSYRRAVLPQNLTQAQRDYFGAHTYERTDKPRGEFFHTEWLD

SEQ ID NO: 16429 - protein, 684 aa, Enterococcus faecalis
MEFTFLIIVFALSITFSNIFNRIVPVIPLPIVQIIVGVLIGLTKMGQEIEFEPEVFLVMIIAPLLFREGELINLKAMMKNFGMILFLAFFGVLITLVGVGWTLHMILPTLPLAACFAFGAALGPTDAVAVGSLSGRIDIPERSMNILSGEGLINDASGVTAFQFALAALLTGSFSPVEAAGTLVISSIGGAVVGIVLVLLKQQIVHLLETAVAKDVTGYLLIELLLPFIAYLISELIGVSGIIAAVIAGIMQASSLKKVSLFEAELSNVGESIWSLIEFTLNALVFLFLGIELSQVFSPIWIDQQYSNWFLLLVVLIISAVVFLIRFLAIFSVYTLQHGLKKVKNAMNEMLILTFGGVKGTVSLATIFILPTAINGEHFKERPLLLFITACVILVTLIGGILVLPFLTDSETEVENEESVEIDLLRDVIDVLKQQNEENPRGEMNAVIENYQDRLKELYTEQLSAERKQEVQELRTLIVSIERDGLEESLKQGEISVRSYRMYQRLITRMQRSIAKQLLSIVGFWLLFARQIISILLHPKLFFNRGEASEEEKELRNEELENIRQVFLRNSQVILKSLDNLRGVYDDDLIDFFIDGRLDLAHKFEKGEFIDSYIVHTETDYVKDLLLGFQEERRMIDHYEQSERISIIEANELRKNVNLLESYSISGEVNNVPLKRFVKNFNKE

SEQ ID NO: 16430 - protein, 208 aa, Oryza sativa
MTTSEREPCPDRILDDVGGAFAMGAVGGTAFHFLRGAYNSPNGHRLSGGSQAVRMSVPRTGGNFAAWGGLFSAFDCAMVHARQKEDPWNSILAGAATGAVLSLRQGPRATATSALVGASLLALVEGAGILLTRTMATLPQEDHAYPFPVVPPPEEVSAHESSPIAWVRGIFGRKEEKPAAAGGDRKSDVLESFETPSPPIPSFDYRDI

SEQ ID NO: 16431 - protein, 567 aa, Oryza sativa
  misc_feature (165)..(165): Xaa can be any naturally occurring amino acid
MASAPPVQEEPLQPGTNHFRSLLAAAVRSISWSYAIFWSISTSCPGVLTWNDGFYNGVVKTRKISNSADLTAGQLVVQRSEQLRELYYSLLSGECDHRARRPIAALSPEDLADTEWYYVVCMTYSFQPGQGLPGKSYASNASVWLRNAQSADSKTFLRSLLAKSXVCIPFTSGVLELGTTDPTFIIAYACHNMEQVLEDPKLVNRIVAYFQELQFPICLEVLMSTSPSPNETEDADIVSEGLITHNAIEEGQMVVSDECVSNANRDPITMEIDELYSIYEDLDLDMDLDLDTVRFLEDNGWPVNPSSFQLVPASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRATETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 16432 - protein, 1383 aa, Methylobacillus flagellatus
MATQVKSVCPYCGVGCGIVMEVEHARIIKVMGDKQHPSNYGRLCTKGSTCAQAVTASGRLEHAYLRTERNAEPARIGMDKAIKESARRLRAILDEHGPDAVALYVSGQMSIESQYLANKLIKGYIGSNNIESNSRLCMASAGSGYKLSLGADGPPGSYQDFDNTDLFFVIGANMADCHPILFLRMMDRVKAGARLIVVDPRRNATADKAHLFMQIKPGTDMALLNGLLHLLHKNGHTDPDFIARFTEGWEAMPEFLEDYSPEAVSEITGIPEADIRQAAEWIGKASNWMSCWTMGLNQSTHGTWHTNAICNLHLATGAICRPGSGPFSLTGQPNAMGGREMGYMGPGLPGQRSVLSAQDRAFIENLWGVPAGTLHTSSAGGTIAMFEQMAAGKIKACWIICTNPVASVANRQNVIAGLERAELVITQDAYLDTETNRYADILLPGALWAEAEGVMINSERNMTLTQQAVPPPGDAMPDWQIIASIACEMGYAEAFSYASAAEVFEEIKRTSNPKTGYDIRGVSHDRLRATPVQWPCPPDDPQDRHPIRYLNDGISQQLKIREDGERPRIAFATESGKGVFFARPWLPPAEMPDHDFPFVLNTGRLQHQWHTLTKTGKIPTLNKLNPGPFVELHPEDAASLGIRDKDQVEIRSRRGRAVLPAVITARVLPGHCFAPFHWNDVFGDDLAINAITSDAVDPLSQQPEFKFSAVALARVEGTPQRMRNAAPEGHHKDEETHTDNAREIAMKDIDALAQLLGLKDTPAIKLEPAEQLYLQGYLAGLRSDASRQAGGVPILPPTAPLPPDKKTLVDGILAGLFSRTWIGAGSLPTQGHEDTATQPVVHILWASQTGNAETFASQCAAKLQAEGWQTVLSSMDEVQPAELANASRALLLASTFGDGDPPDNGSQFWAALQSDHLTLSGLQYAVLAFGDSNYDQFCGFGRKLDARLAALGATALTARTDCEPDYETAAQVWLGQVVSALASRKSPHPSTTTDRQPELILAGDMPADMTCPGTTAPSYTRHHPLHAQLVVNQRLSGNGAEKEVRQFAFDLGGSDFQYEAGDALGVWPRNDPALVGEMLTALQFSPATVVDVHEHGEMTLVEALSNHYEIARITPEMLQFIAARSGSADLADRIGKQGELKPWLWGKQPVDLLHAYPIKVEVSEWLGVLKRLQPRLYSISSSPKTVTDQVHLTVSIVRYGERGGVCSTFLADRAKGLPVPIFLQKSPHFRVPRNPETPLIMVGPGTGIAPFRAFLQERQAAGASGKNWLFFGEQHVDTDFYYRDELAAMQQAGILHRLDTAFSRDQQEKIYVQHRMLEHGAELWRWLEQGAHFCVCGDAARMSRDVDAALKQVVQTHGNMSAEAAAQYVAKMAQDKRYVRDVY

SEQ ID NO: 16433 - protein, 130 aa, Methylobacillus flagellatus
MSQVQQTAAPGAAVQPQISSADLAGTWQHVCALEDIWPNTGVCALVEGRQIAIFRMHDDVLYAIDNHDPHSGANVLSRGIIGDLGGEPVVASPIYKQHYQLRTGICVEDAGTRLTTYPVELRNGAVWVQA

SEQ ID NO: 16434 - protein, 274 aa, Prochlorococcus marinus
MSDFLAAALQLTSTSDIDSNLNAAEEQIELAARRGADLVGLPENFAFLGEDQKKLKIASSIYEKCNSFLVTMARRYQVVLLGGGFPVPAGDGIRTLNRAELFGKDGQSLARYDKIHLFDVDLPEGNTYRESETIVSGSESPPVVDVPGLCKIGLSICYDVRFPELYRDLVNKGADLLMIPAAFTAFTGKDHWQVLLQARAIENTAYVVAPAQTGRHYGRRQSHGHAMVIDPWGTVLADAGVVQGAAIAPADKERVERIRGQMPSLKHRKTELFI

SEQ ID NO: 16435 - protein, 112 aa, Solibacter usitatus
MKKIEAIIQPFKLDEVKEALKSIGIDGMTITDVRGHGRQKGHKEVYRGQEYNVDLLPKVKLELVVPSDRADEVIKTLIQSARTGKIGDGKVFVFDIAEAIRIRNDDHGESAL

SEQ ID NO: 16436 - protein, 854 aa, Methylobacillus flagellatus
MNEYTRIVVVGNGMVGHYFVQELVKRHPDLAAAKLQVTVLGEEPRPAYDRVHLSSFFSGSTAENLSLVEPGFYDRPGLELRLNARATHIDRHQRCLSLADGTVLPYDKLVLATGSVPFVPPVPGRDREHCFVYRTIEDLEAMTAAGATAKSGVVVGGGLLGLECAKALRDMGLDTHVVEFAPRLMAVQVDDIGGRVLRTKIEELGVHVHTSRNTVNITDGATARHRMVFFDETWLETDMIVFSAGIRPRDELARESGLVIGARGGIAIDEFCRSSDHDIYAIGECANWNGQLYGLVAPGYDMARIACAHLSGDAAMTFQGADMSTKLKLMGVDVASVGDAHGETPGARSYQYLDEVRNIYKKIVVSEDGKKLLGAVLIGNADEYGTLQQMTVNDMPLPENPEFLILPASDGKEKPGLGVDALPDQAIMCSCNNVTKGQIGEAVANGACSIGEIKACTKAGTACGGCVPLVTQVMKAQMLKLGMTVNNHLCEHFPYSRQELYHLVRVGQIKTFDELLDKHGKGLGCDICKPTAASILASCWNDFILKKDLAPLQDSNDYFLGNIQKDGSYSVVPRMPGGEVTPDGLIAIGQIAKKYGLYTKVTGGARVDMFGARVEQLPQIWEELIAAGFESGHAYGKSLRTVKSCVGSTWCRYGVDDSVGLAVQLENRYKGLRAPHKIKFGVSGCTRECAEAQGKDVGVIATEHGWNLYVCGNGGMKPRHAELLASDLSKEELIRMIDRFLMFYIRTADRLQRTSTWRDNLEGGLDYLKDVIIHDSLGLGAELEAQMQHVVDTYQDEWKTAVTDPEVRKRFRSFVNSMAGDDNIVFVKEREQMRPATPQEKQQAKVIPIMALAE

SEQ ID NO: 16437 - protein, 461 aa, Unknown
  Candidatus Blochmannia floridanus
MRYLPLFVYLNNKPVLVVGGGIVAFRKVQILQKTGAIIQIVAKTLCLNLKTTLFKKKIIWIGKVFQISMLDNVFLVIIATDDTDFNDMVFKYAEKRHILVNTVDDPAKCSFIFPAIIDRSPILIGISSGGQAPVLIRMLKEKLESLIPMSIGYVASLAGIWRNKIKQHITDIVYRRFFWEKLFYNGQISLLVEKGNFRKANRVIKDAVLNQLHNRKQGSVSLVGAGPGDKGLLTIRGLQVIQTADIILYDYLVNPDILDLSRKDANKICVGKIAKKHSISQNNLNHFMIQLAQQGNNVVRLKGGDSFIFGRGGEELQAVSKAGIMFQVVPGITSGIGVAAYAGIPLTHREYAHSVVFMTGHKRHQGDYKINWSLLSDNKQTIVIYMGQLNAVNISKNLICHGRHIYTPVAIISRGTYLDQKILIGTLIELEKLIYMVKKPTLLIIGDVVSLHNEISWFGNG

SEQ ID NO: 16438 - protein, 129 aa, Zea mays
MRQARPYSGIFCGGVSARTGPHALPLARIKKIMKRSAGEAAAAADGGARMISCEAPVVFSKACELFVAELTRRAWAATLDGKRRTVHREDVATAVHNTDLFDFLVDVVTADTAGGTGGGGGGHDGDGPL

SEQ ID NO: 16439 - protein, 296 aa, Lyngbya aestuarii
NSRLCMSSAVSGYIQSFGTDGPPCCYDDLEQTDCAFLIGTNTAECHPIIFNRLRVYHKKNKSVKMIVVDPRCTQTAEAADLHLAIKPGTDIDLLNGIAHLLMKWGLFDSLFIDDCTQGFPEYAEIIRHYKPELVARKCGIRLDDLEKAARWWGESNRVLSLWSMGMNQSSEGTAKVRTLINLHLMTGNIGKPGAGPFSLTGQPNAMGGREAGGLAHILPGYRVVKNPQHRAEVEEFWGLKPGSISPHPGLAAWDMILGLEQNKVGLLWIAATNPAVSMPDLERTKAAYRKSPFTVY

SEQ ID NO: 16440 - protein, 277 aa, Methylobacillus flagellatus
MRQRNSGQRQVGQSRQFLTKYCWHRHTMAGKVYLIGAGPGDPELMTLKAVKAMQQAEVVLVDDLVNRDILRHAPHARVIEVGKRGGCKSTPQHFINRLMAALAEQGQTVVRLKGGDPFLFGRGGEEMLELRAAGIEVEVIPGVTSGIAVPATLGIPVTHRAYTHGVSFVTGHLQDGESGQNWQALAQSGTTLVIYMGMKHLASITRELLAAGMAPDTPAAAIQHGSLPQQRHITSTLSLLATAVQQAGLASPAIIVVGDVVRLAHGKALLQSISIAA

SEQ ID NO: 16441 - protein, 381 aa, Cryptococcus neoformans
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLDDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGM

SEQ ID NO: 16442 - protein, 340 aa, Ustilago maydis
MPLFKSSDIPDLTGRVAIVTGGNSGLGEVSCLELARNGAKVYMASRTESKAQEAIQKIKQAIPKADIHFLQLNLTELAAVRKAAEDFLSREQRLDILLNNAGVMATPYTFTKDGIELQVGTNVVGHYLFTMLLLPTLYKTSKLPEYSAPDSPSVRIVQVSSLGHVASPSDTSFKDLEAVNKQHWPEVKGTWDRYGKSKLGNILIANELSKLLPKDARITSLSIHPGVVRTGLLRGPNESYGKIIGSVNSLLSRFFTAAEDGALTQLYACTSPEVDRLNLNGAYLVPVAKLGQKSKLAQDTDGRLGQELFSFCNSFIKEKLDLDLPAHLKEIGVQLPQSHL

SEQ ID NO: 16443 - protein, 276 aa, Rhizobium leguminosarum
WGFDGSSTQQAEGRSSDCVLKPVAIYPDPARTNGALVMCEVMMPDGVTPHASNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTDWNGSGMHCNFSTKYMREIGGKAYFEALMAQFEKNLMDHINVYGPDNDKRLTGKHETAPWNKFSYGVADRGASIRVPHSFVKNDYKGYLEDRRP

SEQ ID NO: 16444 - protein, 276 aa, Rhizobium galegae
WGFDGSSTMQAEGRSSDCVLKPVALYPDPARTNGALVMCEVMMPDGVTPHATNARATILDDEDAWFGFEQEYFFYQNGRPLGFPEQGYPAPQGPYYTGVGYSNVGDVAREIVEEHLDLCLEAGINHEGINAEVAKGQWEFQVFGKGSKKAADQIWMARYLLQRLTEKYGIDIEYHCKPLGDTDWNGSGMHCNFSTKYMREVGGKDYFEALMAAFDKNLMDHIAVYGPDNDKRLTGKHETAPWNKFSYGVADRGASIRVPHSFVKNDYKGYLEDRRP

SEQ ID NO: 16445 - protein, 584 aa, Oryza sativa
MGRRPARCYRQIKNKPYPKSRYCRGVPDPKIRIYDVGMKKKGVDEFSHCVHLVSWEKENVTSEALEAARIACNKYMTKSAGKDAFHLRVRVHPFHVLRINKMLSCAGADRLQTGMRGAFGKPQGTCARVDIGQVLLSVRCKPNNAVHASEALRRAKFKFPGRQKIIESRKWGFTKFSRDEYVRLKSEGRIMPDGVNAKSFSPMGHVEEASGSDDDGVELLSVSWNQDNSCFIAATTNGFRVFSCKPFHETMRRMFGPNGGIGIAEMLFRTSIFGLAGAESNTEFPPTMLQLWDDYNERRIHKYNFTSEIRAVRLSKDYFVVVLEKTINVYRFKDLRLFYQARTVSNPNGLCCLSHHANASVFACPGTSKGQVLIEHFGLKETRFIAAHDSPLSCMTMALDGTLLATASVRGTLIRIFNTRDGTCVQEVRRGLDRAEIYSIALSPNVQWLAVSSDKGTVHVFSLRVKDAEEDAKKGESATAGAQVNDNCNYGSTVPVTQTKIGSNTSSSLSFMKGILPKYFSSEWSFAQFRLPEITRYIMAFGDQDTVMMIGLDGSFYRYSFDPVNGGEMMLKEYHLFLKASKSL

SEQ ID NO: 16446 - protein, 296 aa, Gloeothece membranacea
NSRLCMSSAVAGYVQSFGSDGPPCRYDDLELTDCAFLIGTNTAECHPIVFNRLHKHIKKNRKAKLIVVDPRTTKTAEAADLHLAIKPGTDIDLLNGIAHLLMRWGKIDTYFIDECTQGFPEYAEVIRQHPPELVARKCNIRIDKLEEAAKYWAESERVLSLWSMGVNQSSEGTAKVRTIINLHLMTANIGKPGAGPFSLTGQPNAMGGREAGGLSHILPGYRLVKNPSHRTQLEQLWGLQPGQISPYPGRDCWSMITGLETGEVGLLWVAATNPAVSMPDLVRTKAALLKSPLTVY

SEQ ID NO: 16447 - protein, 276 aa, Mesorhizobium huakuii
WGFDGSSTMQAEGRSSDCVLKPVALYPDPARTNGILVMCEVMMPDGVTPHESNSRATILDDEDAWFGFEQEYFFYKDGRPLGFPESGYPAPQGPYYTGVGYKNVGDVARKIVEEHLDQCLAAGINHEGINAEVAKGQWEFQIFGKGSKKAADQIWMARYLLLRLTETYGIDIEFHCKPLGDTDWNGSGMHCNFSTKFMREVGGKAYFEALMAQFDKNLMDHIAVYGPDNDKRLTGKHETAPWNKFSYGVADRGASIRVPHSFVKNDYKGYLEDRRP

SEQ ID NO: 16448 - protein, 65 aa, Brassica napus
FQEPCLDRFLNNIGGPFGLGAVGGGAFNLIKGTYNFPKGSRFLGGGQAVTMNAPGLEGSFAVWGG

SEQ ID NO: 16449 - protein, 276 aa, Sinorhizobium saheli
WGFDGSSTNQAEGRSSDCVLKPVAVYPDPVRTNGVLVMCEVMMPDGKTPHPSNSRATILDDEGAWFGFEQEYFFYKDGRPLGFPEQGYPAPQGPYYTGVGYKNVGNIARQIVEEHLDICLAAGINHEGINAEVAKGQWEFQVFGKGSKKAADEVWMARYLLQRLTEKYGIDIEWHCKPLGDTDWNGSGMHCNFSTAYMREVGGKDYFEALMAAFDKNLHEHIAVYGPDNHLRLTGKHETAPWNKFSYGVADRGASIRVPHSFVNNGYRGYLEDRRP

SEQ ID NO: 16450 - protein, 485 aa, Taxus wallichiana
MDALKQLEVSPSILFVTLAVMVGIILFFRSKRHSSVKLPPGNLGFPLVGETLQFVRTLGSSTPQQFIEERMSKFGDVFKTSIIGHPTVVLCGPAGNRLVLSNENKLVQMSWPSSMMKLIGEDCLGGKTGEQHRIVRAALTRFLGPQALQNHFAKMSSGIQRHINEKWRGKDEVTVLPLVKDLVFSVASRLFFGITEEHLQEQLHNLLEVILVGSFSVPLNIPGFSYHKAMQARATLVDIMTSLIEKRRNELRAGTASENQDLLSVLLTFTDERGNSLADKEILDNFSMLLHGSYDSTNSPLTMLIKVLASHPESYEKVAQEQFGILSTKMEGDEIAWKDLKEMKYSWQVAQETLRMFPPIFGTFRKAITDIHYNGYTIPKGWKLLWTTYSTHTKEGYFKGADQFKPSRFEEEGKHVTPYTYLPFGGGMRGCPGWEFAKMETLLFLHHFVKALSGLKAIDPNEKLSGKPLPPLPVNGLPIKLYSRS

SEQ ID NO: 16451 - protein, 296 aa, Gloeothece membranacea
NSRLCMSSAVAGYVQSFGSDGPPCCYDDLELTDCAFLIGTNTAECHPIVFNRLHKHIKKNRKAKLIVVDPRTTKTAEAADLHLAIKPGTDIDLLNGIAHLLMRWGKIDTYFIDECTQGFPEYAEVIRQHPPELVARKCNIRIDKLEEAAKYWAEPERVLSLWSMGVNQSSEGTAKVRTIINLHLMTANIGKPGAGPFSLTGQPNAMGGREAGGLSHILPGYRLVKNPSHRTQLEQLWGLQPGQISPYPGRDCWSMITGLETGEVGLLWVAATNPAVSMPDLVRTKAALLKSPLTVY

SEQ ID NO: 16452 - protein, 276 aa, Sinorhizobium terangae
WGFDGSSTMQAEGRSSDCVLKPVAVYPDPVRTNGVLVMCEVMMPDGKTPHPSNSRATILDDEGAWFGFEQEYFFYKNGRPLGFPEQGYPAPQGPYYTGVGYKNVGDIARQIVEDHLDICLAAGINHEGINAEVAKGQWEFQIFGKGSKKAADEVWLARYLLQRLTEKYGIDIEWHCKPLGDTDWNGSGMHCNFSTAYMREVGGKEYFEALMAAFEKNLHEHIAVYGPDNHMRLTGKHETAPWNKFSYGVADRGASIRVPHSFVNNGYRGYLEDRRP

SEQ ID NO: 16453 - protein, 454 aa, Bacteroides thetaiotaomicron
MAAEGKAIAKVNDLVIFVPYVVPGDVVDLQIKRKKNKYAEAEAVKFHELSPVRAVPFCQHYGVCGGCKWQVLPYSEQIRYKQKQVEDNLRRIGKIELPEISPILGSAKTEFYRNKLEFTFSNKRWLTNDEVRQDVKYDQMNAVGFHIPGAFDKVLAIEKCWLQDDISNRIRNAVRDYAYEHDYSFINLRTQEGMLRNLIIRTSSTGELMVIVICKITEDHEMELFKQLLQFIADSFPEITSLLYIINNKCNDTINDLDVHVFKGKDHMFEEMEGLRFKVGPKSFYQTNSEQAYNLYKIAREFAGLTGKELVYDLYTGTGTIANFVSRQARQVIGIEYVPEAIEDAKVNAEINEIKNALFYAGDMKDMLTQEFINQHGRPDVIITDPPRAGMHQDVVDVILFAEPKRIVYVSCNPATQARDLQLLDGKYKVKAVQPVDMFPHTHHVENVVLLELR

SEQ ID NO: 16454 - protein, 746 aa, Unknown
  Nostoc sp. PCC 7120
MTESTKTLCPYCGVGCGLEVTPPAQLNKATNRDSQGNPTWRVRGDKAHPSSQGMVCVKGATIAESLDKNRLHYPMVRESLDQEFRRVSWDEAFDLITKRIQSVRFTQGAEAICMYGSGQFQTEDYYIAQKLMKGCLGSNNFDANSRLCMSSAVSGYIQSFGADGPPCCYEDLELTDCAFLIGTNTAECHPIVFNRLEKYHRKNHKVKMIVVDPRRTPTAEAADLHLAIKPGTDIDLLNGIAHLLMRWNMIDVGFIDDCTRNFSAYAEVIRHYSPEVVARQCGITIEDLETASRYWGESQRVLSLWSMGVNQSSEGTAKVRTIINLHLMTGQVGKPGAGPFSLTGQPNAMGGREAGGLAHLLPGYRLVKNPQHRAELEAFWGFQPGQISPHPGLTAWDMITGLEDGNVGLLWIAATNPAVSMPDLERTKKALLRSPFTIYQDAYHPTETTAYAHVLLPAAQWGEKTGIMTNSERRVTLCQAFRQPPREAKPDWEIFAEVGRRLGFEDKFAFTNSAQVYAEFTQLTKGRPCDMSGISHQQLQAQGPTQWPHSSINIETQKPTQHPTVNSQQSTVTSQQSKRLYTDLRFHTPDGRARFGAYYSKGLAEPPDPSYPFVLTTGRLYGHWHTQTRTGRIEKIRAMHPEPFIEIHPRDAAKLGITDNVVVEVRSRRGSAKFPAKVTKAISPGTVFVPMHWGKLWADDAEANALTHSESCPDSLQPELKACAVQLIPISVENTAQNYQLQSSQW

SEQ ID NO: 16455 - protein, 276 aa, Sinorhizobium fredii
WGFDGSSTNQAEGRSSDCVLKPVAVYPDPVRTNGVLVMCEVMMPDGKTPHPSNSRATILDDEGAWFGFEQEYFFYKNGRPLGFPEQGYPAPQGPYYTGVGYSNVGDVARKIVEEHLDICLAAGINHEGINAEVAKGQWEFQVFGKGSKKAADEVWMARYLLQRLTEKYGIDVEYHCKPLGDTDWNGSGMHCNFSTAYMREVGGKDYFEALMAAFDKNLQEHIDVYGPDNHLRLTGKHETAPWNKFSYGVADRGASIRVPHSFVNNGYKGYLEDRRP

SEQ ID NO: 16456 - protein, 271 aa, Unknown
  uncultured bacterium
NSRLCMSSAVAGYTRSLGSDGPPCCYDDLDHCSVAFLIGTNTAECHPVLFQRLLKRKKRNPGSVTIVVVDPRRTDTAKAADIHLPIAPGSDLALLHGTAHLVLRENGQDPAFIDDHTENYEAFFDVVARWTPRRVARFYNLPEKRLREVAQLFHRRENVLSLWSMGVNQRQEGTAVVCGLINLHLLTGQIGKEGAGPFSLTGQPNAMGGREAGGLSHLLPGYRLVTNDQHRQDVEQAWKFPAGSIAATPGLAAWQQIEAMERCEIDRWWVA

SEQ ID NO: 16457 - protein, 276 aa, Sinorhizobium medicae
WGFDGSSTLQAEGRSSDCVLKPVAVYPDPVRTNGALVMCEVMMPDGKTPHASNTRATVLDDEGAWFGFEQEYFFYKNGRPLGFPEQGYPAPQGPYYTGVGYKNVGDVARQIVEEHLDICLAAGINHEGINAEVAKGQWEFQIFGKGSKKAADEVWLARYLLLRLTEKYGIDVEFHCKPLGDTDWNGSGMHANFSTAYLREVGGQDYFEALMAAFEKNLHDHINVYGPDNHLRLTGKHETAPWDKFSYGVADRGASIRVPHSFINNGYQGYLEDRRP

SEQ ID NO: 16458 - protein, 520 aa, Staphylococcus aureus
MAYFNQHQSMISKRYLTFFSKSKKKKPFSAGQLIGLILGPLLFLLTLLFFHPQDLPWKGVYVLAITLWIATWWITEAIPIAATSLLPIVLLPLGHILTPEQVSSEYGNDIIFLFLGGFILAIAMERWNLHTRVALTIINLIGASTSKILLGFMVATGFLSMFVSNTAAVMIMIPIGLAIIKEAHDLQEANTNQTSIQKFEKSLVLAIGYAGTIGGLGTLIGTPPLIILKGQYMQHFGHEISFAKWMIVGIPTVIVLLGITWLYLRYVAFRHDLKYLPGGQTLIKQKLDELGKMKYEEKVVQTIFVLASLLWITREFLLKKWEVTSSVADGTIAIFISILLFIIPAKNTEKHRRIIDWEVAKELPWGVLILFGGGLALAKGISESGLAKWLGEQLKSLNGVSPILIVIVITIFVLFLTEVTSNTATATMILPILATLSVAVGVHPLLLMAPAAMAANCAYMLPVGTPPNAIIFGSGKISIKQMASVGFWVNLISAIIIILVVYYVMPIVLGIDINQPLPLK

SEQ ID NO: 16459 - protein, 91 aa, Triticum aestivum
  misc_feature (61)..(61): Xaa can be any naturally occurring amino acid
  misc_feature (83)..(83): Xaa can be any naturally occurring amino acid
RAEFGTSETAAYILMQRIFPPASPSYLVREGTFVRDNVVSEFGIFGAYLRNNDKVIINDQXCGYLLRTKAASLNEGGWFLGYXFLNNIFLT

SEQ ID NO: 16460 - protein, 276 aa, Sinorhizobium meliloti
WGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKKAADEVWLARYLLLRLTEKYGIDVEFHCKPLGDTDWNGSGMHANFSTAYLREVGGKDYFEALMAAFEKNLHDHINVYGPDNHLRLTGKHETAPWDKFSYGVADRGASIRVPHSFVNNGYRGYLEDRRP

SEQ ID NO: 16461 - protein, 78 aa, Glycine max
  misc_feature (8)..(8): Xaa can be any naturally occurring amino acid
  misc_feature (42)..(42): Xaa can be any naturally occurring amino acid
  misc_feature (65)..(65): Xaa can be any naturally occurring amino acid
  misc_feature (74)..(74): Xaa can be any naturally occurring amino acid
FERFFPQXSARLSVPGGPSVACSTAKAVEWDAAWSNNLDPSXRAALGVHASAYGNQVKAVEPEKXIHTMEVSPXGVAI

SEQ ID NO: 16462 - protein, 432 aa, Glycine max
MAQILAPSTQWQMRISKSSPNASPITSNMWSSLLWKQNKKVSPTSSAKFRVMAIKSDNSIINRLEGLLNLDITPFTDKIIAEYIWIGGTGIDVRSKSRTISKPVEHPSELPKWNYDGSSTGQAPGDDSEVILYPQAIFKDPFRGGNNILVICDSYTPQGEPIPTNKRHRAAEIFSNPKVQAEVPWYGIEQEYTLLQTNVKWPLGWPVGGYPGPQGPYYCSAGADKSFGRDISDAHYKACLYAGINISGTIGEVMPGQWEYQVGPSVGIEAGDHIWASRYILERITEQAGVVLSLDPKPIEGDWNGAGCHTNYSTKSMREDGGFEVIKKAILNLSLRHKDHISAYGEGNERRLTGKHETASINTFSWGVANRGCSIRVGRDTEKNGKGYLEDRRPTSNMDPYVATSLLAETTLLWEPTLEAEALAAQKLALKV

SEQ ID NO: 16463 - protein, 230 aa, Oryza sativa
MQEAGRRPAPQFAGVDLRRPKGYPAAAQLTPAAEEAAAGVGDPCPRCESRDTKFCYYNNYNTSQPRHFCKSCRRYWTKGGSLRNVPVGGGSRKSSTSSSSAAAAAASSSSSPSSPAKSPKRSKNSKRRRVSPPPPQPVPAPPPPTTADAADVAAPTAPEATTKKAPEDLTAAAATQPAVALGLGVADGGGGGKEHLDTSPFEWPSGCDLGPYWPTGVFADTDPSLFLNLP

SEQ ID NO: 16464 - protein, 160 aa, Bacillus thuringiensis
MTVYDFSAKTIIGEEKSLKDYEGKVLLIVNVASKCGFTPQYKGLQEVYDKYKEQGLEILGFPCNQFGGQEPGTEVDITSFCELNYGVNFPMFAKIDVKGDKAHPLYTYMTEQAPGLLGMKAVKWNFTKFLIGKDGKVVGRFAPQTKPVDLEVEIEKVLGE

SEQ ID NO: 16465 - protein, 673 aa, Methanocaldococcus jannaschii
  misc_feature (131)..(131): Xaa can be any naturally occurring amino acid
MEFKIVNTICPYCGVGCGLGLVVKDGRVIGIHPNKRHPINEGKLCAKGNYCYQFIHSKDRLTKPLIKKESGFVETTWNKALEVIAENLKTYKDEIGFFSSARCTNEDNYILQKFARVALKTNNIDHCARLXHSATVTGMSACFGSGAMTNSIEDIELADCILIIGSNTFEQHPLIARRIMRAKDKGAKIIVIDPRRTITAKNSDIYLQIIPGTNVALINAMINVIIKENLIDKEFIKNRTEGFEKLKEIIKKYTPEYASKICGVDKELIIESAKIYGNAERASIIYCMGVTQFTHGVDAVKALCNLAMITGNIGKEGTGVNPLRGQNNVQGACDMGALPNVFPGYQKVEDGYKLFEEYWKTDLNPNSGLTIPEMIDESGKNIKFLYIMGENPIVSDPDVKHVEKALKSLDFLVVQDIFLTETAKLADVVLPAACWAEKDGTFTNTERRVQLIRKAVNPPGEALEDWIIIKKLAEKLGYGDKFNYNKVEDIFNEIRKVTPQYRGITYKRLKIDGIHWPCLDENHSGTKILHKDKFLTDNGRGKIFPVEYREVAELPDKDYPFILTTGRIIFHYHTGTMTRRCKNLVEEINEPFIEINPDDAKSLKIENGDLVKVISRRGEITAKARITEDIKKGVVFMPFHFVEANPNVLTNTALDELCKIPELKVCAVKIERI

SEQ ID NO: 16466 - protein, 426 aa, Arabidopsis thaliana
MVRDIEDEIRDEKNPRPLDEDDIALLKTYGLGPYSAPIKKVEKEIKDLAKKINDLCGIKESDTGLAPPSQWDLVSDKQMMQEEQPLQVARCTKIISPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 16467 - protein, 466 aa, Oceanicola granulosus
MTNATLGLYGLGTMGSALALNILDNGYPLHVSNRTDKVVDDFVAEAGPLAEKLTPARSLVAMAQAMEAPRAIILMVPAGRPVDESIAELVPHLEHGDVIVDAGNADFNDTMRRTRELEAQGLAFLGMGVSGGEEGARRGPSIMVGGTEAVWEGLREVIEAIAAKFEGDPCAARLGPDGAGHFVKTVHNGIEYADMQLIAETYGLMRYGRGMAPARIGEVFAGWNKGRLQSYLVEITAEVLAATDRETGAPALDDILDRAGQKGTGRWTVIEALRMGQSASAIEAAVAARSWSAEKPTREAGAVLLGFTRGAVELTDAELEAALLAGRIVAYAQGFRILRAASDEFGWSLDFARVAEIWRAGCIIRSSLLDDISGAFRGDLPEGQLIFAPAFAQMLQQSAPALRKVVAAAALAGHAAPAFSGALAFLDTMSTARGTTDLIQGQRDFFGRHGFERLDGRAGQHGPWWD

SEQ ID NO: 16468 - protein, 112 aa, Prochlorococcus marinus
MKKIEAIIRPFKLEDVKIALVNSGIVGMTVSEVRGFGRQKGQVERYRGSEFTVEFLQKLKVEVVVEDEKVNSVIDAIAEAAKTGEIGDGKIFITSIDSVVRIRTGDKDEEAL

SEQ ID NO: 16469 - protein, 464 aa, Arabidopsis thaliana
MIIRDIMEDPENEGPHNMRSDFEPLLSVLRLRDYETGDIIEFDSTEASEEALSDITEFGSTEASEAHFEEPYSARIKKVEKEINELAEKICNLGIKESDTGLAPPNQWDLVSDKQMMQEEQPLLVATCTQIISPNTEDAKYVVDIKKIGKYVVGLGDKASPTDIEAGMRVGVDQKKYQIQIPLPPKIDPSVTMMTVEEKPDATYSDIGGCKEQIEKIREVVELPMLHPEKFVRLGIDPPKGVLCYGPPGSGKTLVARAVANRTGACFIRVVGSELVQKYIGEGARMVRELFQMARSKKACILFFDEIDAIGGARFDDGVGSDNEVQRTMLEILYQLDGFDARGNIKVLMATNRPDILDPALLRPGRLDRKVEFCLPDLEGRTQIFKIHTRTMSCERDIRFELLAGLCPNSTGADIRSVCIEAGMYAIGARRKSVTEKDFLDAVNKVVKGYQKFSATPKYMAYYI

SEQ ID NO: 16470 - protein, 801 aa, Cryptococcus neoformans
MSPPQGKGVPVPNLGLKHESKKKGHVMQSSLELVFSYSRSQQMHYGSRSAPSFLDDSSFRGDQFDVDDYDEDQNYNDIYDGIERTGEEQFEGRDLSGRLEDLKMAGAISEGNEDGSTQEELGQDSHITRRSSDEPAFFHSDSVPISPISQLQPSVNQGAKVNTLLPDGIGPIQGLFLAAMPSPRLAPVLPHPGSLDTSFCTEAGPSSNPRTSKRWNSHTRGDSNPMEIRESAALVSSSPQYHGKGKSAENRPLLDGRPTEGYASIQSQKEIRRKSNRRKRSEDGQSTEGQTLFNATAVLVGIGLLSLPLAFAYAGWIGGTIMLLGFGWLTCYTAKLLARLIRADGRMMGYTDIGLRAFGSWAGAGINLLVHFIVSSCNDGILTTGSSVALVLLFGDTLNVLYPSIPSNVWKLVGFFIIVPTVLLPLRLLSLPSLLSSISSFFLIIVLLVDGILPSPEPSSASTGSLLHPSPTSLSPEWSRGNWLGGIGLILAGFGGHAVMPSLARDMKRPEKFDGIVNWAFAIATGISFTAGAAGYLMFGETVSDEVTKDLMREKYHYPRILNIVALWMIVINPLTKFGLSSRPLNLTIEGILRISPSPPPSLFSPFDGGLESALGSGAPETSQVNFPKRRDRSSFSTHNDPRTSRRPSALTSPSNSRPFPQSQSQIVAFEQYVSKERKKRWLRMVSRVVITALCVGVAVVLPGFGRVMAFLGSFSAFMICIILPLLFYIRLSPTLLPTCPPSPHSLTFLPTARSQPMSKWASEKFTNAIHWVLVIASTALMIAGTIWAFLPGSGHDELET

SEQ ID NO: 16471 - protein, 510 aa, Pisum sativum
MASGCVSLKTNTHFPNSKKGSFFGERIKGSLKNSSWVTTQKKIKPASFSAILTSDDPKGSLNLQVPSFLRLRADPKNVISIVLGGGPGTHLYPLTKRAATPAVPVGGCYRLIDIPMSNCINSGINKIFVLTQFNSASLNRHIARTYFGNGVNFGDGFVEVLAATQTPGEAGKKWFQGTADAVRQFTWIFEDAKNINVENVLILAGDHLYRMDYMDLLQSHVDRNADITVSCAAVGDNRASDYGLVKVDDRGNIIQFSEKPKGADLKAMQVDTSRLGLSPQDALKSPYIASMGVYVFKKDVLLKLLKWRYPTSNDFGSEIIPSAIREHNVQAYFFGDYWEDIGTIKSFYDANLALTEESPKFEFYDPKTPIFTSPGFLPPTKIDNSRVVDAIISHGCFLRDCTIQHSIVGERSRLDYGVELQDTVMMGADYYQTESEIASLLAEGKVPIGIGRNTKIKNCIIDKNAKIGKEVVIANKEGVQEADRSEDGFYIRSGITIIMEKATIEDGTVI

SEQ ID NO: 16472 - protein, 73 aa, Fusobacterium nucleatum
MSKKDVIELEGTIVEALPNAMFKVELENGHTILGHISGKMRMNYIKILPGDGVTVQISPYDLSRGRIVYRKKN

SEQ ID NO: 16473 - protein, 410 aa, Arabidopsis thaliana
MLSSIKPSSSSFSTAISGSVRRSIPTKLKFSPLLIIKNCHNQSFNANVVSHQKPLHISSASNFKREVKVEAYEADRSRPLDINIELPDEQSAQKLKIGIYFATWWALNVVFNIYNKKVLNAFPYPWLTSTLSLACGSLMMLVSWATRIADAPKTDLEFWKTLFPVAVAHTIGHVAATVSMSKVAVSFTHIIKSGEPAFSVLVSRFFMGETFPLPVYLSLLPIIGGCALAAITELNFNITGFMGAMISNLAFVFRNIFSKKGMKGKSVSGMNYYACLSMMSLVILTPFSIAVEGPQMWAAGWQNAVSQVGPNFVWWVVAQSVFYHLYNQVSYMSLDQISPLTFSIGNTMKRISVIVASIIIFHTPIQPVNALGAAIAIFGTFLYSQVNKQTYSCLPTSSTWFFSEQFLVLI

SEQ ID NO: 16474 - protein, 590 aa, Oryza sativa
MGRGGSRAACAAAAPPWHSLPDEVWEHAFSFLPAAADRGAAAGACSSWLRAERRSRRRLAVANCYAAAPRDAVERFPSVRAAEVKGKPHFADFGLVPPAWGAAAAPWIAAAADGWPLLEELSFKRMVVTDECLEMIAASFRNFQVLRLVSCDGFSTAGLAAIAAGCRVGRHLRELDLQENEIEDCSIHWLSLFPESFTSLVTLNFSCLEGEVNITVLERLVTRCHNLKTLKLNNAIPLDKLASLLHKAPQLVELGTGKFSADYHSDLFAKLEAAFGGCKSLRRLSGAWDAVPDYLPAFYCVCEGLTSLNLSYATVRGPELIKFISRCRNLQQLWVMDLIEDHGLAVVASSCNKLQELRVFPSDPFGAGFLTERGLVDVSASCPMLESVLYFCRRMTNEALITIAKNRPNFTCFRLCILEPHTPDYITREPLDAGFSAIVESCRGLRRLSISGLLTDLVFKSIGAHADRLEMLSIAFAGNSDLGLHYILSGCKSLKKLEIRDCPFGDKPLLANAAKLETMRSLWMSSCLLTLGACRQLARKMPRLSVEIMNDPGRSCPLDSLPDETPVEKLYVYRTIAGPRSDTPACVQIV

SEQ ID NO: 16475 - protein, 707 aa, Thermobifida fusca
MPMVEVWPGHAYPLGATYDGSGTNFSLFSEVATGVELCLFDDDGAETRVPLTEQDGHVWHGYLPTVGPGQRYGYRVHGPYDPERGLRCNPNKLLVDPYAKAIDGQIHWHESLFDYHFADPGRVNNHDSAPYVPTCVVVSPFFDWGAEQHPNIPYHETVIYEAHVRGMTIRHPDVPPPLRGTYAGMAHPAIIEHLLSLGVTAVELMPIHHFLPEHALVARGLTNYWGYNTLAFFAPHSGYAATGTRGHQVQEFKTMVKALHQAGIEVILDVVYNHTAEGDHMGPALSLRGIDNLAYYRVREDNPRYYLDYTGCGNSLNVRHPHSLQLIMDSLRYWVLDMHVDGFRFDLAAALAREFHDVDRLSTFFDIVQQDPVISQVKLIAEPWDVGPGGYQVGNFPPLWTEWNGKYRDTVRDFWRGYPVLPELASRISGSSDLYQADGRRPVASINFVTCHDGFTLADLVSYDRKHNEANGEDNRDGTDDNRSWNHGTEGPTTDSAIATLRRRQMRNMLTTLMLSQGVPMLSHGDEIGRTQHGNNNAYCQDNPISWVDWELARRNADLLDFVRTLSRLRREHPVFRRRRFFQGALPGRGKQRDIAWLRPDGTLMEDADWGRGWRALGVFLNGDAITEPDRMGRRIRDDSFLLLLNAGINDVQFTLPGPSYSAAWETVVDTADPEVAGRPYLPAGSDVTVIDRSFLVLKGVTKALPS

SEQ ID NO: 16476 - protein, 333 aa, Glycine max
GPPSSQYVGPPPPDYTPLYGFISLCGRRPEMEDAVATVPRFLKIPIQMLIGDRVIDGINKCFNQQMTHFFGVYDGHGGSQVANYCRDRTHWALAEEIEFVKEGLISGSMKDGCQNQWKKVFTNCFLKVDAEVGGKVNNEPVAPETVGSTAVVAVICASHIIVANCGDSRAVLCRGKEPMALSVDHKPNRDDEYARIEAAGGKVIQWNGHRVFGVLAMSRSIGDRYLKPWIIPEPEVTFVPRTKDDECLILASDGLWDVMTNEEVCDLARKRIILWYKKNGLEQPSSERGEGIDPAAQAAAEYLSNRALQKGSKDNISVIVVDLKPQRKYKSKT

SEQ ID NO: 16477 - protein, 461 aa, Unknown
  uncultured bacterium 442
MARWECIVCGLIYDEKEGWPDDGIPAGTKWSDVPDDWLCPDCGVGKDDFELIAGSEDEPVGETDTTTSADESSVATNNRHIVIVGSGLAGYGLVSALRKLDPEVAITLITRDGGESYSKPMISTGYTKNLSAEKLAAQSSEAMAEQLAVTMLTRKTVVSIDPSSNQLNLDDETVIAYSELVLTLGAELIRPPMGGDAAGDVMGVNDLDDYRSFRDTLEAKGVRKVAVIGAGLIGCEFSNDLLNGGFEVEAVDPMSWCIPTLLPEPAGRAVQAALEAKGARFHFGPLATEVNRSATGYQVQLNNGEHIEADAVLSAVGVRPRTQLASSAGLDVGRGIKTNRLLETSSPGIYALGDCAEVAGHVLVYVAPLLAAGRALAATLTGNPTEVSYPAMPVTIKTPACPVCVSPVAKDTEGSWTLSGEGSDIKGLFHSPNGQLLGFALTGAAVKERMALTKELPPILN

SEQ ID NO: 16478 - protein, 310 aa, Enterococcus faecalis
MTKGYVKSVTELIGQSPVVKLKRMVPEGAADVFVKLEFFNPGGSVKDRIALSMIQQAEADGRLKPGQTIIEPTSGNTGIGLAMVGAALGYPVKIVMPDTMSIERRKLMQAYGADLLLTPGAEGMKGAIAKATALAEEHGYFMPLQFNNPANPMVHEQKTGKEIVDVFGKRGLDAFVSGVGTGGTVTGVGHELKRIFPDIEIVAVEPTESPVLEGGEPGPHKIQGIGAGFVPEVLDTTVYQKVAAVSSEDALETARLMGPKEGILVGISAGAAIKAAIDLAVELGAGKRVLALVPDNGERYLSTALYEFPE

SEQ ID NO: 16479 - protein, 186 aa, Arabidopsis thaliana
  misc_feature (15)..(15): Xaa can be any naturally occurring amino acid
  misc_feature (42)..(42): Xaa can be any naturally occurring amino acid
  misc_feature (46)..(46): Xaa can be any naturally occurring amino acid
  misc_feature (91)..(91): Xaa can be any naturally occurring amino acid
  misc_feature (97)..(97): Xaa can be any naturally occurring amino acid
  misc_feature (107)..(107): Xaa can be any naturally occurring amino acid
  misc_feature (165)..(165): Xaa can be any naturally occurring amino acid
LLPRREISTCYERAXPISTAQERYPHMHLAEQCDTHAPNGHXETAXPHLTKTTTGIDSVAARDIGVALAQSDVCARFIRELIKRICLLNVXPDEGLXSLTYNMNNDXSLITGSVNASDIDSSVISSSTTIEYTVIGPPNAWLAPSECESSTWPDSVAIDDAMNRXLTYTAQDRVHAVCDETHDTML

SEQ ID NO: 16480 - protein, 257 aa, Nocardia farcinica
MSESAFLDTMFGLHGRVAVVTGASSGLGLGFARTLAGAGATVYAAARRLDRLDALAAENPRIVPVRCDVTADADRRALVDRCHAEHGRLDVLVNNAGRPGPPHAEEETAAGFAAILEVNLLAGFHLATYAATRLPAGERASYINIASVVGLVSTAPIGGASYAASKAGTLGLTRELAGQWGRRGIRVNAVVPGWFDTEMTDGLFDNEKSAGWVRRNTMLGRGGAPGEVDGAVLFLASDASSYVTGQTLVVDGGWTAR

SEQ ID NO: 16481 - protein, 613 aa, Mycobacterium smegmatis
MTQTTAAPLATLSPQERVDAWLADFESALAARDIERVVSKFAVDSFWRDLVAFTWNIKTVEGHEGIADMLSARLADTDPSGFKTTEPPTEDVDGNTVITSAFIEFETATGRGNGHLRLRSDDTGDRAWTLLTTLQELKGHEEPKGPKRVLGAVHGSDPDRRSWAEKRLDEQLTLGYSEQPYIVVIGGGQGGIALGARLRQLGVPAIVVDKHERPGDQWRKRYKSLCLHDPVWYDHLPYLPFPPNWPVFAPKDKIGDWLEFYTKVMEVPYWSSTTCLSASFDENEKRWTVEVDRNGEKVTLRPTQLVLATGMSGKPNIPTLPGQDIFRGDQHHSSQHPGPDRYVGKRAVVIGSNNSAHDICKALVENDVDVTMVQRSSTHIVKSDSLMDLGLGDLYSERAVAAGMTTEKADLTFASLPYRIMADFQKPIYDAIRERDKEFYARLEAAGFELDFGDDDSGLFMKYLRRGSGYYIDVGASDLIADGTIKLAHGQVERLTEDSVILADGTELPADVVVYATGFGSMNGWAADLIGQDVADKVGKVWGLGSGTTKDPGPWEGEQRNMWKPTQQENLWFHGGNLHQSRHYSLYLALQLKARYEGMDTPVYGLQEVHHLS

SEQ ID NO: 16482 - protein, 642 aa, Unknown
  Azoarcus sp. EbN1
MCGIAGLFDLRGKRDFSRDLVRRMNDVQVHRGPDEGGYHFEPGIALAHRRLSIIDLSTGQQPLFNEDGSVAVVFNGEIYNFQELVPELEALGHAFHTRSDTEVIVHAWEAWGEDCVQRFRGMFAFALWDRNRETLFLARDRLAVKPLFYALLPDGTFAFGSELKVLMQHPLLDRRIDAHAVEEYFALGYVAEPRTIFAGAKKLGAAETLCVRRGQPVPQPRCYWDVHFMLDNPLSLAEASAELTARLRESVRLRMIAEVPLGAFLSGGVDSSAVVATMAGLSDEPVHTCSIAFDDPAFNESDFAQKVADRYRTNHYVETVKSDDFDLIDTLAGLYDEPYADSSAIPTWRVCQLARKRVTVALSGDGGDESFGGYRRYRLHLMEERMRGALPLGVRQPMFGLLGRLYPKADWAPRMFRAKTTFQALARDSLQAYFHSVSILRDAMRRQLFSNRFRSELAGYNAIEVFRRHAATAHTDDALALIQYVDLKTYLVGDINTKVDRASMAHSLEVREPLMDHKLVEWLATLPSGLKVKGQEGKYLFKKAMEPLLPNDVLYRPKMGFSVPLSRWFRGPLRERVRQTVLGETLAATGIFNPDYLRHLVDAHQSGARDYSSPLWSLMMFEAFVRSSGGCPARAPELAAAV

SEQ ID NO: 16483 - protein, 110 aa, Myxococcus xanthus
MAGADVTNIGDGDFKQQVLDSQEPVLVDFWATWCAPCRAIAPSIEALASQYKGQVKFAKLNIDENQDTPQEYGIRSIPTLLLFKGGRVVEQIVGAVPKARIEEAVKKALT

SEQ ID NO: 16484 - protein, 601 aa, Mycobacterium smegmatis
MCGATGEVRLDGRTPDIGAVSAMAETMSSRGPDAAGVWSQGRVALGHRRLKIIDLTEAGAQPMIDPELGLAVCWNGCIYNYKELRAELSGHGYRFFSHSDTEVLIKAYHHWGDRFVEHLKGMFAFAIAERDTGRVLLGRDRLGIKPLYLSETGDRIRFASSLPALLAGGGVDTGIDSVALHHYLTFHSVVPPPRTILRGVKKVPPASIVAIEPDGTQRTTVYWSPDFSRRAERADWSERDWEDAVLQSLREAVERRLVADVPVGCLLSGGVDSSLIVGLLAEAGQHGLKTFSIGFESVNGVAGDEFKYSDIVAQHFGTDHHQIRIDTARMLPALDGAIAAMSEPMVSHDCVAFYLLSQEVAKHVKVVQSGQGADEVFAGYHWYPPMAEPAAASLDGAVNSYRGAFFDRDSAGVASLISDAYRVDGDPSGVFVTDHFGAPGAETGVDRALRLDTTVMLVDDPVKRVDNMTMAWGLEGRVPFLDHELVELAATCPPELKTAHGGKGVLKEAARRVIPAAVIDRPKGYFPVPALTHLEGPYLNMVRDALYAPEAKERGLFRPEAVERLLADPNGRLTPLRGNELWQIGLLELWLQRHGITGSAA

SEQ ID NO: 16485 - protein, 426 aa, Arabidopsis thaliana
MSVSLSAASHLLCSSTRVSLSPAVTSSSSSPVVALSSSTSPHSLGSVASSSLFPHSSFVLQKKHPINGTSTRKISPKCAASDAAQLISAKEDIKVLLRTKFCHPILVRLGWHDAGTYNKNIEEWPLRGGANGSLRFEAELKHAANAGLLNALKLIQPLKDKYPNISYADLFQLASATAIEEAGGPDIPMKYGRVDVVAPEQCPEEGRLPDAGPPSPADHLRDVFYRMGLDDKEIVALSGAHTLGRARPDRSGWGKPETKYTKTGPGEAGGQSWTVKWLKFDNSYFKDIKEKRDDDLLVLPTDAALFEDPSFKNYAEKYAEDVAAFFKDYAEAHAKLSNLGAKFDPPEGIVIENVPEKFVAAKYSTGKKELSDSMKKKIRAEYEAIGGSPDKPLPTNYFLNIIIAIGVLVLLSTLFGGNNNSDFSGF

SEQ ID NO: 16486 - protein, 219 aa, Unknown
  uncultured bacterium
NSRLCMSSAVAGYTRSLGSDGPPCSYEDLDHCSVAFLIGTNTAECHPVLFQRLLKRKRKNPGSVKIIVVDPRRTDTAKAADIHLPIAPGSDLALLHGIAHLVLRENGQDPAFIDDRTENYDAFFDVAARWTPRRVARFCNIPEKRLREVAALFHRREKVLSLWSMGVNQRREGTAVVQGLINLHLLTGQIGNEGAGPFSLTGQPNAMGGREAGGLAHLL

SEQ ID NO: 16487 - protein, 299 aa, Zea mays
DEFVEHGAGLPGRFREGRATAGERRRQQRGRGLQRRRHRREQGLLADPTLASSRKAAAVPACPVASPRHSDYFDPRAPPPPRGDGGYGRPPNGAQDGRVFTSYSIYKGKAALSFDPRPPLFVPLDSGAYKVAKEGFVLLQFAPAVATRQYDWTRKQVFSLSVWEIGTLLTLGPTDSCEFFHDPFKGRSLGTVHQENIYHIISSFDINSEEGKVRKVLKIEPTPDGNGRFFNLSVQNRLINVDESIYIPITKGEFAVIVSTFNYIIPHLMGWSTFVSSIKPEESRPYSRPQSTSEYEWRR

SEQ ID NO: 16488 - protein, 589 aa, Ustilago maydis
MRSSWLSTASAVFVCAAALANAAKLPAPLEQIHYDQAGNLVWNEDNDVSNVIPSLGRPDFSALKLEGVVAAATPVKQSVHDVFSESMKQAEDVLTWAENEIERIEHKIEDAVVGTKHTVKDWIHTGKVFVDGLEFERLTHPSFPEYSLRLNTQSEAFCDKDVVQHSGYLDISDSKHLWFIFFESRSSPKDDPVVLWLNGGPGCSSSTGLLFELGPCRVTDQGRAVKNNPHSWNNKANLLFLDQPVDVGYSYSDNDQVNNSPAAAEDVYAFLQLFFAKFPEYSKLPFTASGESYAGTYLPNIASTIYKKNKNLALARYSNPELAPKHINLDTVMIGNGLSSPQYQFPSVPEYACGADNKYALFEPGSSTCKTLEQQAATCKSLINSCQKYNSRLTCTPAALYCWSRLYGPAQETGKNLYDVRKTCDREKDGPLCYKDMEYIETLLNTPSIKKNLGVPESVNFQSCNMNINQAFLLQGDSMHDSAALLPELIEDDIRVLIYAGEADFMCNYMGNLEWMQSLETSYLDDFNNGTAKEWTVNGKKAGLVRKGGKGAGNVAFAQVYAAGHMVPYDQPEVASDMINRWLANKPLA

SEQ ID NO: 16489 - protein, 219 aa, Unknown
  uncultured bacterium
NSRLCMSSAVAGYTRSLGSDGPPCSYEDLDHCTVAFLIGTNTAECHPVLFQRLLKRKRKNPGSVKIVVVDPRRTDTAKAADIHLPIAPGSDLALLHGIAHLVLRENGQDPAFIDDHTENYDAFFDVAARWTPRRVARFCNIPEKRLREVAALFHRREKVLSLWSMGVNQRREGTAVVQGLINLHLLTGQIGKQGAGPFSLTGQPNAMGGREAGGLAHLL

SEQ ID NO: 16490 - protein, 365 aa, Hyphomonas neptunium
MADTQSSPPKTGINAEGFLTDSWYLAATSAELKAGQQQRVMMLGEPVVVGRTPAGEAFALRDICPHRLVPLSAGQQVETAGEWTLQCPYHGWRFGTDGGCRLMPSLTGDSPYDPSKVKVRRYPVHEANGAVYIYVAHDARSIAPPAVPPPDFGPLPEKPGFVIHDVFNAHMDDAVVGLMDPAHVPFVHNQWWWRPPSAGLKLKEKPFVPITRGWAIDRHAPSSNSKLYRWVFGGDVMTEICFQLPGYRWEIISNATARLLTLTCLTPEAPKRTRITQFTWWTGAPLLKLAVPVAKRMGKTFLAQDGRMVDLQNEGMAHQKAMLWIDDIDVQAKWYQMLKREWTAARCEDRDFANPIEPRILKWMS

SEQ ID NO: 16491 - protein, 219 aa, Unknown
  uncultured bacterium
NSRLCMSSAVAGYTRSLGSDGPPSCYEDLDHCSVAFLIGTNTAECHPVLFQRLLKRKKRNPGSIKIVVVDPRRTDTAKAADIHLPIAPGSDLALLHGIAHLVLRENGQDPAFIDDHTENYHSFFDVAARWTPRRVARFCNIPEKRLRDVAQLFHRREQLLSLWSMGVNQRREGTAVVQGIINLHLLTGQIGKEGTGPFSLTGQPNAMGGREAGGLSHLL

SEQ ID NO: 16492 - protein, 274 aa, Solanum bulbocastanum
MGSFPGHVLPGTLFLVIGVWHIWSALVRYSSNPKSFRVRVWSPVPGFDGKLKYLELYVIAIGGFIDFCIELFYSTHLRLVVHGVLNPVHMNNFEHAGMLLMFVIFGLIVLLSEKTSFLPLPEGALCLIAATAFSAEYFLFFFHSTTHKGLEGYYHLILVLLIGLCILTTIAGALMPTSFPIDLASGISVALQGLWFYQTAFTLYGPMMPDGCQLKGNDVMCRSEDSEVRGELLANLQLFSMIFFVLAATTGAYGFAASETGHKDIRNSHLPLDG

SEQ ID NO: 16493 - protein, 213 aa, Trichodesmium erythraeum
MQISDRLSSSTAPILNLPVRRASVKRKTGETDVTVNLNLDGVGNCQANTGIPFLDHMLHQISSHGLIDLDVQAVGDIEIDDHHTNEDVGITLGQALKQALGDRKGIVRFGHFLAPLDEALVEVALDFSGRPHLSYGLEMPTQRVGNYDTQLVREFFVALANNSLMTLHIRQLGGINSHHIIEAGFKAFARSLRMATEIDPRRVGEIPSSKGVL

SEQ ID NO: 16494 - protein, 423 aa, Brachypodium sylvaticum
MEAYCSSLVKDELINGGGGGAGGMRYCEAAPRVSPPVAIKSVKRRKREPPAVSGMTTVSGGGGGNGKDGDKSAGNAAAAKRSSRFRGVSRHRWTGRFEAHLWDKGTWNPTQKKKGKQVYLGAYNEEEAAARAYDLAALKYWGPTTYTNFPVVDYEKELKVMQGVSREEYLASIRRKSNGFSRGVSKYRGVARHHHNGRWEARIGRVFGNKYLYLGTYSTQEEAARAYDIAAIEYRGINAVTNFDLSSYIRWLKPNSAANTNTPPAAAAELAILGGAPAALISPAPAPTTMRVPRLLPPLVRGRGGSIPDDVSAGGSCVFGSPSPSPSPTTTSALSLLLRSSVFQELVAQQQPPSIVDDDDGVGGQEAVSDAAERAAEENEESFGEVLYGAGEGEAAAAFSCSMYELGLDDSFARIEESLWGCL

SEQ ID NO: 16495 - protein, 266 aa, Brachypodium sylvaticum
MPPPLSLSLPSPPPLLSLLLPHHAKAFQSLTLAPPRTLASVACSVVPARHSDYFDPRARTPPPRDEYGEPPPPPLAPAQGGQSGRVFASYSIYKGKAALSFDPRPPQFVPLDSGAYKVAKEGFVLLQFAPAVAARQYDWTRKQVFSLSVWEMGTLLTLGPTDSCEFFHDPFKGRSDEGKVRKVLKVEPTPDGNGRFFNLSVQNRLLNIDESVYIPITKGEYAVIVSTFNYIIPHIMGWSTFTNSIKLEESQPYSRPQSSPELEWRR

SEQ ID NO: 16496 - protein, 313 aa, Ostreococcus tauri
AMTRVVTRAGATTGRPTHCVVTGANTGIGLETARALARTYDVVTLACRDETRARAAMATIGADDLCDAELRFASLDLSSLASIEDFGRAMRAADEAIDAFVANAGVMALPTATRTRDGFETQVGVNHLGHYAAIGWVFPLIERAGRETGDARVVVVSSEAHRIASRGLRRDDLFGETRYGAWTQYGQSKLANVLFANELARRCEGRGVTVASLHPGAVDTELGRYLQPPDAEVKWWQKKLYNFIRKFLKTPEQGAATSVFLARDVERGVANGKYFSDCREKTPAKTCLDEDDALWLWNRSAELTGVAFDLERV

SEQ ID NO: 16497 - protein, 1481 aa, Mycoplasma penetrans
MSKQNDKIWNRSLDDIMSESFGKYAKYIIQDRALPDVRDGLKPVQRRILHAMNELKIHHDKPYKKSARTVGEVIGKYHPHGDSSIYEAMVRMSQEWKNNLPLLDMQGNKGSIDGDSPAAMRYTECRLSKFGQTILKDIDKNTVKFINNFDDSEQEPTVLPSLLPNILINGATGIAAGYATNIPPFNPSEVIDGTIYRILRPESSLAELAKIIKGPDFPTGGIIQGKEFIQEIYKTGKGKFFIRAKIEEEPTKSTKNVKRLIVKEIPYDTNKSAIVKSLDEIKYNNELPGFKEVRDDSDKNGISIVLEFDTEKDLEIIKTFLYKKTQLQISYNANMVLIKDRKPVQAGLLEILDSFIEHANNVVIKAAQYDLEKSLLRKEIIEGLIKAISEIDVLVNLIKSSVSKEEAKLKIQDYFKVNERQSEAIVNLRLYVLTSFDTEKLKKEYEELLEFIKEKELIINSVPYRNKFIVSILENHKKSFGYKRRSLIENEVEELEIETVDIVEERNGTCIVTRDNYIKFIDDVSIEELDLSKAKIKDADIPVDIFRLSTLDHLVCLTNRGKMITIPAYKIKMTKLKDNGVHINELITIDSFEKTILAFGVSKYSDINTEILVATKNSLIKRISLEDINLSKNAKSSTYVSLKGGNDDVVSAYILKKEYSEVVSVTQNGYATRYKIDEIPLVGRTAAGVKNMSLKDKDLMAFTVPIPKHENFLFFISNRGAKRIHINDIVVTSRSKLGKRIFQQIDSNPYIVNSGFMVGGRSNVFMLLESNELVSLKVAEIPITEADSRMNLITKIGKSSILKGTYLTINKSHIETSQTNNFLTLNSEKSSSSELKENSDDNEDDEHHFVEDDVEIIPIEKLKKQLEKQQPKENEFESSTNFNILEEMEKNKNSSKSNTKKEIEPSIEKVEEKTEDNQIQEEELENNSDEIIEESDNEELALEDAEEENEDNNSDESDDDIKITESEDSEDDNSEDYESDDENDELEDSTEETEDEEYYDDSEESEDETEITESEDSEDDNQDESYDEEDDSEETEDYESDDENDEEYSDDSEETEDEEYSDEENDDESEDSEENSEDDSEELYDESDEDSESYDEETEGYESDDENDEEYSDDSEEIVDESYDEEDDPEETEDESEDSEENSEDDSEELYDESDDEETEDYESDDENNEEYSDESEEIEDEFYDEEDDPEETEDEEYPDDESDDLDISDEDENEDNDSDESEDETEITEIKDSEDDNSEDYESDELEDSTEETEDEEYSDDSEENSEDDSEELYDESDEDSESDYEETEDYESDDENDEEYSDDSEEIEDESYDEEDGSEETEDEEYSDEENDDESEDSEENSEDDSEELYDESDDEETEDYESDDENDEEYSDDSEEIEDESYDEEDDSEEETDDESEDSEENSEDDSEELYDESDEDSESDDEETEDEEYSDDDYEEELENEFEEDESSDEDEEESEFSFDDLNDMEEDDLDDEDNED

SEQ ID NO: 16498 - protein, 268 aa, Glycine max
MAEHLASIFGTEKDRVNCPFYFKIGACRHGDRCSRLHNRPSISPTLLLSNMYQRPDMITPGVDPQGQTLDPRKIQQHFEDFYEDIFTELAKFGEIESLNVCDNLADHMIGNVYVQFREEDQAAKALHALRGRFYNARPIIADFSPVTDFREATCRQFEENSCNRGGYCNFMHVKLIGRDLRRRLFGRNHRGGSGTYHRVSRSRSRSRSASPRYRRERRESDSRGGRRSRERDGSGGRRRQHGSPPAREGSEERRARIEQWNREREENK

SEQ ID NO: 16499 - protein, 322 aa, Vibrio parahaemolyticus
MSKIYEDNSLTIGNTPLVRLNKVSKGNVLAKIEARNPSFSVKCRIGANMIWEAEKAGTLKPGVELVEPTSGNTGIALAFVAAARGYKLTLTMPESMSLERRKLLKALGANLELTEAAKGMKGAIAKAEEIVASNPEKYLLLQQFNNPANPQIHEKTTGPEIWDATDGEIDVLVAGVGTGGTITGTSRYIKGEKGKAITSVAVEPAESPVIAQALAGEEIQPAPHKIQGIGAGFIPGNLDLDIIDRVEPVTSEEAIEMARRLMEEEGILAGISSGAAVVAANRIAELPEFEGKTIVTILPSSGERYLSTALFAGIFTEKENQQ

SEQ ID NO: 16500 - protein, 966 aa, Saccharomyces cerevisiae
MNPGGEQTIMEQPAQQQQQQQQQQQQQQQQAAVPQQPLDPLTQSTAETWLSIASLAETLGDGDRAAMAYDATLQFNPSSAKALTSLAHLYRSRDMFQRAAELYERALLVNPELSDVWATLGHCYLMLDDLQRAYNAYQQALYHLSNPNVPKLWHGIGILYDRYGSLDYAEEAFAKVLELDPHFEKANEIYFRLGIIYKHQGKWSQALECFRYILPQPPAPLQEWDIWFQLGSVLESMGEWQGAKEAYEHVLAQNQHHAKVLQQLGCLYGMSNVQFYDPQKALDYLLKSLEADPSDATTWYHLGRVHMIRTDYTAAYDAFQQAVNRDSRNPIFWCSIGVLYYQISQYRDALDAYTRAIRLNPYISEVWYDLGTLYETCNNQLSDALDAYKQAARLDVNNVHIRERLEALTKQLENPGNINKSNGAPTNASPAPPPVILQPTLQPNDQGNPLNTRISAQSANATASMVQQQHPAQQTPINSSATMYSNGASPQLQAQAQAQAQAQAQAQAQAQAQAQAQAQAQAQAQAQAQAQAQAQAHAQAQAQAQAQAQAQAQAQAQQQQQQQQQQQQQQQQQQQQQQQQQQQQQQQLQPLPRQQLQQKGVSVQMLNPQQGQPYITQPTVIQAHQLQPFSTQAMEHPQSSQLPPQQQQLQSVQHPQQLQGQPQAQAPQPLIQHNVEQNVLPQKRYMEGAIHTLVDAAVSSSTHTENNTKSPRQPTHAIPTQAPATGITNAEPQVKKQKLNSPNSNINKLVNTATSIEENAKSEVSNQSPAVVESNTNNTSQEEKPVKANSIPSVIGAQEPPQEASPAEEATKAASVSPSTKPLNTEPESSSVQPTVSSESSTTKANDQSTAETIELSTATVPAEASPVEDEVRQHSKEENGTTEASAPSTEEAEPAASRDAEKQQDETAATTITVIKPTLETMETVKEEAKMREEEQTSQEKSPQENTLPRENVVRQVEEDENYDD

SEQ ID NO: 16501 - protein, 72 aa, Agrobacterium tumefaciens
MTKEEVLEFPGIVTELLPNATFRVKLENEHEIIAHTAGRMRKNRIRVLAGDKVLVEMTPYDLTKGRITYRFK

SEQ ID NO: 16502 - protein, 441 aa, Alkaliphilus metalliredigenes
MKILLVKCHKKTIFSKIEPIVTEPLELEYLSALLENLEIQHRVYDGLLEKGSFRAVFEAYEPDVLLLTGYITAVGKIIAYSQYAKKSHRQIKVIVGGVHAEINYEDFFVDTIDIIVHSNGLSTLNELLQHDFHLEIMRGLKGIALRHGDQWTVNESVPTALTQMPLPNRDYFEKHQHRTKYMSYSPVAIVKTALSCPHGCHFCYCKLLNTGLYATREINEVVEEISGIGAPYIWIVDDSFLLDRQRTRQFIEAIKISGIRKKFIAYSRVDFVVNNEDILQQLKEIGFIELIIGMEAVDDSMLKDFNKAATVDENSRTVTLLKKYDIKLTALFIVGIDFKVGDFKKMRHWIRRRKLQSFTVSIFTPMKGTQGYGDYEEKIQETDFSKFDFLHLTMKPYYMSKFSFYIQFYLIYGQLFFQSKSVRQYLFKNLKHILKPGGYHE

SEQ ID NO: 16503 - protein, 177 aa, Oryza sativa
MYLLSPRNGDEEDEQEEIQELISDDEPPNLKLASCATAASSSSSGSDMEKGRGKACGGGSTAPPPPPPSSSGKSGGGGGSNIREAAASGGGGGVWGKYFSVESLLLLVCVTASLVILPLVLPPLPPPPSMLMLVPVAMLVLLLALAFMPTMTSSSSSAGGGGGGGRNGATTGHAPYL

SEQ ID NO: 16504 - protein, 609 aa, Saccharomyces cerevisiae
MNSSYTQRYALPKCIAISDYLFHRLNQLNIHTIFGLSGEFSMPLLDKLYNIPNLRWAGNSNELNAAYAADGYSRLKGLGCLITTFGVGELSAINGVAGSYAEHVGILHIVGMPPTSAQTKQLLLHHTLGNGDFTVFHRIASDVACYTTLIIDSELCADEVDKCIKKAWIEQRPVYMGMPVNQVNLPIESARLNTPLDLQLHKNDPDVEKEVISRILSFIYKSQNPAIIVDACTSRQNLIEETKELCNRLKFPVFVTPMGKGTVNETDPQFGGVFTGSISAPEVREVVDFADFIIVIGCMLSEFSTSTFHFQYKTKNCALLYSTSVKLKNATYPDLSIKLLLQKILANLDESKLSYQPSEQPSMMVPRPYPAGNVLLRQEWVWNEISHWFQPGDIIITETGASAFGVNQTRFPVNTLGISQALWGSVGYTMGACLGAEFAVQEINKDKFPATKHRVILFMGDGAFQLTVQELSTIVKWGLTPYIFVMNNQGYSVDRFLHHRSDASYYDIQPWNYLGLLRVFGCTNYETKKIITVGEFRSMISDPNFATNDKIRMIEIMLPPRDVPQALLDRWVVEKEQSKQVQEENENSSAVNTPTPEFQPLLKKNQVGY

SEQ ID NO: 16505 - protein, 488 aa, Geobacter metallireducens
MRRLNPVAPLIALAAAATLFVLGGCAPEKAQPVKTVQIPDGEVDPAVWGKAYPTEYEMWKKTEEPEPPGKSKYKRGFDADHVTYDKLSEFPYMALLFNGWGFGIAYNEPRGHANMVRDQLEIDSARLKSGGVCLTCKTPYAPKLEKEMGIDYFKTPFKDVLAKIPEKHKTLGVACIDCHDNKDMSLRISRGFTLGEALKKLGVDQAKLSRQEMRSLVCAQCHVTYNIPKDADKKSIGVYFPWQGSKMGNISVENIIKQIRSDASVGEWTQTVTGFKLGFIRHPEYELFSNNSVHWKAGAACTDCHMPYTRVGAFKVSDHRVMSPLKNDMKACIQCHTEKPEWLRDQVIAIQDRTVSLMLRSGYATATVAKLFEKAHAAQAQGKQIDKALYDRAKDLYEEAFYRCVFIGAENSVGFHNPTEAMRVLGDATAFATKAEALLRQALAKAGVDVPLTVNLELNKYLDQRGEKKLTFDPKVEIKDPYGVQVRF

SEQ ID NO: 16506 - protein, 354 aa, Hebeloma cylindrosporum
MAYRYHNDLLAPYLALPQGDKIQAEYVWVDGDGGLRSKTTTVSKKVTDIGSLRIWDFDGSSTNQAPGHDSDVYLRPAAIFKDPFRGGDNILVLAETYNSDGTPNRTNFRHHAAKVMEQAKEDVPWFGLEQEYTLFDADGSPYGWPKGGFPGPQGPYYCGAGTGKVFARDLIEAHYRACLYSGINISGINAEVMPSQWEFQVGPCEGISMGDHLWMARYLLVRIAEQWAVKVSFHPKPLQGDWNGAGCHTNYSTKAMREPGGMKVIEEAIEKLSKRHDEHIAVYGEDNDLRLTGRHETGHIGAFSSGVANRGASIRVPRHVAAQGYGYLEDRRPASNIDPYRVTSIIVETTLLNA

SEQ ID NO: 16507 - protein, 449 aa, Alkaliphilus metalliredigenes
MKILLIRPKPHKETIGLQHVMICEPLELEYIAANIEDKEASVEIIDMILEKKPLEYFIQKHQPNIVGLSGYITHVEVIKGYGERIKKIKPDTTVVVGGVHAEVVPQDFVSDFIDYIVEANPIKTFNQIINHPGEKDIQGTYQPGKTNVKETTFSYKFPARNKVAKYRNQYYYMFHNPCSLIKTSFGCPYNCSFCFCKEITDGKYYTRSIDSVIQELKGIPEQEIYIVDDDFLFSSQRILEFCQRLQEENIHKRFLVYGRADFIYKNESVMKTFKEAGLRAVIVGLESFKKADLDKYNKGTNIIENEEAVKILKRHDIEIYGTFILDMDFSKEDFKDLYGWIKKLDLTFVNLQPLTPLPGTEIYESYEKHFIIQKQEYEKWDLAHLVLAPTKMSVRRYYFEMIKLYYKITMDPKSVVKLIRKYGFKDVLKLSIGSSRVTQQYIGKIVRGK

SEQ ID NO: 16508 - protein, 329 aa, Arabidopsis thaliana
MKLDHVDSTADITKQHEKENTHDHPNANPNPNPNPHPHPHPQLTKTTSSRSKTSRHGTPSVRSESSCNSQTFLMRINNHNENKQRKMNDTSISFGGFRCYGPCSGVKTVHTDPKNSCKSRNSDRDFVAYDARKHNDKPRLHFEAKKADFHAQEKISLPIQRSDIAMNLERKLSLLTWDAIPNQLSTKNNNHNNNGNNSSMSSNTQEEETASVASSDLFEIENITSSVYEPSEASIGWSVVTGSMADQSVISDFDMMKRVTRNGPVVKTKPVIGEKVRSAGFLSGCKSHKAVSVVDSSRKVKETAKVDHHEMSHQKKFKTEIRIQDLSFL

SEQ ID NO: 16509 - protein, 345 aa, Emericella nidulans
MKYMSLDQRGSVMAEYIWIDAHGGTRSKTKTLSKAPSSVDELPEWNFDGSSTAQAPGDNSDVYLRPVAMYPDPFRRGDNILVLCETWDSDGSPNKFNYRHDCARLMETHAKEEFWFGLEQEYTLLGPDGWPYGWPKGGFPGAQGPYYCGVGTGKVYCRDIVEAHYRACLYAGVKISGINAEVMPSQWEYQVGPCHGIEMGDHLWISRFLLHRVAEEFGVKISNDPKPIKGDWNGAGLHTNVSTTSTRAEGGIKAIESYMKKLEARHVEHIAVYGEGNEERLTGRHETGNIDKFSYGVADRGGSIRIPRQVAKDGKGYFEDRRPASNADPYQITGIIAETVSFSNR

SEQ ID NO: 16510 - protein, 438 aa, Alkaliphilus metalliredigenes
MKKLLLIQSTPYDSQRRPIKKNKLYFVGLGLPLLAALTPEDWQVEIVLETIEEIPFESDADVVAIGSMGHAIIRSIDIATEFKKRGKTVIMGGYMASLMGEEAKKYCDSVVIGDAEGVWGQLLEDYESGQLKDFYKEELNELSTPLPRFDLIMGKNIGDFLPVQAGRGCPNSCSFCSVHCLYKNKYLKRAIPDVLRDIAQIKELGFKKFLLLDDNIIADRDYLMTLCGEIKKLKMKWISQCAITIGEDLELLKAVADSGCIALSFGLESITQESLNDMDKSWANPSHYPHLIKTIQEAGIDVSTEMVVGADGDTLGSIAATAQFIEDNKIVVPRFYILTPIPGTKYFDEMKSAGRIYKEDIYSYNGSEAVHIPQNMTPQELTTAYWELYNEVFSYKSIVKRTLWQKGFFKRMDRAFFYVMVNLFYRYQIKRKITPNII

SEQ ID NO: 16511 - protein, 485 aa, Geobacter metallireducens
MLMSNVKRWAAVTAFTAMAAVGTGCAPKKVEQDKSASVADGTIDPAGWKKAYPAQYELWKKTEEPTPTGKSRYKKGYDEDGVFYDKLDEYPFLALLYNGWGFGVEYKEPRGHAYMIHDQFEVDPARLKAGGSCLTCKTPYAPELQQRLGKDYFSKPYKEVHAQIPKEHQMLGVTCIDCHNGSDLSLKISRGFTLGKALEKLGVDRAKLSAQDKRTLVCAQCHVTYAIPKDGNMKSTDVYFPWDGSTYGGITIENIIKKLRSSPANGEWTQGVTGFKLAFIRHPEFELFSNNSPHWQAGVSCADCHMPSTTAGNQKVSDHRVMSPLKNDLKACAQCHTETPDQLRGKVYAIQDRTMSRFIRTGYATATVAKLFEMTNKAEAQGKQIDKTLYAQAKDHYEEAFYRVVFIGAENSVGFHNPTEATRVLEDAAMHAGKADGLLRQALAKAGVTVPAKVDLELEKYVNNRGSKKLMFKPEHEIKDPLAGK

SEQ ID NO: 16512 - protein, 334 aa, Porphyromonas gingivalis
MSYLTEEKLTIVGAAGMIGSNMAQTAAMMRLTPNLCLYDPFAVGLEGVAEEIRHCGFEGLNLTFTSDIKEALTDAKYIVSSGGAPRKEGMTREDLLKGNAEIAAQLGKDIKSYCPDCKHVIIIFNPADITGLVTLIYSGLKPSQVTTLAGLDSTRLQSELAKHFGIKQSLVTNTRTYGGHGEQMAVFASTAKVNGTPLTDLIGTDKLTNEQWAELKQRVVKGGANIIKLRGRSSFQSPSYVSIEMIRAAMGGEAFRWPAGCYVNVPGFEHIMMAMETTITKDGVKYSDINQLGNEAERAALKESYSHLAKLRDEVIAMGIIPAIADWKTVNPNL

SEQ ID NO: 16513 - protein, 408 aa, Arabidopsis thaliana
MGSLRRSTSNRSRKKGTAVKMNRMPSSLSPPTPPCSAIVGGTGKSKKRRGGVCLWTRFDRTGFMEVAGCDKSTIIERSSVSAKDLRTAFSHSSKILAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLD

SEQ ID NO: 16514 - protein, 642 aa, Unknown
  Azoarcus sp. EbN1
MCGIHGIYRFDAAPVSPAQLSAMGDVTRHRGPDDEGRYIDADGRCGIAMRRLSIIDLAGGHQPISNADDTLWGVCNGEIYNFRELRAELQERGYRFKTGSDSEVLVHLYDAFGDDFVHRLDGMFNFALWDARRKRLLIGRDPLGVKPLYVHRSASMLAFATEAKALLELPGVTRELDHDVVADYLHLGYVAAPHSMFRDIRKLPPATLLSVENGEVRQWRYWRLPSSVARYVTEAEWIGRIRDGMERAVHRQMVSDVPIGAFLSGGVDSSAVVAFMAKHSAHPIRTYAIGFEGGEAEQLYNELPYARQVAQLIGTEHHEIVVTPDVVGLLPKLLWHMDEPVSDSAFITTFLVSEFARRDVKVILSGVGGDELFGGYRRYLGGHYVRKLQRLPRWSRQLMSRTAAMLPSDRHSKVLNTMRLARGFLASAELSPDERYRHYLQVLDRASIAELMNGRTGTTDALRDAFAAAGDEDALNRMFAVDAETQLPDDLLLLTDKMSMAVSLECRVPLLDRELVELAAAIPEALKVRDGRLKHLMKEALADVLPASILDRKKRGFGTPMGAWLKRDLAPVLRRLLSADVVRDRALFEPKVIARLMADHDANRIDGTDALLALMNLEIWSRIFLDRRSPDDVTTELKAYLP

SEQ ID NO: 16515 - protein, 502 aa, Xylella fastidiosa
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAAHAFDIVSTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDNPHRVYPGGNPSTLILLDALTPQALGGLIAMYEHSVYVQSVIWGINAFDQFGVELGKHLAVQLLPALKGESVEVADPVTRAVLLRLRG

SEQ ID NO: 16516 - protein, 722 aa, Arabidopsis thaliana
MSFVVGVGGSGSGSGGDGGGSHHHDGSETDRKKKRYHRHTAQQIQRLESSFKECPHPDEKQRNQLSRELGLAPRQIKFWFQNRRTQLKAQHERADNSALKAENDKIRCENIAIREALKHAICPNCGGPPVSEDPYFDEQKLRIENAHLREELERMSTIASKYMGRPISQLSTLHPMHISPLDLSMTSLTGCGPFGHGPSLDFDLLPGSSMAVGPNNNLQSQPNLAISDMDKPIMTGIALTAMEELLRLLQTNEPLWTRTDGCRDILNLGSYENVFPRSSNRGKNQNFRVEASRSSGIVFMNAMALVDMFMDCVKWTELFPSIIAASKTLAVISSGMGGTHEGALHLLYEEMEVLSPLVATREFCELRYCQQTEQGSWIVVNVSYDLPQFVSHSQSYRFPSGCLIQDMPNGYSKVTWVEHIETEEKELVHELYREIIHRGIAFGADRWVTTLQRMCERFASLSVPASSSRDLGGVILSPEGKRSMMRLAQRMISNYCLSVSRSNNTRSTVVSELNEVGIRVTAHKSPEPNGTVLCAATTFWLPNSPQNVFNFLKDERTRPQWDVLSNGNAVQEVAHISNGSHPGNCISVLRGSNATHSNNMLILQESSTDSSGAFVVYSPVDLAALNIAMSGEDPSYIPLLSSGFTISPDGNGSNSEQGGASTSSGRASASGSLITVGFQIMVSNLPTAKLNMESVETVNNLIGTTVHQIKTALSGPTASTTA

SEQ ID NO: 16517 - protein, 57 aa, Fragaria vesca
YGLFWSISPKQPGVLEWGDGYYNGDIKTRKTVQAIELDADQMGLQRSEHLRELYESL

SEQ ID NO: 16518 - protein, 214 aa, Zea mays
MKRETMPSWLELLLATQFFTTCANHLLASRNECNLFCTQCETKPAAFCNYCRSSDHSTHRVIQIRRSSYHDVVRVSEIEDILDVSDVQTYVINSARIVFLNERPQLRASSVPICKAPTSSTHSCETCSRVLLDAFRFCSLGCNLRGLNMEAGMQAMVGNNPRSNGMDHVARIDNVGSSTTNDPNSCNDKNYEEPPPKRVARHRRKGIPQRAPFF

SEQ ID NO: 16519 - protein, 110 aa, Arabidopsis thaliana
  misc_feature (22)..(22): Xaa can be any naturally occurring amino acid
  misc_feature (32)..(32): Xaa can be any naturally occurring amino acid
  misc_feature (34)..(34): Xaa can be any naturally occurring amino acid
  misc_feature (39)..(40): Xaa can be any naturally occurring amino acid
  misc_feature (46)..(46): Xaa can be any naturally occurring amino acid
  misc_feature (49)..(49): Xaa can be any naturally occurring amino acid
  misc_feature (52)..(52): Xaa can be any naturally occurring amino acid
  misc_feature (55)..(55): Xaa can be any naturally occurring amino acid
  misc_feature (57)..(57): Xaa can be any naturally occurring amino acid
  misc_feature (60)..(60): Xaa can be any naturally occurring amino acid
  misc_feature (64)..(65): Xaa can be any naturally occurring amino acid
  misc_feature (72)..(74): Xaa can be any naturally occurring amino acid
  misc_feature (78)..(78): Xaa can be any naturally occurring amino acid
  misc_feature (82)..(83): Xaa can be any naturally occurring amino acid
  misc_feature (89)..(89): Xaa can be any naturally occurring amino acid
MASFTASASTVSAARPGLLLKXTVAISAPVLXLXPPMGXXKGGVRXSMXTKXGNXPXMGXGASXXPTAALTXXXEQSXDVLXXDERMSXEGTGLPFCSKNPPDPCALGLS

SEQ ID NO: 16520 - protein, 477 aa, Enterococcus faecalis
MKRVIWFRRDLRLQDNKALAHALQNSAADELILLFQMNPQQFIQESANHNAFFASLASFKERIDQEAHLQIMVGEPLDLFSRLKRKLPDWQAIYFNEDTCGFGAKRDQQAMRFFEENNIQSFSFQDAYLHGSEEIKKNDGSKYQVFTPYYNKWKEAPKETPIPVSYTAEKIFSACLFPEEEAAYREQIARIPLTHYSVGEETARRRLNTFIDQKLQSYENKRDFPYQDQTSHLSTFLRTGELSIRTIWQELASVPSSLSKETFKKELAWRDFYNMIYSAFPQQKEEAIQEKFRYIQWTNDPEMFVKWQKGETGYPIIDAAMRQLNQTGWMHNRLRMITASFLVKNLHIDWRWGEKYFQKMLIDYDAANNIGGWQWAASTGTDAVPYFRIFNPIIQSKKFDNDGQFIKKYVPELKQVPQKYIHQPNLMNEALQTQYHVHLGENYPKPIVDYASSKKQTLFLYEASKEIHQEMNNPRFQ

SEQ ID NO: 16521 - protein, 521 aa, Salmonella typhimurium
MLDTNMKTQLRAYLEKLTKPVELIATLDDSAKSAEIKELLAEIAELSDKVTFKEDNTLPVRKPSFLITNPGSQQGPRFAGSPLGHEFTSLVLALLWTGGHPSKEAQSLLEQIRDIDGDFEFETYYSLSCHNCPDVVQALNLMAVLNPRIKHTAIDGGTFQNEITERNVMGVPAVFVNGKEFGQGRMTLTEIVAKVDTGAEKRAAEALNKRDAYDVLIVGSGPAGAAAAVYSARKGIRTGLMGERFGGQVLDTVDIENYISVPKTEGQKLAGALKAHVSDYDVDVIDSQSASKLVPAATEGGLHQIETASGAVLKARSIIIATGAKWRNMNVPGEDQYRTKGVTYCPHCDGPLFKGKRVAVIGGGNSGVEAAIDLAGIVEHVTLLEFAPEMKADQVLQDKVRSLKNVDIILNAQTTEVKGDGSKVVGLEYRDRVSGDIHSVALAGIFVQIGLLPNTHWLEGALERNRMGEIIIDAKCETSVKGVFAAGDCTTVPYKQIIIATGEGAKASLSAFDYLIRTKIA

SEQ ID NO: 16522 - protein, 329 aa, Rhodopseudomonas palustris
MGSLNSIAVLGGGAWGTALAQTAARAGRKVTLWEHDAGNAEHLIAARESRFLPGVRLEPSIQVTRDLAEAARADALLLVVPAQVLRQVVTSLQPLIAPRTPLVACAKGIEHGTHRFMTEIIAEAAPAAIPAILSGPSFAADVARGLPTAVTIAATDAACAQALAQAMNSGSFRPYHSTDVRGVELGGATKNVLAIAAGIVEGRQLGASALAAMTTRGFVELVRFGKAYGARIETMHGLSGLGDLTMCCSTPQSRNFSFGMALGRGEGIESAAHGKLAEGYYTAPVLLEMAQAKDIDMPISTAVAAVLGGKLSVDAAIEGLLTRPLKAEE

SEQ ID NO: 16523 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVDETLKFIANRDKVAVLVGSKLRAAGAEEAAVKFTDALGGAVATMAAAKSFFPEENALYIGTSWGEVSYPGVEKTMKEADAVIALAPVFNDYSTTGWTDIPDPKKLVLAEPRSVVVNGIRFPSVHLKDYLTRLAQKVSKKTGSLDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAAKGLKAKTGGELAEAIKVALANTDGPTLIECFIGREDCTEELVKWGKRVAAANSRKPVNKVV

SEQ ID NO: 16524 - protein, 776 aa, Hordeum vulgare
MDSAASTNRSPLRPAAAATATATARRSSSSALPNRVAASRLGVAPGCGGGHFGKAQRFGSVRTTTARAQAGNAGRIATEEKESAMAGTEMPLKYSSGKASPLGVSQVESGINFAIFSQHASSVTLCIKLAERGTKDEESEKLVEFALDCQKNKTGDIWHVLVEGLPTSGVLYGYRVNGPQGWEQGHRFDSNIILLDPYAKLVSGRNYFGVDKGKPSQPFGTYDFDSSPFDWGADYQLPNLPETDLVIYEMNVRAFTADESSGLDPAVRGSYLGFIDKIPHLLELGVNAVELLPVFEFDELEFKRYPNPRDHMVNTWGYSTINFFAPMTRYASAGGGPLAASRELKQMVKALHKAGIEVILDVVYNHTNEADDAHPYVTSFRGIDNKVYYMLDPNNNSQLLNFSGCGNTLNCNHPVVMELVLDSLRHWVKEYHIDGFRFDLASVLCRGPDGSPLDAPPLIREIAKDSVLSRCKIIAEPWDCGGLYLVGRFPNWDRWAEWNGKYRDDLRRFIKGDPGMKGVLATRISGSADLYQVNQRKPHHGVNFIIAHDGFTLCDLVSYNLKHNDANGEGGRDGCNDNFSWNCGVEGETNDSNVLALRSRQMKNFHVALMISQGTPMMLMGDEYGHTRYGNNNSYGHDTCINNFQWEQLAERRYGHFRFFSEMIKFRQNHPILKRDRFLSKNDVTWHEDCWDNLESKFLAFTIHDHNSGGDIYLAFNAHDYFVDAVIPPAPHHKSWNRVVDTNLESPNDITPEGVPLTGSGYRIASYSSILLKAKP

SEQ ID NO: 16525 - protein, 614 aa, Triticum aestivum
MASISGAAAPPSSSSACRLRLRRQLLMRPSHLRLRAPHSIADLSRSSGSPHAPAPPLASRAPGQGGGAAVEKDPIKLWDRYVEWLYQHKQLGLFVDVSRMGFTDDFLLQMEPLMQRAFVAMGELEKGAIANPDEGRMVGHYWLRDPGLAPNSFLRTKIEKTVDHILAFSQDVVSGKIKPPSSQAGRFTQILSIGIGGSSLGPQFVSEALAPDNPPLKIRFIDNTDPAGIDHQIAQLGEELKSTLVIVISKSGGTPETRNGLLEVQKAFRDAGLDFSKQGVAITQENSLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVEEVTPRAVGALVALYERAVGIYASLVNINAYHQPGVEAGKKAAGEVLALQKRVLTVLNEASCKDPAEPLTLEPIADRCHCPKDIEMIYKIIQHMAANDRALIAEGSCGSPRSVKVYLGECNVDDL

SEQ ID NO: 16526 - protein, 980 aa, Methylobacterium extorquens
MLIKRKSGDAARTKHQAVAAGLAAGVLDRRAFLRKSGLTAGALAAAGTIQLGSVRKAQAAGSSAVGPDTVIKKNVCTHCSVGCTVTAEVVNGVWVGQEPSYASPINRGTHCAKGAAIRELVSSDRRLKYPMKLEGGQWKRISWDQAYEEIGDKLVQIREKNGADSVYWLGSAKFTNEASYLMRKFAALWGTNSIDHQARICHSTTVAGVANTWGYGAQTNSYNDIRNAKTMIILGGNPAEAHPISMQHVLSGKEINRANMIVIDPRFTRTAAHATEYVRIRSGTDIPVVWGILWHIFQNGWEDKEFIAQRVYAMDDVRKEVAKWTPDEVERVSGVPGEQLKRVAEKFAKEKPATLIWCMGATQHTVGTANVRALCILCLATGNVGKPGTGANIFRGHTNVQGATDLGLDVTSLPLYYGLVEGGWRHWARVWDVEYEWLQSRFDEVPAKGGRKARTRKENMEAPGITSTRWFDAVNLPPEQIDQRSPIKAFMVFGHGGNTVTRMPEAIDGMNKLELLVVADPHPTTFAALDARQDNTYLLPICTSLEMDGSRTASNRSIQWGEQIVKPAFESKSDYEVLYRLAQKLGFADKLCKNIKIVDGAPEAEDILREINRGGWSTGYCGQSPERLKAHMRNQHKFDLVTLRAPKDDPEVGGDYYGLPWPCWGKPELRHPGSAILYNTSLHVKDGGGGFRARFGTERNGQTLLAENSFSKGSDLTDGYPEFTFGVFKKLGWDKDLTPDELATILKIGGEKPDTVSWATDLSGGIQRVCLDHGVSPFGNGKARANAWNLPDPVPVHREPVYSPRPELVAKYPTRPDERQLRMPNIGFSVQKSVVDRGVAKDFPIILTSGRLVEYEGGGEETRSNPWLAELQQDMFVEINTGDAAARGIKDGQWVWVSGPENGAKTKVKALVTDRVGKGVAFMPFHFSGWYQGKDMRDFYPKGTDPVVLGESVNTVTTYGFDPVTGMQETKCTLCQIAAA

SEQ ID NO: 16527 - protein, 316 aa, Bacteroides fragilis
MAKIAKKLTELIGHTPLMELSGYSRKYGLQENIVAKLESFNPAGSVKDRVALSMIEDAEERGVLQPGATIIEPTSGNTGVGLAMVATIKGYRLILTMPETMSLERRNLLKALGAQIVLTNGQKGMAGSIAKAEELKKSIPGSVILQQFENPANTEVHARSTGEEIWQDTDGEVAVFVAGVGTGGTVCGVARALKKHNPNVYIVAVEPASSPVLEGGKAASHRIQGIGANFVPGIYDASVVDEVMPVPDDEAIRGGRELASTEGLLVGISSGAAVYAARQLAGRPEFKGKMIVTLLPDTGERYLTTELFAFDAYPLD

SEQ ID NO: 16528 - protein, 201 aa, Unknown
  marine gamma proteobacterium HTCC2080
MATVTTPRSASVERTTLETSISVELCLDGSGQVEFDTGVPFLEHMLDQIARHGMIDLKVIAKGDLHIDGHHTVEDIGITLGQAFYKAVGEKTGLARYGHAYVPLDEALSRVVVDFSGRPGLVWEVPFTRGMIGSFDVDLFVEFFQGFVNHALVTLHVDNLRGHNAHHQAETVFKAFGRAMRMALTPDPAMAGITPSTKGTL

SEQ ID NO: 16529 - protein, 384 aa, Physcomitrella patens
  misc_feature (136)..(137): Xaa can be any naturally occurring amino acid
  misc_feature (153)..(153): Xaa can be any naturally occurring amino acid
  misc_feature (355)..(355): Xaa can be any naturally occurring amino acid
  misc_feature (363)..(363): Xaa can be any naturally occurring amino acid
MASEGSINRDTEKFQQELAYKCPRSSDLLLAITTSANTAVREHGSSAERRRRGNSGLFGNMSLLTEDEDDAPDAQDHEFEDNPQSEQDLELRAAIIDHPFYPEMVLAHVRVFKIGAPGRLRRKLDELAKKFQRFQXXDHTSKIGSDPELDHFXRSYVGVLTKFAEDLEEPFNKFIQFTDNTSKALEEICGHYVDTTPDEDNCGFDIGPLEYGAQEGDDLDTLGDENVMYPLDIDESVIVDPMASDEDIKKALRKKYGRHIGELKAEFNRVRKKGKLPTSARTILKDWFNRHSHWPYPSEMEKQYLQRICGLNLKQINNWFINERKRHWSCEGKCMHPNAKFYGTSNGQCRGHLEXEQSNRLQXSSEETIYVKCSHAALIFEVSM

SEQ ID NO: 16530 - protein, 529 aa, Unknown
  Erythrobacter sp. NAP1
MLDANMQIQLKQYLANLREPIELVASLDDGEKSAQTRELLTEIAELHEMVTASFDGTHERKPSFIIRRASDANKWVRFAGLPMGHEFTSLVLALLWAGGHPPKVDADLIEQVRALEGDYEFEMFFSLSCHNCPDVVQALTLMALENTHITATLIEGGTFQDEVEERGVLAVPATFLNGESFYNGKMELAEILSKLDSGADEKAAEKLSAKDPFEVLVIGGGPAGAASAIYTARKGFRTGIAAERFGGQLQDTLGIENLPGTSYTEGPKLSDDLKKQVAENEIDMMDLARATELRPAKEAGGMHEVTLANGAVLKSRSLILSTGARWRNLGVPGEAEYRNKGVAYCPHCDGPLFKGKRIAVIGGGNSGVEAAIDLAKIVGHVTLIEFDAKLRADEVLQRKLRSMDNVEIITSGQTTEITGDGARVNGLVLKDRESGDERRIDLEGVFVQIGLVPNTEWLADTGLELSKFGEIIVDDHGATNLPGIYAAGDATTVKDKQIVVAMGTGATAGLGAFDYLIRNEPVDEIAQAA

SEQ ID NO: 16531 - protein, 726 aa, Unknown
  Erythrobacter sp. NAP1
MDAKTGEMSGCPFHGDGGTRTLLGRTNMDWWPETTQLDLLTEEGKSANPYGEDFDYASAFNAIDYQALKDDLTALMTDSQDWWPADYGHYGPFFIRMAWHAAGTYRTGDGRGGAGSGQQRFAPLNSWPDNGNLDKARRLLWPIKQKYGKGISWADLYILAGNVAIESMGGPVFGFGGGRADVFEPEMVYWGTEEKWVDTGAETRIIPDEGRALENPLAAIQMGLIYVNPEGPGGNPDPLESARDMRETFARMAMNDEETVALTAGGHAFGKAHGAQPADTFGEAPEGMHLEHQGFGWLHDAEEIGKGHITTSGIEGSWSNNPTSWSHDYFRLLFKYDFELTHSPAGAQQWTPINPDPEDMAPDARDPSKKVPTIMTTADMALKMDPEYRKISERFHANPEQLDDAFARAWFKLCHRDMGPKVRYQGPEVPAEDLIWQDPVPAGTAPSDADVSAFKDAILGSGLTVSELVKAAWASASTYRKSDHRGGSNGARVRLAPQNGWAANDPDELAKVLAKIDEHRGSMSMADAIVLAGTAAVEKAAKDAGFDVSVPFTGGRGDAGDEHTDAESFEPLEPFADGFRNYLKTKANVKTEDMLIDKAHLLGLSIPETTVLVGGMRVLGANSGNRKHGVFTDRVGQLTPDFFTNLLDMGTKWAPVDGSGDEEYVGSDRASGEEKYRATRTDLIFGSNSQLRAQAEVYAESGAEEKFVHDFVAAWTKVMNAGRFDI

SEQ ID NO: 16532 - protein, 294 aa, Leptospira interrogans
MSVISMKNLLETGVHFGHQTRKWNPKMAPYVFTARNGIHIIDLQKTVQKAKEAYDALKKLTSEGKKVLFVGTKKQARGAIEREAIRSNMFFINNRWPGGLLTNWNTVKRSIARLKKLEGMEADNSFEKEVKTKKEVLTLRRELEKLRKTLGGIKDMATIPEIMFVIDPKKEEIAVKEARKLGLKIFAVVDTNCDPELIDYPIPGNDDAIRAISLFLETMSNAVIEGTGGVVEQPRFSEDLDSEALALEYQGEYDESGKFIMDEDPDSKKTKTAEEPSATIEPSTTTTVEVDQNE

SEQ ID NO: 16533 - protein, 244 aa, Aspergillus niger
MPLPARTASITRITNETKIQISLSLDGGILPPYEPCAHFPAPTDPAEVEASKKGIIPNKAAPHATQFTPTQQITINTGIGFLDHMLHALAKHGGWSLAVRAKGDLFIDDHHTTEDTFLALGSAFTEALGARQSLARFGRGDAPLDEALSWAVIDLSSRPWAVINIGFRREKIGDLSTEMITHGLQSFAQAAGVTLHVGCTYGDNDHHRAESAFKALAVAIRTACTRRVEGEVGAGDVYLVGGGV

SEQ ID NO: 16534 - protein, 340 aa, Ricinus communis
MGEEANHNNNNNNINSNDEKNEEKSNYTVVNSRELYPTNIFHALLALSIWIGSIHFNLFLLFISYLFLSFPTFLLIVGFFVVLMFIPIDEHSKLGRRLCRYVCRHACSHFPVTLHVEDMNAFHSDRAYVFGYEPHSVFPLGVSVLSDHFAVLPLPKMKVLASNAVFRTPVLRHIWTWCGLTSATKKNFTALLASGYSCIVIPGGVQETFYMKHGSEIAFLKARRGFVRVAMEMGKPLVPVFCFGQSNVYKWWKPDGELFMKIARAIKFSPIVFWGVLGSHLPLQRPMHVVVGKPIEVKQNPQPTVEEVSEVQGQFVAALKDLFERHKARVGYADLTLEIL

SEQ ID NO: 16535 - protein, 349 aa, Zea mays
MGGLTMDQAFVQAPEHRPKPIVTEATGIPLIDLSPLAASGGAVDALAAEVGAASRDWGFFVVVGHGVPAETVARATEAQRAFFALPAERKAAVRRNEAEPLGYYESEHTKNVRDWKEVYDLAPREPPPPAAVADGELVFENKWPQDLPGFREALEEYAKAMEELAFKLLELIARSLKLRPDRLHGFFKDQTTFIRLNHYPPCPSPDLALGVGRHKDAGALTILYQDDVGGLDVRRRSDGEWVRVRPVPDSFIINVGDLIQVWSNDRYESAEHRVSVNSARERFSMPYFFNPATYTMVEPVEELVSEDDPPRYDAYNWGDFFSTRKNSNFKKLNVENIQIAHFKKSLVLA

SEQ ID NO: 16536 - protein, 662 aa, Pasteurella multocida
MNTIKSGKPSPLGCSKQTEEGQDGYNFALFSQAARRVELCLFSEGQERRVDLQPSDDGIWHIWLSDVSVGTEYAYRISGKTDRTLANSNKLMLDPYAKAVVGKPDLSTPEKRAWFDLNDPRDNAHLAPKAVIIDEAFDWQGDKPLRTPWAQTVIYEMHVKGFSQLREDLPEALRGTYAGLAHPNMIAYLQDLGVTAVELLPVQYQADEVHLQEKGLANYWGYNPLAMFALEPRYSSQHSSMGALHEFKTMVKALHQAGIEVILDVVFNHTAESEKYFPTFSQRGIDDETYYWQDAQGYYHNWTGCGNTLNLSQPITRRWVLDCLCYWVEACHVDGFRFDLGSVLGREGEGGFNPQAQLFADIQAEPRLQGCKLIAEPWDIGDFGYQMGNFPAYFAEWNDRFRDDVTRFWLWKSGESGAFAQRLAGSSDLFQQTRQVHNSINFITAHDGFTLRDLVSYNEKHNWANGENNRDGRNHNYSYNHGVEGIDNVPSAVENGRILSSIALLMNLLLANGTPMLLAGDEFGNSQFGNNNAYCQDNEIAWLKWQDFNPVLFNATKQTIALRKQIASLQQDCWWSEVNVQWLNTKGEPMTIADWHNQESKALQVLLDNKWLFLINAKQKLQTFSLPEGDWEVMYCATNLTTQGGFIELDDVTFGVLQQLNK

SEQ ID NO: 16537 - protein, 439 aa, Pasteurella multocida
MEVIMNSSIVKLPNKYELVKDTLVLILAGGRGSRLYELTDKRAKPALYFGGNRRIIDFALSNCLNSGLNRIGVVTQYAAHSLLRHLQNGWSFLPAERGEFIDMLPARQQIDDSTWYRGTADAVYQNMAIIRDHYCPKYILILAGDHIYKQDYSQMLLDHIHSGAKCTVGCIEVEREKATEFGVMAVNENLKVKSFVEKPKDPPAMVGKPNTSLASMGIYVFDADYLYDVLEREVSSPYTSHDFGKDILPKALEEGVLYAHPFSRSCMGRNTEGEIYWRDVGTLDSFWQSNIDLVCENPQLDIYDQSWPIRGNPVQTYPSKFFYKKENARPVDNSLISGGCVITDASISYSVLFDRIKINEGSQIDHCVVLPQVTIGKNCKLKRCIIDRHSVIPDGMEIGVDLELDRQRFRVSSGGVVLVTPSMLKKLNGEEVASEAHLD

SEQ ID NO: 16538 - protein, 363 aa, Pasteurella multocida
MTQQSILFIDRDGTLIDEPKTDFQIDSLEKLQFEPNVIPALLKLKPYYRFVMVSNQDGLGTASFPQENFDKPHNAMMALFKSQGIEFDEVLICPHKPEDECDCRKPKIKLLKKYIDKKLFDPTTSFVIGDRATDVQLAENLGIRALQYDREKLNWDLIVEKLLPKQTALLDRKPRYAEVVRTTKETDIKVQVWLDETGMNDIKTGVGFFDHMLDQIATHGGFRMNVYCKGDLWIDEHHTVEDTALALGTALKQALGDKRGIQRFGFVLPMDECKAECTMDLSGRPYFKFKAKFKRDKVGDFSTEMTEHFFQSLAYTLMATLHLKTKGDNDHHKIESLFKVFGRTLRQCIKVEGNELPSSKGVL

SEQ ID NO: 16539 - protein, 158 aa, Listeria innocua
MNVHDFSEKAMNGKEIALSDYKGKVLLIVNTASKCGLTPQLEGLEKMYKKLGGDNFEILGFPCNQFLRQDPGSDEEILEFCQMNYGVTFQMFSKIKVKGKDAAPLYKYLTEQTGGKKVEWNFAKFLIDENGEVVERFPSKMKPEDFEDKVEALVAAVK

SEQ ID NO: 16540 - protein, 306 aa, Aeropyrum pernix
MFLKWSWFLEWLTPDRATLKHIEDVIFQGRSRFQEIAVVRVSGEGKVLVLDGKTQSSESDEFMYHEALVHPAMILHGSPRKVLILGGGEGATLREVLKHRSVEKAVMVDIDETVVNVAREHLREWHRGAFDDPRAEVVIDDAWNYVASKAETGFDVVIADLVDPLEAGPATRLYSEEYYRMVKDVMNPGGVFVTQAVSISHLTEYHAIIRNTVARVFKHVESYGVYVPSFDSMWGFVVASDDKDPRILGDRGFFETRLSHQLQGAELRFLDYASMLHMLNIPKMYREAIAREKRYATLDNQVFLPA

SEQ ID NO: 16541 - protein, 513 aa, Rubrobacter xylanophilus
MIYLVGSGPGDPGLITAKGLRLLEEADAVVYDRLAPGALLRRARPDAELFYVGKRPGDDQAMKQDEINALLVRLGREGRRVVRLKGGDPYVFGRGGEEALALLRAGVPFEVVPGVTSGIAAPAYAGIPVTHRALASSVAFVTGHEDPSKGRTDVDWERVARGADTLVLYMGVGRLGEIASSLVAAGRDPATPAAVIRWGTVPEQRTVTGTLADIAQRVAEAGIRPPAVTVVGEVVRLREEGLAWYEARPLFGRRVVVTRARAQAGELSRRLEELGAAVVEFPTIEIRPPRDFGPLDEAIRGLDSFDWLVFTSVNGVEAFLERLASHGLDVRAIPRGARIAAIGPATAGRVREAGLRVDVVPREYRAEALLEEISGEPLRGRRVLIPRAARAREVLPERLREAGAEVSVPPAYETVPSAEGREELARGLQAGEVDCVTFTASSTVENFVAAFGAREAARLLAGTRVACIGPITAAAARERGLRVDVEAGEYTIEGLVRAVAGLFAARAPQERVG

SEQ ID NO: 16542 - protein, 619 aa, Unknown
  Azoarcus sp. EbN1
MINRPWISSDMHRKVEGPRLLARITGAISRNAPLHGAGRSNSLSGLVEFRSGFCSHDGGVAVHRAGDLVCMALGSPRFEPGALHERASTAGIAAAWLDAFRERGARAPAAAKGRFAVVVLNGGEGSAWLAVDRFGTHPLCHAIEDGMLAFATRADEVPVVAKALDTQALFDYLYFHMIPAPRTVFAGVERLLPGHVLHWRDGKARSERYWTPRFAPDRSLDLEAGKLRFLEIVESAVARETSDGQPGAFLSGGTDSSTVSGMLCRVLGRPAPTYSIGFDAAGYDEMAYARIAAKHFGTDHHEYYVTPDDLIEGIPKVAAYYDEPFGNSSVVPSWLCARNARNDGITRMLAGDGGDELFGGNSRYAKQRIFGFYDAVPGVLRSSMLEPMLGLRGMDRVPVVKKAASYVSQARVPLPDRMGMYNLLLRLGPTHVLTADFLGLVQQEAPLAAQRTVWAETAGQPLVNRMLAFDWKYTLADNDLSKVLGSTALAGVEVAFPLLSDELLEFSLTLPAEWKLKGLTLRWFFKEALRGFLPDEIIAKKKHGFGLPFGVWASQHAGLRSMARDSLETLKQRGIVRGAFIDDLLTNLLPAHPGYYGEMVWILQMLELWLREHAPEYRL

SEQ ID NO: 16543 - protein, 297 aa, Glycine max
  misc_feature (128)..(128): Xaa can be any naturally occurring amino acid
SYVGPPPRYADVSWPGEAHTYKIEKILFHGKSEFQELLVFESSRQGKVAILDGHIQLTENDEFAYQEMLTHLALCSIPDPKKVLLIGGGDGGILREISRHSSVEHIDICELDQMVIDVYSEFFPDIAXGYEDPRVHVHISDGVAFINSVPEGTYDVIISDAFPAMGHSADVLADECFLESVAKALRPGGVFSAPADSLWHKNFVVADTIANCKKIFKGSVNYAWTTVPTYARHFLSNYIGVIGFMLCSTEGPPVNFKHPINKLNPEKNGVAKGPTKFYNPEIHAAAFCLPSFVDKVD

SEQ ID NO: 16544 - protein, 358 aa, Mycobacterium smegmatis
MAAMETSTAPLDEPAGLTDADGFTPLRVKDVIRETTDAVSLILDVPELIEDRFRYTAGQFVTVKTTIRGEEHRRCYSMSSSPHVGPDLRITVKRDRDGVVSNWINDTAAAGDRLLTAPPDGRFVLTTADRDVVTFAGGSGVTPVFSLVNTTLATTGRRVRMFYANRDADSVIFRDALTRLTDSHSDRLHVHHHLDTRDGVVSARHITEFLGASTVSTAEADFYICGPAPFMDTVERVLLDAGVPAQRVHLERFTVTPADPAVEAESAATEEVTIVLGRTTVTQPYRAGTTLLQTARLAGLKAPSSCEVGTCGTCIGQVVEGSARLLNNDALDDDEIAEGWVVTCQALPTSHTVKVVYE

SEQ ID NO: 16545 - protein, 487 aa, Salmonella typhimurium
MSLSKDNIWKLLAPLVVMGVMLLIPVPDGMPPQAWHYFAVFVAMIVGMILEPIPATAISFIAVTICVIGSNYLLFDASELADPAFKASKQALKWGLAGFSSTTVWLVFGAFIFALGYEVTGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGVQISWLQWFLSFLPVGIILLIVAPWLSYVLYKPEVTHSAEVAAWAGGELKNMGRLSRKEWTLIGLVLLSLGLWVFGGKIINATAVGLLAVSLMLALHVVPWKDITRYNSAWNTLVNLATLVVMANGLTRSGFIDWFANTMSTHLEGFSPDATVIVLVLVFYFAHYLFASLSAHTATMLPVILAVGKGIPGVPMEQLCILLVLSIGIMGCLTPYATGPGVIIYGCGYVKSRDYWRLGAIFGVIYIAMLLLVGWPILAMWN

SEQ ID NO: 16546 - protein, 412 aa, Hordeum vulgare
GGPGCSSFDGFVYEHGPFNFESGGSVKSLPKLHLNPYAWSKVSTMIYLDSPAGVGLSYSKNVSDYETGDLKTATDSHTFLLKWFQLYPEFLSNPFYIAGESYAGVYVPTLSHEVVKGIQGGAKPTINFKGYMVGNGVCDTIFDGNALVPFAHGMGLISDEIYQQASTSCHGNYWNATDGKCDTAISKIESLISGLNIYDILEPCYHSRSIKEVNLQNSKLPQSFKDLGTTNKPFPVRTRMLGRAWPLRAPVKAGRVPSWQEVASGVPCMSDEVATAWLDNAAVRSAIHAQSVSAIGPWLLCTDKLYFVHDAGSMIAYHKNLTSQGYRAIIFSGDHDMCVPFTGSEAWTKSLGYGVVDSWRPWITNGQVSGYTEGYEHGLTFATIKGAGHTVPEYKPQEAFAFYSRWLAGSKL

SEQ ID NO: 16547 - protein, 450 aa, Lactobacillus acidophilus
MRRGKNLEQKKSGLPTLASTTIWMISLGYLGVQIAFTLETSQMSRIFQTLGADPTKLGWFFILPPLAGLLVQPGIGSLSDRTWIPKIGRRLPYLLIGMVFAVITMIILPNVGSFGLGYGSLEALVFGAVAIAVLDVASNMAMQPFKMMIGDMVNDDQKSYAYGIQSMLSNFGAVIAAFFPFLLTSLGVANTAKKGVVPQSVVISFYVGAAVLVVTSLFTIFRVHEYDPETYARYHGIKESDNKEGGGWIELLKKAPKVFWQVSLVQFFSWISFQYLSTYATGAIAQNVWHTTSASSSGYQIAGNWFGVLTAVQSIAAVIWSYVLAKVPNNHHKLGYGVSLFLGAIGYTSIFLVHSQMMLIVSFILIGISWAGMNTYPLTMVSNALSGKHMGTYLGLFNCSICLPQIVASLLSFIIFPLVGNSMPAMMLITGISGFLAALSVISIKETYVK

SEQ ID NO: 16548 - protein, 820 aa, Unknown
  Nostoc sp. PCC 7120
MPMSTLSFWQFFPSAKKPVCDSPSSLQTNPVRHSRSLLAKVIVGGTTLFVVVGAYFSYQTVRSIMLTNLKGQVLSEVEQSRDEIDHWLAMLKVRVEMLANTDLVRSVDWAIASKYLKAEDQRIEDFSLFGLTTPEGWRESTVPNSKRANVTDRRWFQRSIAGYVHVGDPMIARANGISSVPISSPIRRDGNLSSSPIGVVHGSVSVDRIKYVTETLKYGENSYAFTLNSAGQAIIHPNPAFMTTIEKPGIKLVEAADSGLAAIAQKMVNQQQGIELVTLDKTKKYVAFLPLKEANWSVALVIPRENIESQLKLLDIIALAILALAGTLIGVLVYVQSAEQTQLKQSKALADAAKESADSANNAKSEFLANMSHELRTPLNGILGYAQILGRSKVLPDKERQGVNIIHQCGSHLLTLINDILDLSKIEARKLELASQAFHLPSFMQGVVEICHIRVQQKGIEFHYEPDADLPAGISADEKRLRQVLINLLGNAIKFTDRGSVALRVQRTGLEESDPRTKLRFSIVDTGVGIASADINKLFQTFEQVGEQKRKVEGTGLGLAISQQLVQLMGGQIQVKSQLGVGSEFFFEIILPLASDWSQQQTASVGNIIGYEGVKRHILVVDDRWENRAVLLNLLEPLGFIITEAENGQAGLDQLQQHLPDLVITDLVMPVMDGFEMLRKIREQEQLRSLKILVSSASVAQIDQQMSIDAGGDDFLAKPVQVNDLFTLLEKHLELTWKTEDITHKSADQQQLTELIPPPLADLQSWLELVQEGRLKKLIAAAEQLAQESDRYQPFTQQIIQLAKQFQSEQLEQFIQQYLS

SEQ ID NO: 16549 - protein, 427 aa, Clostridium thermocellum
MNDAIVKSTMENFDKDVLKSDIPVAVLFYTESCPVCDAFMPIFERTAQKYGKYMKFVKIYRQQNRQLVEDLKIKSSPTVLFYKEGNEVCTRLNGYISNAEFVEAIERVIGDVCKGEKREKVHCDFLILGGGPAGLTAAIYAARAKLHTVVVDEGLIGGQVATTFQVANYPGTNGVVRGIDLMENMKKQALDFGAYIDDLKEISDVNLEGKEKLVTAKDTDYYAKAVLIATGATPRRLPAEGEKEFRGRGVHYCATCDGAMYFDANILVVGGGESAAEEAVFLTRYAKHVTIINRHDYLKASKTAQDEVFRNPNISVVWNSEVRKINGDSFVKSVTIENLKTGKIEEIETDGLFVYIGTQPKTELFAGKVGMNEEGYILTNEDMATNIPGVFAAGDVRAKKVRQIATAVGDGAVAGIMAERYINGKFY

SEQ ID NO: 16550 - protein, 267 aa, Unknown
  uncultured archaeon
MVKGWPNPGELVVCTVTKVVDFGAFVALDEYDNKEGLIHISEVASGWVKYIRDHVREGQKIVCKVLDVNPKRGHIDLSFKDVNEHQRRETIQLWKNDQKALKWLQFVAEETKLQPKELEDLEDTIRDEFGNLYAVFEEVVHDGPQGLIKAGIPQNIADAINRIAHENVKVPSVDIAGYVDLLCPTSNGVEIIKKALKAAGSIDAGEGVTVDVTYVGAPRYRIHVIAPDYKKAEKVLNTAARAAIDYVKKHEGEGEFHRHMEEAKSIS

SEQ ID NO: 16551 - protein, 541 aa, Oryza sativa
MRCFASLAIAPSYNWGKDRHPRLPLENLVVYGANVALFTKDRSSGLPDDAAGTFTGLSAKVEHFRSLGVNAILLEPVFPFHQVKGPYFPYHFFSPMNLYSSKGLSVSAIKSMKDMVRVMHRNGIEVLLEVVFTHTAEGESECQTISMRGIDNSSYYIANGIAGCKASILNCNHPVTQKLILDSLRHWVLDFHVDGFCFINAPFLVRGPGGEYLSRPPLLEAITFDPVLSMTKIIADPWSPLDISNVQFPFPHWKRWAEVNTRFSIDVRKFLKREALISDLATRLCGSGDLFSTRGPAFSFNHVSRNSGLSLVDLVSFSNDDLLSESSWNCGEEGPSENSAVLQTRLRQIRNFLFILFVSLGVPVLNMGDECGHSAAGSVSYKDRGPLNWRGMKTTFVKEVTGFISFLTALRSRRGDIFQRREFLKLENIHWYGSDLCEPGWDDPTSNFLCMHINAEVDEMAADSVRGDLYICFNANEESVSAALPALAEGSVWLRLVDTSLAFPGFFATESNPKVQQVPGLSSYHVEAHTCVLFESKSALA

SEQ ID NO: 16552 - protein, 239 aa, Triticum aestivum
  misc_feature (177)..(177): Xaa can be any naturally occurring amino acid
MAAPPSSVSVRAGASVSAKLTPRQAARAGFGGRVSVSSGRKCGGPVRASLFSPKPAVAMDARPTKVQELHVYELNERDRESPAYLRLSAKQSQNALGDLVPFTNKVYNGSLDKRIGITAGICILIQHVPERNGDRYEAIYSIYFGDYGHITVQGPYLTYEESYLAVTGGSGVFEGVXYGQVKLNQIVFPFKIFYTFYLKGIPDLPKELLCTPVPPSPTIEPTPAAKATEPHACLNNFTD

SEQ ID NO: 16553 - protein, 154 aa, Bacillus thuringiensis
MGYVEELRKIVGHRPLILVGAVVLVINEHGYVLLQQRTEPYGKWGLPGGLMELGESPEETACREVYEETGIEVKNLQLINVFSGANYFTKLANGDEFQSVTTAYYTDEYDGDFVMNKEEAVQLTFFPLTELPDYIVGSHKKMIAEYMKIMEKKI

SEQ ID NO: 16554 - protein, 112 aa, Rhodopseudomonas palustris
MKLVVAIIKPFKLDEVRQALTEIGVHGMTVTEVKGYGRQRGHTEIYRGAEYIVNFLPKLRIEIAVDSALADKAVEVITRGARTGQIGDGKIFVTPIDRALRIRTGETDVDAL

SEQ ID NO: 16555 - protein, 258 aa, Streptococcus mutans
MKISLLQLDIKDGQSHVNQANVQNLLQEALLEEPDVIVLPELWNSGYALDKLEKIADEDGKVSRPWLSQFAEKHGVTLVAGSVATKRKGQFYNTAYSFSSKGQLINTYDKVHLFGLMAEDKFLTAGQRESHFQIGTVGASHVICYDIRFPEWIRHLMSQDAALLFVSAQWPSSRIEQWRILLQARAIENQAFVIAVNRVGQGLKDQFNGHSLIIDPLGKILLEANDCEGVFSAQIDLNQVKKVRGQIPVFKDRRLELY

SEQ ID NO: 16556 - protein, 750 aa, Shewanella oneidensis
MTSAALINSGGSLPYSVSAGKAFPLGATVDDGGVNFALFSAHATGVELCLFDAQGKVEIQRIALTEQTQQIWHLYVHGLCAGQLYGYRVYGPYEPQLGHRFNPHKLLLDPYARQLVGRYHHHIANFGYELDNPNEDLSFSTLDNAAYMPKCKVVDIRPLLAAAESQAIRPLSPHRNPLPIEQCIIYEMHLKGFTALHPEIDVPLRGTFAGLASKAAIDYLVKLGVNCVELLPIQAFFSEPFLLEKQLSNYWGYNSIGFFAPEPSYLSSEDIIEFRTMVDALHGAGIEVILDVVYNHSAEGSRLGPTFSFRGIDNLSYYRLHPNDKRFYINDTGCGNTLNLNHPRMLQLVLDSLRYWVKVMGVDGFRFDLAASLGREAYGFDPGSGFFDALLQDPVLCRVKLIAEPWDIGPGGYQLGNFPVAFSEWNDRYRDTMRRFWRGDHGMLPEFARRFHGSGDFFEHSGRPPAASINFLTSHDGFTLKDLVSYCERHNWANGEENRDGHHANFSYHYGVEGASNDVSVLVLRARQQRNLLTTLFLSQGVPMLLSGDETGRTQGGNNNAYCQDNPMNWFDWSSEGMDKHLLSFTQQLIALRKRFPLLCAKRFIHEQLVARSLESPSESPLGAAKFLTQPSARLDWFSRQGKPMTKSLWSESMCRSLCVVLSGDLTAGIDVAGDNSFQALLLMVNADEHPLAFTPPVFEHLGPWQCLLHTQTEPQYLTPTEPLDAQSSPTRYLLQDRSLMLFHADFIRN

SEQ ID NO: 16557 - protein, 387 aa, Zea mays
MALQAALLPSTLSSVPKKCSLAVAAKDTAFLSVSQKKVQAASLSVRTRVATTAPVATPGSSTAAKDGKKTVRQGVVVITGASSGLGLAAAKALAETGKWHVVMACRDFLKAAKAAKGAGMADGSYTIMHLDLASLDSVRQFVDSFRRAGMPLDSLVCNAAIYRPTARTPTFTADGYEMSVGVNHLGHFLLARLLLDDMQKSDYPSRRLIILGSITGNTNTLAGNIPPKAGLGDLRGLAAGLRGQNGSAMIDGSESFDGAKAYKDSKICNMLTMQELHRRYHEETGITFASLYPGCIATTGLFREHIPLFRLLFPPFQKFVTKGFVSEAESGKRLAQVVSDPSLTKSGVYWSWNKDSASFENQLSQEASDPEKAKKLWEISEKLVGLA

SEQ ID NO: 16558 - protein, 125 aa, Oryza sativa
  misc_feature (66)..(66): Xaa can be any naturally occurring amino acid
  misc_feature (112)..(112): Xaa can be any naturally occurring amino acid
MGGRVGSSSQSKKLSCSCSWMAYMATTGSRLLKTSFGGARLPGAGRNPTVSVAPCTGSTICNSISXSDTVPNYDLNAMRVRPIKECIVSCEMTRLYMTRMITYADTDVLVVXGAGSAGLFCAYEL

SEQ ID NO: 16559 - protein, 527 aa, Arabidopsis thaliana
MEEISPAVALTLGLANTMCDSGISSTFDISELENVTDAADMLCNQKRQRYSNGVVDCIMGSVSEEKTLSEVRSLSSDFSVTVQESEEDEPLVSDATIISEGLIVVDARSEISLPDTVETDNGRVLATAIILNETTIEQVPTAEVLIASLNHDVNMEVATSEVVIRLPEENPNVARGSRSVYELECIPLWGTISICGGRSEMEDAVRALPHFLKIPIKMLMGDHEGMSPSLPYLTSHFFGVYDGHGGAQVADYCHDRIHSALAEEIERIKEELCRRNTGEGRQVQWEKVFVDCYLKVDDEVKGKINRPVVGSSDRMVLEAVSPETVGSTAVVALVCSSHIIVSNCGDSRAVLLRGKDSMPLSVDHKPDREDEYARIEKAGGKVIQWQGARVSGVLAMSSLCKIMRSPESGFQSASFSGDQYLEPFVIPDPEVTFMPRAREDECLILASDGLWDVMSNQEACDFARRRILAWHKKNGALPLAERGVGEDQACQAAAEYLSKLAIQMGSKDNISIIVIDLKAQRKFKTRS

SEQ ID NO: 16560 - protein, 922 aa, Bradyrhizobium japonicum
MTKITFELDGKQVEASPGETIWQVAKRQGREIPHLCYSPAPDYRPDGNCRACMVEIEGERVLAASCKRTPSVGMKVKTESARAVSAQKMVMELLVADQPARETSHDPDSKFWHWAETTGVTESRFPAAERWATDASHPAMRVNLDACIQCGLCVRACREVQVNDVIGMAYRSHGSKIVFDFDDPMGESTCVACGECVQACPTGALMPAVMLDENQTRVTYADKKVDSLCPFCGVGCQVTYEVKDEKVIYAEGRDGPANHNRLCVKGRFGFDYIHHPHRLTKPLVRLPNAKKDANDQVDPANPFTHFREASWEEALDIAAKGLVKIHDTNGAKALAGFGSAKGSNEEAYLFQKLVRTGFGSNNVDHCTRLCHASSVAALFEGLSSGAVSAPFSAAMDAEVIIVIGANPTVNHPVAATFIKNAVKQNGAKLFVMDPRRQTLSRHATKHLQFKPGSDVAMLNAMINTIITEGLTDDQYIAGYTEGFEDLKEKIKEFTPEKMEAICGVPAQTLREVARTYARAKSSIIFWGMGISQHVHGTDNARCLIALALITGQVGRPGTGLHPLRGQNNVQGASDAGLIPMFLPDYQPVGRDDLRGAFEKLWQQDLDPVRGLTVVEIMNAIHAGEITGMYIEGENPAMSDPDLQHARHALAMLDHLVVQDLFVTETAFHADVILPASAFAEKEGSFTNTDRRVQLARQVIKPPGDARQDLWIIQEIGKRMGLPWNYAGAGDVYTEMAELMPSLKNISWERLVREGAVTYPADDPNKPGNEIIFTTGFPTASGRGKIVPAKVIPPDELPDAEYPMVLSTGRVLEHWHTGSMTRRAQVLDQIEPEAVAFMSPKDMHKKQLAPGDFIRLETRRGAVEVKVRSDRDVPENMVFMPFCYAEAAANLLTNPALDPFGKIPEFKFCAARAERVEMRDAAE

SEQ ID NO: 16561 - protein, 316 aa, Unknown
  Synechococcus sp. WH 8102
MSTPGTVLITGTTSGVGLNATCALVKRGWTVITANRSPQRAAAAADDMDLPKERLQHVLMDLGDLDSVRRAVDALPDRLDAVVCNAAVYKPKLKQPERSPQGYEISMATNHLGHFLLVQLLLGRLQNSSHPSRRVVILGTVTANSKELGGKIPIPAPADLGDLSGFEAGFKYPVAMASGKPFKPGKAYKDSKLCNMISTQELHRRLHGESGITFTSLYPGCVADTPLFRNTPKAFQTIFPWFQKNITGGYVSQALAGERVADVVAHPDFAESGVHWSWGNRQKKDGQQFSQELSDKATDPDTARRVWDLSMQLVGL

SEQ ID NO: 16562 - protein, 518 aa, Unknown
  Candidatus Tremblaya princeps
MHDHIRLLREYCKYYDAGPGSIVAARVVAISSNHVVLRAGLKSDSRVPLGEFVSPQGDRLEVKVGDVTLAYVERDAYDEGTVRLSRSKARRRVAWGILDSAHRTRGTIMGTVVGRVKGGMTAVVNGMRAFLPGSLIDTRPVKDAERYEGRRLRFHVIKLDRKRGNVVLSRRSVIERRQAENRNRLLASLGDGDVVQGVIKNITDYGAFIDLGGLDGLLHITDISWRRIRHPSQVLSVGDRITVKVLKFDRTKTRVSLGLKQLHPDPWAGIIGRYPAGSRVRGRVTNIADYGLFVEIERGIEGLLHVSEMHQKSKGTISLRHFRVGQYVNVTVLDVSKTRRRISLGMKHGTLNPWLTFYKGFRKNDRMGAIIRSPVDVGILVDLPMGVHGVVCMSKDLRRRLLRALCSGGVVEARVVGVDVNRGRISLASGFALGPLGVRILAPGFIRPGAFVRMAPPMRPCCLNVRAAPCAAAKAQCALRGAHVAIRLLSAISIRPRSVACAIRGAMRANHGLVPCLP

SEQ ID NO: 16563 - protein, 572 aa, Desulfovibrio desulfuricans
MESKEAALRQKKGVSACNGRNIRLCRSVVITRCRKTHGKETYKIMVEKLLFADLPLSKEVLRAIQDMGFEEASPIQTMSIPHILAGKDVVGQAQTGTGKTAAFGIPILERIDPRDKATQAVVLCPTRELAIQVAEEVTTLARHKRGISVVPVYGGQPIERQVRALRRGAQVIVGTPGRVMDHLDRGTMDINTVKMVVLDEADEMLDMGFRDDIEFILGKMEQEVQTVFFSATMPRAILDMAQRYLKEPEFLKVTQKLLTVPSIEQIYFEVRPFQKLESLCRVLDVYNPKLTIVFCSTKVGVDELATNLQARGYDADGLHGNLNQAQRDRVMNRFRKGNIDILVATDVAARGIDVENVEAVVNYDIPNDVESYVHRIGRTGRAGRAGRAFTFVSGREFYKLRDIKRFTKAQIAQRQVPSLSEVENAKFTQMLNEVTNQIRTGGLERYIELVEGIIGEEFTSVEAAAALLRMMMHRNAGDAVTEEQKFGDTGAQPGMVRLFFNVGRKARVTARDFVGAIAGETGLPGRMIGSIDIYDRFTFVEVPNEFAAEVLAVMNGNQIRGNKLAVEPASRR

SEQ ID NO: 16564 - protein, 67 aa, Brassica napus
MQNLSSAGVTVVEEAVNCPSISKLACQYASIFRSFLEKSRLPVWNMSKSCGFWRQLTVCVLQDTLLC

SEQ ID NO: 16565 - protein, 77 aa, Medicago truncatula
MVRCFSLGSVLILIALAASMVVLPLMLPPLPPPPLALLFFPVGIMAALVVLAFSPSENVKNVVVYSSSSSGIANSKR

SEQ ID NO: 16566 - protein, 132 aa, Arabidopsis thaliana
MDSQVQFFEGVEKRIEFDFAGTNLRDELNRAVLEKIVKPVECVIEGVLSGDHVDSYLLSASSLFVYDDLVIIKTCGATKIFECINGIVAAVGWNKLRSIKYTRGSFFRPDLQPYPHQRPCDEKRCVRLVPKS

SEQ ID NO: 16567 - protein, 553 aa, Vibrio vulnificus
MFCIQCEQTIQTPAVKGCSFAQGMCGKTAEVSDLQDVLVYSLQGVSYWATQAHRYGIINDEINQWAPKAFFSTLTNVNFDPERILQLTSQAAQFKAQLKDQVLTASSLANSPLSEVPAVAEFELPENAQAILAFAPQVAVNRGKESVHEDVIGLRLLCLYGLKGAAAYMEHARVLEQTSNDIYAEYHEIMAWLGTDPEDLGELLDCSMRIGLMNYKVMEMLDHGETATFGHPVPTAVNVKPVKGKCILVSGHDLHDLEKILQQTEGKGINVYTNGEMLPAHGYPELNKYPHLVGNYGSAWQNQQKEFANFPGAIVMTSNCLLNPNVGQYADRLFTRSIVGWPGVAHIEGDDFSAVIESALAQPGFQHDEIEHMITVGFGRNALMNAAPAVIDQVKQGNIKHFFLVGGCDGDKAERSYYTDFTEAAPEDTLILTLACGKFRFNKNTFGDINGIPRLLDVGQCNDAYSAIQLALALAQEFDCGINELPLTLVLSWFEQKAIVILLTLFALGVKGIYTGPTAPAFLTPNLIAIIQEKFDMRSIGNVQDDLNTILAA

SEQ ID NO: 16568 - protein, 72 aa, Symbiobacterium thermophilum
MSKDDVIEVEGTVVENLPNAMFRVELPNGHRVLAHVSGKIRMHFIRILPGDRVTVELSPYDLTRGRIVYRYK

SEQ ID NO: 16569 - protein, 561 aa, Alkalilimnicola ehrlichei
MTESFAELFEESLANTDMRPGAIVMGKVVAIDGDHVVVNAGLKSEAVIPASQFYDEEGNLEVAEGDEVEVSLDAVEDGSGETRLSREKAKRAYAWRFLEDAYEKSEAVKGQISGKVKGGFTVDLGHIRAFLPGSLVDIRPVRDTTYLEGRDLEFKVIKLDPRRNNVVVSRRAVVEEEYSAEREQLLEKLQEGQVLKGIVKNLTDYGAFVDLGGMDGLLHITDMAWRRVKNPSEVVEVGQEIEVKVLKFDRERNRVSLGLKQLGADPWENIGGRYPEGARVPGRVTNITEYGAFVEIEEGVEGLVHVSEMDWTNKNVNPAKMVSIGDEVEVMILDIDEERRRISLGMKQCLPNPWDEFAATHQKGDRVTGQIKSITDFGIFVGLDGGIDGLVHLSDLSWGEAGEEAVRNYRKGEEVEAVVLSVDPERERISLGIKQLEQDPFGSWLADHPKGSLVKGTVKDVEAKGATVTLEGGMEGYVRASDISRDRVEDARTVLKEGEEIEAKFVGVDRRNRMANLSIKAKDQVEEQRLVQDHARPTGTAGTTALGDLLKEQLGEQNDDR

SEQ ID NO: 16570 - protein, 447 aa, Hyphomonas neptunium
MRYLPLTPEDRANMLATIGAKSVDDFYTDVPDAARLKGKIAGLPDHQGELAVERHLTKLAAKNRSASSGPFFVGAGAYKHHVPATVDMIIQRSEFLTTYTPYQPEIAQGTLQTLFEFQTQVASLTAMDVANASMYDGSTSCAEAAVMAARVTRRKKIILSGGLHPHYAAATRLLAEAQGLTVVQLPVAIDGEGELAKAVDGETACVIGQSPNVFGTVTDLSAVADAAHGKGALLVSVFTEAVSLGLVTPPGEMGADIAAGEGQSIGNGLNFGGPYVGLFSCREKLVRQMPGRLCGETVDADGKRGFVLTLSTREQHIRRDKATSNICTNSGLCALAFTSHMTLLGGKGLKQLAELNHEAAIELADALGAVKGVEILTPRFFNEFAIRTPMDAEAVLAMLDEAGVVGGVRASRLFPGDHLGDVILVAATECTTADDIAAYTDALKEII

SEQ ID NO: 16571 - protein, 112 aa, Rhodopseudomonas palustris
MKIVMAIIKPFKLEEVRDALTAIGVHGLTVTEVKGYGRQKGHTEIYRGAEYAVSFLPKIKIEVAIANEQVEKTIEAITSAAKTGQIGDGKIFVIGLDHAVRIRTGEADAAAL

SEQ ID NO: 16572 - protein, 241 aa, Triticum aestivum
ARFLWFLLRLRAMTVVDAEARFHVLAVDDSVIDRKLIEMLLRTSSYQVTTVDSGSKALEVLGLRDEGDDASSSSPTSSSAPAHHQEVGVNLIITDYCMPGMTGYDLLRRVKGSSSLKDIPVVIMSSENVPARISRCLEDGAEEFFLKPVKLADMKKLKSHLVRRKQPQLQPPQPQEKPQQQQKAELAPTELVEEVAAEVTATGITSDCGGGSRKRKAAMMEQDGTTNASLSGGSGGLAVET

SEQ ID NO: 16573 - protein, 420 aa, Shewanella oneidensis
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDDMRILGFEEKPQLPKHCPGNPEKCLASMGNYVFNTEFLFEQLKKDAQNAESDRDFGKDIIPSIIEKHKVFAYPFKSAFPNEQAYWRDVGTLDSFWLANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 16574 - protein, 724 aa, Gibberella zeae
MPATSSLEEQAIDREYPQQQRQHHRRHQELEPEPRQFSFRSPNRNEAVPQSQLDNQQDTGSLSYSQQHYRPQNSSLSHTQSNSRLVVPSVSGVRSTSPAPSVSPLPTPSISPSASVVSIDASYSSRDPSSPIQTPSSTSAEAHDSHPQRDSSEHNSSERGSTDSYSYLRRERNSSNMATWSGQPAIRGNSEAVRMILLCFVTIGITFTWGIEMTYCTPYLLNLGLTKSNTSLVWIAGPLSGLVVQPVVGVIADESKSKWGRRRPLMVVGSIIVAISLLILGFTREIIGYFITDEEAAKRPTIVLAVLAIYVVDFAINAGMIRFLMSCSKSLIVDTLPIEKQQSGAAWSSRMSSIGHMIAYGAGAVDLISIFGKTLGDTQFKQLTVISTVALLSSTALTCWAVTERVLLTSKPAKHEGRFKVFRQIWSTLLNLPPRIQAICWAQFWAWIGWFPFLFYSTTWVGETYFRYDVPADARKSEDTLGAIGRIGSTALVMYSVITFAGAWVLPMLVQSPEDNTFTHRPPQAIAGLLTSFNKLKPDLLTAWVFGHLMFAASMALAPFATSFRFATVLVCLCGIPWTLAMWAPSAFLGVEVNKMSGETGADGTYRRISDEPDIELSEVSHNDAPLHLDHGSEVDLPSTASTGELSGIYFGILNIYTTLPQFVGTFISTIVFAILEPGKSPELADDAKKQPDPDGPNAIAVCLFIGAMSSVVAAYVTRKLKVM

SEQ ID NO: 16575 - protein, 472 aa, Prochlorococcus marinus
MSKAHFGLIGLGVMGENLVLNAERNGFSSVVFNRTYSKTEEFLQGRGLGKNIEGAETLQEFVNKLERPRRILMMVKAGPATDAVIDNISGYLEEGDLLIDGGNSQFKDTERRVNTLESKSFGYIGMGVSGGAKGALEGPSMMPGGTKASYDAIESLLTKMAAKVEDGPCVAYVGPGGSGHFVKTVHNGIEYGIEQILAEAYDLMKRVKGMNGQQMSEVFGIWNNTDELASYLVEITEICLNTKDEITGDDVVEKILDKAGQKGTGLWTVVSALELGVSVPTIYASLNARVMSSLKEQRSEIEKTIPSKEIEDFDLGNISDGMKPLFDAVVLATIASYAQGMDILREASAVYNYGLNMPSIAQIWKGGCIIRSKLLSKIQDAYNKDPNLKNLIFDDWFNNEIATRLDNLAKVVSLSTKAGIPVPCLSSTLDYLNSYRTNRLPQNLVQAMRDCFGSHTYERIDKKGSFHTEWMK

SEQ ID NO: 16576 - protein, 244 aa, Unknown
  Synechococcus sp. WH 8102
MLSGSTPTTTSTPEQLIDRLANGSPRQRRSLIKSLESRSADLVSLGSDALAPFDRKASDWAPGWILQVIRRHQPDHLAQLLSSTPEGWLSVASAIGVDYIPLQQALLDEDFETADRTTSSILRQLAGPAAEARGYVYFSEVPAMAGLDLVSLDRLWTVYSQGRFGFSMQARLLAGLDGRYERLWPRIGWKLDGTWTRYPGAFTWTIEAPEGHMPLINQLRGVRLMDALLNHPDLVTHRGSTGLS

SEQ ID NO: 16577 - protein, 500 aa, Triticum aestivum
RASPPSESRAPLRAPQRSATRQHQARQGPRRMCNGGRGPPYWTAGVTSAPARQTPLFSGRPSGGLSDPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAWRKIIWVLEDYYKNKSIEHILILSGDQLYRMDYMELVQKHVDDNADITLSCAPVGESRASEYGLVKFDSSGRVVQFSEQPKGDDLEAMKVDTSFLNFAIDDPAKYPYIASMGVYVFKRDVLLNLLKSRYAELHDFGSEILPRALHDHNVQAYVFTDYWEDIGTIRSFFDANRALCEQPPKFEFYDPKTPFFTSPRYLPPTKSDKCRIKEAIILHGCFLRECKIEHTAFSRLNSGSELKNAMMMGADSYETEDEMSRLMSEGKVPIGVGENTKISNCIIDMNARIGRDVVISNKEGVQEADRPEEGYYIRSGIVVIQKNATIKDGTVV

SEQ ID NO: 16578 - protein, 323 aa, Sulfolobus solfataricus
MSLLPRTTSVKPGEKFDVIIVGLGPAAYGAALYSARYMLKTLVIGETPGGQLTEAGIVDDYLGLIEIQASDMIKVFNKHIEKYEVPVLLDIVEKIENRGDEFVVKTKRKGEFKADSVILGIGVKRRKLGVPGEQEFAGRGISYCSVCDAPLFKNRVVAVIGGGDSALEGAEILSSYSTKVYLIHRRDTFKAQPIYVETVKKKPNVEFVLNSVVKEIKGDKVVKQVVVENLKTGEIKELNVNGVFIEIGFDPPTDFAKSNGIETDTNGYIKVDEWMRTSVPGVFAAGDCTSAWLGFRQVITAVAQGAVAATSAYRYVTEKKGKK

SEQ ID NO: 16579 - protein, 801 aa, Bacillus thuringiensis
MKKRLVMIGNGMAGIRCMEEILKHDCDSYEITIFGDEPHPNYNRIMLSHVLQGKTNIQDIIMNEYSWYEENEITLYTNERVQSIDREEKVIITEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIQEYTPASILHKAGEESELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYNVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLGFDHIKEILQDANMVTKLNERFQTARGTYKEAWGQALETKSLKAMYEVETVK

SEQ ID NO: 16580 - protein, 423 aa, Unknown
  uncultured archaeon
MLNRNAVLQRGLVNEAKKFPDTPAEHYQRALSIMNSARLDDLPALYDVISLCREAVRLNPDYAEAYCLLGAALAGMGQSGDAIQALEKAITLQPGYAEAHYYLGKAVLATGNPDQALNLFTASKQLGMNESMACCGIGSALAEKGLYRESIVELSRAIAVDPGNVEAYVRLGMACCETGSYAEAMAWLKKAVELNPGNIEAHLCLARAYLRGQMYDAALAEYDVVLGLRPRCLDAINGKGTVYHYKGLIDQAIQEYRHAIDLYPGDYRAHNNLALAYVDKGMYERAIPEYRLAICASPKLPELHADYGMLLLLTGDTYGATLAFREALRLAPDSYSGHVNLAVALYQSGQCSDALAELAEAVRLSPSEPEAFFHLGTIHDRCGDPVKAATAYESFIRFSASGDKRVKSVRARLLEIKGGKKRK

SEQ ID NO: 16581 - protein, 315 aa, Burkholderia pseudomallei
MPVALSEQVSGRAALAVICMEQPLVLFRDASGAVCAMEDRCAHRRAPLSLGRVTPDGRLQCAYHGWTYDGATGACVAIPNLSASERVPAHYAAHAYKTLERDGFIWACARDAPPPAEAIPRAPRSARRFAGSVTVAIARDEYVAALADGPHLTMRIAGLYITDYVIADATPHDGDIATERGVTWLAHIVDRHFGVRYPWTLRVTSPRDGALASVELASRDGATALWASIAITPAARGATNVLWRGGVAADASGFGAKLFRTWARLHAAPFAMLAHVDGRALSTLDALYSRAWRGPIPEGIAHTRPMPADYRTRSR

SEQ ID NO: 16582 - protein, 543 aa, Bacteroides thetaiotaomicron
MSMFCYQCQETAMGTGCTLKGVCGKTSEVANLQDLLLFVVRGIAVYNEHLRREGHPSEEADKFIYDALFITITNANFDKAAIIRKIKEGLQLKNELASKVTIANAPDECLWDGNEDEFEEKARTVGVLRTPDEDIRSLKELVHYGLKGMAAYVEHAHNLGYQSPEIFAFMQSALAELTRNDITMEELVQLTLATGKHGVSAMAQLDAANTNSYGNPEISEVNLGVRNNPGILISGHDLKDLEELLEQTEGTGIDIYTHSEMLPAHYYPQLKKYKHLAGNYGNAWWKQKEEFESFNGPILFTSNCIVPPRANASYKDRIYITGACGLEGAHYIPERKDGKPKDFSALIAHAKQCQPPTAIESGTLIGGFAHAQVVALADKVVEAVKSGAIRKFFVMAGCDGRMKSREYYTEFAEKLPKDTVILTAGCAKYRYNKLALGDINGIPRVLDAGQCNDSYSLAVIALKLKEVFGLDDVNKLPIVYNIAWYEQKAVIVLLALLALGVKNIHLGPTLPAFLSPNVKNVLIEQFGIGGISTADEDIMKFLS

SEQ ID NO: 16583 - protein, 112 aa, Bartonella quintana
MKKIEAIIKPFKLDEVKEALQKIGLHGITVTEAKGFGRQKGHTELYRGAKYVVDFLPKVKIEIVVADEKLDQAIDAIRNAAQTKHIGDGKIFVFSIDNAIRIGTGKSGIEAL

SEQ ID NO: 16584 - protein, 279 aa, Unknown
  Magnetococcus sp. MC-1
MHTVDTYTSMAPGSVILAGSGPGDPNLLTLGVYKALQACDTLVYDALVSPEIMALVPASVEQHFVGKRGGHPSIGQEAINAILVQLAKAGKKVLRLKGGDPFVFGRGGEEAYCLSCEGIPFSIIPGVTAGVAGPAYAGIPITHRDVNANVAFLTGHESPTNAAGETVPTTVDWESVGAAFPVIVLYMGVKNLPTIAKRLIAGGRSGETPVALIRWATTPRQQTMITTLNRAADDISECKIKPPSIVVIGEVVNYRDHLSWFADDTLTRDNCKNKLRDDE

SEQ ID NO: 16585 - protein, 436 aa, Oryza sativa
MDSVVRTHIGHMLKMIHFCSMFLITFSDYKIQAILSSQQKRKAPEESDVAESSDCMITSPGFAVSPMLTPVSGKAVKTSKSKTKNNKAGPQTPTSNVGSPLNPPTPVGTCRYDSSLGLLTKKFINLLKQAPDGILDLNNAAETLEVQKRRIYDITNVLEGIGLIEKTLKNRIRWKGLDDSGVELDNGLSALQAEVENLSLKEQALDERISDMREKLRGLTEDENNQRWLYVTEDDIKGLPCFQNETLIAIKAPHGTTLEVPDPDEAGDYLQRRYRIVLRSTMGPIDVYLVSQFDEKFEDLGGGATPSGHANVPKHQPTEVFNTTNAGVGQCSNSVAVDNNIQHSQTIPQDPSASHDFGGMTRIIPSDIDTDADYWLISEGDVSITDMWKTAPDVQWDESLDTDVFLSEDVRTPSSHNQQPSAVGGPQMQVSDMHKP

SEQ ID NO: 16586 - protein, 328 aa, Gibberella zeae
MVKHASKATVHQLAKEYSSIIKGKTILTTGVSPGGLGALFVEAIAVAEPELAILAGRNINKLQQTADHLASKHPNLKTKLLTLDLSSLASIRSAAQQVNGWSDVHKIDVLVNNAGIMATDFKLTEDGFENQFASNHLGHFLFTNLIIDKILAAEAPRIVSVSSNGHRLGPIRWGDANFSNGDLYNRWNAYGQSKTANMLFAISLAEKLGSRGLQAYSLHPGAILETSLGDHLANLDSLVEADRAIGDPWGWVDWSTVPVTAEVGAATHVFAAFDPDLKDHNGAYLLDCRLADPFTDTVRPWATSSTEAELLWRLSEKMVGQKFPLKLQ

SEQ ID NO: 16587 - protein, 393 aa, Oryza sativa
LKRKHDREENEAAESNDWMMSPGYTNPAGSPVPTPLSGKGSKAFAKSKAAKGQKSCPQTPLCASSPGNPVTPVGGCRYDSSLGLLTKKFLNLLKGAPGGIVDLNNAAETLEVQKRRIYDITNVLEGIGLIEKKLKNNIRWKGIDDSRPGEVSDDMSILQADIEALSLQEHSVDQQISEMRDKLRGLTEDENNQKWLYVTEDDIKSLPCFQNQTLIAIKAPHGTTLEVPDPDEVNDYPQRRYRIVLRSTMGPIDVYLVSQFEEMSGMETPPRTVQPVSMDSLENPRTPLAAEPNKAAESQPNIQDGLLMPSDAPSSSQDIGGMMKIVPSELDTDADYWLLSDAGVSITDMWKTAPEVEWEGIEKFNAEDFLEVSTPRQQDKPSSDIMDGDSCIS

SEQ ID NO: 16588 - protein, 234 aa, Arabidopsis thaliana
MGEKEEVKLLGVWYSPYAIRPKIALRLKSVDYDYVEENLFGSKSELLLKSNPVHKKVPVLLHNNKPIVESLNIVEYIDETWNSSAPSILPSHPYDRALARFWSDFVDNKWFPALRMAAITKSEDAKAKAMEEVEEGLLQLEDAFVSISKGKPFFGGEAIGFMDICFGSFVVLLKAREKFKAEKLLVESKTPSLCKWADRFLSDETVKNVAPEIEKVAEFLQELEVRAQSAASRS

SEQ ID NO: 16589 - protein, 140 aa, Enterococcus faecalis
MKIALIAHDRKKTLMIKLATAYKHILEKHELYATGTTGMKVMEATGLPVHCFKSGPLGGDQQIGAMISEDNIDLVIFLRDPLSAQPHEPDVTALIRLSDVYEIPLATNIGSAEILLRGVEAGFADFREVIHEGDRRPLAF

SEQ ID NO: 16590 - protein, 174 aa, Brassica napus
PQGSRGISDDEDGDNSRKKLRLSKDQSAILEETFKDHSTLNPKQKQALAKQLGLRARQVEVWFQNRRARTKLKQTEVDCEFLRRCCENLTEKNRRLQKKVTELRSLKLSPQFYMHMNPPTTLTMCPSCEHVSVPPPPPQVAASGHHQRSLPVNPWAPATRVSHGLTFDAFRPRS

SEQ ID NO: 16591 - protein, 99 aa, Unknown
  Cyanothece sp. PCC 8801
MATYKVTLINEQEGINATIDVPEDEYILDAAEEQGIDLPSSCRAGACSTCAGKLVTGTVDQSDQSFLDDDQVAAGFVLTCVAYPKSDCTIETHQEEALY

SEQ ID NO: 16592 - protein, 413 aa, Oryza sativa
MTEAVLIRTPLKRKHDREENEAAESNDWMMSPGYTNPAGSPVPTPLSGKGSKAFAKSKAAKARNLVPRPLCALLLMLTPSSLPGSPGNPVTPVGGCRYDSSLGLLTKKFLNLLKGAPGGIVDLNNAAETLEVQKRRIYDITNVLEGIGLIEKKLKNNIRWKGIDDSRPGEVSDDMSILQADIEALSLQEHSVDQQISEMRDKLRGLTEDENNQKWLYVTEDDIKSLPCFQNQTLIAIKAPHGTTLEVPDPDEVNDYPQRRYRIVLRSTMGPIDVYLVSQFEEMSGMETPPRTVQPVSMDSLENPRTPLAAEPNKAAESQPNIQDGLLMPSDAPSSSQDIGGMMKIVPSELDTDADYWLLSDAGVSITDMWKTAPEVEWEGIEKFNAEDFLEVSTPRQQDKPSSDIMDGDSCIS

SEQ ID NO: 16593 - protein, 72 aa, Solibacter usitatus
MSKEDSIEVTGTVLEKFPSGLFSVQLEHERVVLAHLAGRLRRNRIRVLAGDKVTLELSPYDLTKGRITFRHR

SEQ ID NO: 16594 - protein, 378 aa, Taxodium distichum
FSIKGNGIGNGNGHCNGYSNGHGHCINGYSNGISASVSSNGVSHLPYSNGNTVHHSNGNSHTSPSFGDGRRRCFWYEEEIEDDLRWCFALNRIIHTGVSEYQDIALIDTRPFGKALVIDGKMQSTEVDEFIYHESLVHPALVYHSHPKSAFIMGGGEGSTAREILRHKCVKKVVMCDIDKEVVDFCKKYLVVNREAFSNSRLELVINDARTELQSRQERFDVIIGDLADPVEGGPCYQLYTKSFYELVIKPKLNHQGIFVTQAGPAGVLTHTQVFSSIYNTLRQVFKHVMPYSAHVPSFADTWGWVMASDHPLTLKAEEIDDRIKQRIKGELQFLDGQTFLVAATLNKSVRKSLSKETHVYTEETARFIHGHGKASYQ

SEQ ID NO: 16595 - protein, 757 aa, Oryza sativa
MGSETNKEGARGGGQFEVVATTCEVTIVVGCMKEMSAGQFYCKGEERVDGGAGIKRRGAPQRKGKSPKKVEGKTYKYKGFVIEGCELDSTIIMIKSSDLVHIPSIFTPPEVNSQKGSKTSICIDRSLSQAYHDSPDNASILPTNLAQRIQLSSDTLGSDKRHGIAGKTDHETAQKHAKLSCFDQRCLDKMKQLTSGMNVQKRDLAKTHNDEITACDWDYLGTQYDSSVVPESDLRFETAELLLETPKNGDAMPGKSFLPIVEANLENSRRKLFQGSADCYSQSAVDNIHAYCTSRGKEVATNHVSGILPCPRESQLIPDHHFSDSLEVPSDYMAMNPSAVSQHLRGLHRRSLFNDKVRDPTMGVQSVSNLGASTCATRHRSIPDDNYSKLVGSPVCALPNVDLHLVRMTEEMLAPNTSEMNTHNQGDYSSQATMPTSAGNSGQENPKRKRQKCQNDNVDSCKRCSCKKSKCLKLYCECFASKVYCSESCSCRGCFNDHSHEETVLSTRNRIESRNPLAFAPKVIRTCGPGLEFGEDSNATPASSRHKRGCNCKRSYCVKKYCECFQSGVGCSMSCRCENCKNSFGVRKGIERFETKEIERADRKMKDHPKEEQSEMDKYHALCEIWGVRSTENLFTTPSMDSRRAFALFPSECPKSSLTSSTRTSSHLHSPTRTDVLLSPFGSYTQMLLGNEASDMLLQQGDSSCTASLRIASPNKKRVSPLRTGNTLSPTCRKELGLKSIIPPFPSLTGDANSELQ

SEQ ID NO: 16596 - protein, 367 aa, Caulobacter crescentus
MPDDASKPAKPAAADKFGEGFVWDAWYVAALSPDLKPGTKSKREYLGEPVLLGRTRAGQVYAIRDICPHRAAALSAGRLHREADGTDSVECPYHGWRFGPDGACTAIPSLTADSDFDIAKVRVRRYPTVESQGLVWIWMSSDPRFDGQPPEPPPVIPGVVGGKPKLVDHLDYDIHIDHAVLGLIDPAHGPYVHQQWWWRTKTSQHEKNKRFAPSEAGFTMVRHEPSKNSKAYAILGGEPLTEITFRLPGLRWEHVTVGKKQVLALSAMTPINAHKTRMNQIMWSDHWAFTALYPIIRIAARAFLRQDGRIVENQTPGLKCNPPLMWVGDADQQARWYHQCKREWNASRREGRPFVNPVKDQTLRWRT

SEQ ID NO: 16597 - protein, 509 aa, Clostridium thermocellum
MFLDAEIMQQLEQYLTLLENDIVIKVNAGNDKVSVDMVGLIDEIAKLTPKIHVEKAELDRTPSFSVNRPNEDTGIVFAGIPLGHEFNSLVLALLQVGGRAPKVDEALINQIKGIKGEYHFETYVSLSCHNCPDVVQALNIMSVLNPNITHTMIDGAVFREEVESKGIMAVPTIYLNGNFFESGRLTLEEILAKLGQATESPSINEKEPFDVLVIGGGPAGVSSAIYAARKGLRTGIIAERFGGQILDTLGIENFISVPYTEGPKLAENFKEHVKRYDIDVMERQRAKSIRRNELLEVELEKGAVVKSKTVIIATGARWRNVNVPGEKEFKNKGVAYCPHCDGPLFAGKDVAVIGGGNSGIEAAIDLAGIVRHVTVLEFLPQLKADKVLQERLYRLPNVTVLTNVQTKEFTGKEKLDGITYIERDTNQEKHIEVQGVFVQIGLVPNTEWLEGTIERNAMGEIIVNEKNETSMPGVFAAGDCTNSPYKQIVIAMGSGATAALSAFDYLIRN

SEQ ID NO: 16598 - protein, 412 aa, Zea mays
  misc_feature (69)..(69): Xaa can be any naturally occurring amino acid
MNALAATTRNFRRASKLLGLDSKLEQSLLIPFREIKVECTIPKDDGSLATFVGFRVQHDNARGPMKGGXIRYHNEVDPDEVNALAQLMTWKTAVAAVPYGGAKGGIGCSPGELSRSELERLTRVFTQKIHDLIGTHTDVPAPDMGTNAQTMAWMLDEYSKFHGHSPAVVTGKPIDLGGSLGRDAATGRGVMYATEALLAEYGKCISGSTFVIQGFGNVGSWAARLIHEKGGKIIAIGDVTGSIRNTAGIDIPALVKHRNEGHAMKDFDGAEVLDSTELLVHDCDVLVPCALGGVLNKDNAPDVKAKFVIEAANHPTDPEADEILAKKGVVVLPDIYANSGGVVVSYFEWVQNIQGFMWDEEKVNDELEKYMSSAFQHMKAMCKSLDCDLRMGAFTLGVNRVARATLLRGWEA

SEQ ID NO: 16599 - protein, 322 aa, Triticum aestivum
  misc_feature (178)..(178): Xaa can be any naturally occurring amino acid
MLPWIFSRKGASGFSWASTADHVTAGISAAGLTAIVTGASSGIGAETARVLAARGAHVVMAARNLAAAETVRQAVLADTPGASLELMELDLSSLASVRKFAADFAARGLPLNILVNNAGVMATPFSLSKDGIEMQFATNHVGHFLLTHLVLDTMKKTSRESNVEGRIVIVASEGHRVXYKEGIRFAKINDEQGYGTLAAYGQSKLANILHAGELARRFKEEGVNITANSLHPGAIITNLLRHHSIIDAFASVFAAIERTLGRLVLKNAKQGAATQCYVALHPDAKGVSGKYWSDSNLYEPSEKAKDAELGKKLWDYTLDLVA

SEQ ID NO: 16600 - protein, 353 aa, Solanum diploconos
DAWDTSVAVEVKVADSIEIVRFFHCYKRGVDRVFVDHPIFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTSITGIVNGMDTQEWNPATDKYTDVKYDITTVMDAKPLLKETLQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16601 - protein, 870 aa, Glycine max
  misc_feature (587)..(587): Xaa can be any naturally occurring amino acid
MAEPLSNTELSSSKTLDPTNGHDSTSEPHQTAPEDAQLNREDDVVPTAKRKRDDDVEDRSLHPLWKTSLCSYFRSHNGSCSHGGACRYAHGEEELRPRPDNTWDPTSERAKKALKTESDEKRAVSEEVMMTEAVVDDGDDGCGANHALNICLVHLPRKWSSENLRTFLGEQGIPFKHAKKKKGMMIGFVTFEDEEQLKSSTMELEGKSIGNKTVKVANVLPRSFEKKSNAIVASRQELDEENAGVDVASSGTLDGETNNDNLAKTRNVRDAVTPLAHMAYADQLEQKTSSLMQILKKLTRNARKACPNGVSLPEWILKSREIGGLPCKLEGIIASPIVNGYRNKCEFSVGYSLEGKVTVGFMLGNFREGVTAVEEAVDCPNVSTVACKYATIFQEFLQDSDLPVWNRFKNTGFWRQLTVREGRTNGNVVDAETFSGVAEVMLIVSTASFDDAKVAAEFKRLAQAFVAGATSHCPILPLTALVVQDHQGISNVAPADAPLHSLPIPKAAGDPEVDENNNAKDVRIHDHINNLQFSISPTAFFQVNTLAAEKLYSLAGDWSCLGPDTLLFDICCGTGTIGLTLAHRVGXIGIEMNASAVSDAHRNAEINGIKNVKFICSKAEDVMGSLLREYLNVTREQVDDPNISGSGNDIPKDSACPEPENCEIASRCPENNIAEVGSEVQKGCTCEQADGISEQAEDVMGSLLRGDANVAKEQSDDPNVSGSSNDIPVDDTCPEPENGEITSHSENNNAETSLQQFKNVVAIVDPPRAGLHPTVIKALRTHPGLRRLVYISCNPETLVANAIELCTPSPVKIEKGNKDNRGWRNMSSAGLARHRAKSMPISEAFHPVKAMAVDLFPHTPHCELVMLLER

SEQ ID NO: 16602 - protein, 101 aa, Triticum aestivum
  misc_feature (7)..(7): Xaa can be any naturally occurring amino acid
  misc_feature (10)..(10): Xaa can be any naturally occurring amino acid
  misc_feature (12)..(12): Xaa can be any naturally occurring amino acid
  misc_feature (18)..(18): Xaa can be any naturally occurring amino acid
  misc_feature (20)..(20): Xaa can be any naturally occurring amino acid
  misc_feature (22)..(22): Xaa can be any naturally occurring amino acid
  misc_feature (29)..(29): Xaa can be any naturally occurring amino acid
  misc_feature (36)..(36): Xaa can be any naturally occurring amino acid
  misc_feature (38)..(38): Xaa can be any naturally occurring amino acid
  misc_feature (43)..(43): Xaa can be any naturally occurring amino acid
  misc_feature (48)..(49): Xaa can be any naturally occurring amino acid
  misc_feature (58)..(58): Xaa can be any naturally occurring amino acid
  misc_feature (68)..(69): Xaa can be any naturally occurring amino acid
  misc_feature (79)..(79): Xaa can be any naturally occurring amino acid
  misc_feature (82)..(82): Xaa can be any naturally occurring amino acid
  misc_feature (94)..(95): Xaa can be any naturally occurring amino acid
FEIVFVXPTXEXIKNKRXLXNXLKANPGXPTSSEFXWXTGETXRRSAXXSEKVKVFDXPHGEKIPKRXXNSSGKKGKQXKKXDPETEERQKKAXXGQRRAN

SEQ ID NO: 16603 - protein, 353 aa, Solanum drymophilum
DAWDTSVAIEVKVGDSVEIVRFFHCYKRGVDRVFVDHPMFLEKVWGKTGSKIYGPKAGEDYLDNELRFSLLCQAALEAPRVLNLNCSKYFSGPYGEDVLFIANDWHTALLPCYLKSMYQSKGLYLNAKVAFCIHNIAYQGRFAFSDFPLLNLPVKFRGSFDFIDGHEKPVKGRKINWMKAGILESDRVVTVSPYYAQELVSAVDKGVELDNVLRKTCITGIVNGMDTQEWNPATDKYTEVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16604 - protein, 353 aa, Solanum dulcamara
DAWDTSVAVEVKVGDSIEIVRFFHCYKRGVDRVFVDHPMFLEKVWGKTASKIYGPKAGLDYLDNELRFSLLCQAALEAPRVLNLNCSKYFSGPYGEDVFFIANDWHTALIPCYLKSMYQSRGMYLNAKVAFCIHNIAYQGRFAFSDFPLLNLPDEFRGSFDFIDGYEKPVKGRKINWMKAGILESHRVVTVSPYYAQELVSAADKGVELDNVLRKTCITGIVNGMDTQEWNPATDKYTDVKYDIATVMDAKPLLKEALQAAVGLPVDRKIPLIGFIGRLEEQKGSDILVAAIHKFIALDVQIVVLGTGKKKFEKEIEQLEVLYPNKAKGVAKFNVPLAHMITAGADFMLVPSR

SEQ ID NO: 16605 - protein, 328 aa, Deinococcus radiodurans
MTQGSALPVLGAGGWGTALAVAAARAGQPARLWARRPDFAARLAEVRENREYLPGVLLPPEVAVTSDLPGAVAGADFALLVVPSVGVPELLAGLPRELGVVLCAKGLAPDGSRLSEYAAGLGFDRVAVLSGPNHAEEIGRGLPAATVVASRDPALAAAVQTALMSPSLRVYTSRDVPGVELGGVLKNVIAVAAGMGDGLHLGDNAKATLLTRGLREMNRYLRSLGAEEETVYGLSGLGDLIATATSPHSRNRAAGEAIARGESPQQGGKVVEGLRTAGLLDAWAAAHGHDLPIVRAVAQVTRGEWSPAEGVRHLMGREAKGETEAGEP

SEQ ID NO: 16606 - protein, 185 aa, Oryza sativa
MDLSWLHPTYCLINCYLARYLYLEDMQLLPWGGKITSESLKFFSPIVIWTIFESTEHNHHVLHSAFVDYYKVWLELMDQAIKENNKATIARNQEEQHKYLTWRAEKDPGYPLLKKLIGESRAEDLVMEFLFEGVNTLGTKSFLDYFPEYARDDGSVNKKRSMIGKSFETRPWDANGEFIGDAEAQ

SEQ ID NO: 16607 - protein, 188 aa, Saccharomyces cerevisiae
NPISSKLESGYLDLVVKAYVDGKVSKYFAGLNSGDTVDFKGPIGTLNYEPNSSKHLGIVAGGSGITPVLQILNEIITVPEDLTKVSLLYANETENDILLKDELDEMAEKYPHFQVHYVVHYPSDRWTGDVGYITKDQMNRYLPEYSEDNRLLICGPDGMNNLALQYAKELGWKVNSTRSSGDDQVFVF

SEQ ID NO: 16608 - protein, 565 aa, Haloarcula marismortui
MTAARAWWKEAVVYQIYPRSFNDSDGDGVGDLQGIIERLDYVADLGVDVIWLNPVYDSPQKDNGYDISDYQTIYDEFGTMADWEALVEEVHNRDMRLVMDLVVNHTSDQHEWFRKSRQRDPEYEDYYIWREGGTDEDGDPVPPNNWESFFGGSAWEYDEERSEYFLHLYDTSQPDLNWRNDSVRTDIFDTIEWWLEKGIDGFRMDVINLLSKVEGLPDGDPDSEWVGAEHFIDGPEMLSYLTALDEEVLSNYDVMTVGEMPQLTVESALEYADTDGPLDMAFHFQHTKLDYADGERWSVGDWSLPELKRIIGRWQDGLAADGWNTLYWENHDQPRSVSRYGDPENYRRESAKLLGTFILTLRGTPYVYQGQELGMTNADWETMDDLRDVDAINHARELLDRDGVEEYDDVKDIVGYRTRDNARTPMQWDDSKNAGFTDGDPWIQVNPNYREINAADQQADVDSVYSYYQRLIQLRADRDVLVYGDYTDLLPDHETVFAFTRSLSADSGTERILVVLHFDDATETLDLPVEYADATLLEGNYDCDDTDPGTVTLAPYEARVYELFD

SEQ ID NO: 16609 - protein, 112 aa, Symbiobacterium thermophilum
MAGDKVVTLSASNWAAEVEQSSLPVLVDFWAVWCGPCRMIAPVVEEIAADYEGRMKVGKLNVDENNDLAARYGVMSIPTLILFKNGEPVERIVGFQPKKELAAKIDRALAQA

SEQ ID NO: 16610 - protein, 317 aa, Pasteurella multocida
MNAMKHSQLLILGSGPAGYTAAIYAARANLKPVLVTGLQQGGQLTTTTEIENWPGDFGETTGPELMQRMLQHAEKFDTEIIFDHINKVDLSSRPFKLYGDVHTFSCDALIIATGASARYLGLPSEEAYKGRGVSACATCDGFFYRNKPVAVIGGGNTAVEEALYLANIASEVHLVHRRDSFRSEKILIDRLMKKVEEGKIILHTNRTLDEVLGDNMGVTGVRLKDTQSEATEELSLDGVFIAIGHAPNTDIFAEQLELNNGYIVVKSGLEGNATATSVDGVFAAGDVMDHNYRQAITSAGTGCMAALDAERYLDAQK

SEQ ID NO: 16611 - protein, 527 aa, Prochlorococcus marinus
MNGDLNSWDKFCNYLWFDKKLNIWLDISKINFTSKEIKNLEDKFKDVFSSIKELENGAISNIDENRQVGHYWLRNPSISPSSKIGEEIRADINSISEFGKQILNGDIKNKNNQQYTDVLWIGIGGSGLGPLLITESLQKCSKGLNFSYIDNVDPFLISEKLEELSEKLSTTLFVVVSKSGGTPEPRIAMEIIKSHCENNSLEWNSNAIAITMKGSKLFKKATSENWLKIFNLQDWVGGRTSITSSVGLLPLALINENISEFIRGASLMDETTRIRDFKNNPAALLSSAWYLTGDGIGKRDMVVLPYRDRLQVFSKYLQQLVMESLGKKFNRNGQVVNQGISVFGNKGSTDQHAYVQQLRDGIDNFFCIFIELLDSPSTNIFDEKENPKEYLSGFLQGTRSALSSENRQSITITLEKLNCFSLGALIALFERAVSFYAELVNINAYDQPGVEAGKKAAANIIEYQQKVSHLLDEGGEYSINDITSLFDNSVSEPIFFILREMCFGNDNYLVKGDWSNPNSLVIQKINS

SEQ ID NO: 16612 - protein, 221 aa, Triticum aestivum
  misc_feature (3)..(3): Xaa can be any naturally occurring amino acid
  misc_feature (9)..(9): Xaa can be any naturally occurring amino acid
  misc_feature (36)..(36): Xaa can be any naturally occurring amino acid
LCXGPPGTXKTLLARAVANRTDACFIRVIGSELVQXYVGEGARMVRELFQMARSKKACIVFFDEVDAIGGARFDDGAGGDNEVQRTMLEIVNQLDGFDARGNIKVLMATNRPDTLDPALLRPGRLDRKVEFGLPDLEGRTQIFKIHTRAMNCERDIRFELLARLCPNSTGADIRSVCTEAGMYAIRARRKTVTEKDFLDAVNKVIKGYQKFSATPKYMVYN

SEQ ID NO: 16613 - protein, 277 aa, Thermobifida fusca
MCRGGGAHTDDDTTPLRKDATMRRFEGRIAAIVGGGSGMGRAISHRLASEGATVYVADLSEESAKKVAEEITAQGGKAVPVQVDATNNDSLRALFDRIRSDHGVLHVLHAQVGMPGPGGIETSDEEWQKNIDVNIKSAYYTCTLGYDLLKSANGKGSITMTSSTSALVGSPFSPIYSLTKGSLVPFARALALKGAPDGIRVNVICPGTVQTPMLAQFFGREPGADVSELTKDFIKNIPLGRGAQPEEIASVIAFLASDDASYVTGVTIPVDGGLTAK

SEQ ID NO: 16614 - protein, 316 aa, Cryptococcus neoformans
MNGQVVKINLPDRLVIMANHQAYLDWIYIWILACYAGHSAGLIILLKASLKNIPVIGWGMRFFNFIFLRRSWVADRDNLTLALRQLGQEAQSGQENSETATLLPLRKRSPLWLLIFPEGTIISDEERVKSIKYAKKEGVDDFATLLHPRSTGLLFCLRTLLPQIPDLNLLDITIGYPGVPFGNYPQNWYGLFSVFLKSVPPPTVYLHLHVYSHLGEPECKIPSLVPRRSSNVSGLSTDSGLANAEEARAFELWLRNLWTAKERRMEQFYESQRFGGPCDIVPIQQIKWYHWISAIGGGGLGTVVLLAFCIWFAVCR

SEQ ID NO: 16615 - protein, 383 aa, Picea abies
SRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEELTKPFKEAMAFLKKIENQLGALTKGTIRTSSLDQGDERGDGAASSEEEDGSGGEVEFHEVDPHAEDRELKDQLLRKYSGYLSSLKQEFLKKKKKGKLPKEARQKLLDWWTRNYKWPYPSESQKIALAESTGLDQKQINNWFINQRKRHWKPSEEMQFVVMDSPNPHNAAFFLEGHLRTDGTAFSMDC

SEQ ID NO: 16616 - protein, 119 aa, Alternaria arborescens
STGGKAPRKQLASKAARKSAPSTGGVKKPHRYKPGTVALREIRRYQKSTELLIRKLPFQRLVREIAQDFKSDLRFQSSAIGALQESVEAYLVSLFEDTNLCAIHAKRVTIQSKDIQLAR

SEQ ID NO: 16617 - protein, 419 aa, Cryptococcus neoformans
MAQKPLYTIPINDRPPHGPWTSKILFPVIFTLAQLSINSAQFLLVPLLLVPFVGKRLFSRAIGWTKDGYGRLLIAITVLFGPTQFAITTDTPPPHGQTLVERDMNGQVVKINLPDRLVIMANHQAYLDWIYIWILACYAGHSAGLIILLKASLKNIPVIGWGMRFFNFIFLRRSWVADRDNLTLALRQLGQEAQSGQENSETATLLPLRKRSPLWLLIFPEGTIISDEERVKSIKYAKKEGVDDFATLLHPRSTGLLFCLRTLLPQIPDLNLLDITIGYPGVPFGNYPQNWYGLFSVFLKSVPPPTVYLHLHVYSHLGEPECKIPSLVPRRSSNVSGLSTDSGLANAEEARAFELWLRNLWTAKERRMEQFYESQRFGGPCDIVPIQQIKWYHWISAIGGGGLGTVVLLAFCIWFAVCR

SEQ ID NO: 16618 - protein, 385 aa, Triticum aestivum
MEGGGARNVSAAAAQTEGSGDDGSRKPLPPCCVKAQAAVAESEAKCHATVVSGWFTGTRSRSGKPSKARYFNNPMWPGEAHSLKVEKILYQGKSPYQEVLVFESSTYGNVLVLDGIVQLTDKDECAYQEMVTHLALCSIPSPKNVLVVGGGDGGVLREIAKHDSVETIDICEIDQLVIDVCKDFFPRLYVGYKDPRVRLHVGDAVEFLRNSPEGKYDAIIVDSSDPIGPAQELVEKPFFQTIARALKPGGVLSNLAESMWLHTHLIQDMLSICREVFKGGVHYAWASVPTYPSGVIGFLLCAKDGPPVDFLTPVNPIEKIEGATKDGREMRFYNSEIHRAAFILPTFVKRELEAYSTSTEKEKPEKPTAKPVKMKVMRDSAITAS

SEQ ID NO: 16619 - protein, 103 aa, Lactuca sativa
MSGSGKGGKGLGKGGAKRHRKVLRDNIQGITKPAIRRLARRGGVKRISGLIYEETRGVLKIFLENVIRDAVAYTEHARRKTVTAMDVVYALKRQGRTLYGFGG

SEQ ID NO: 16620 - protein, 420 aa, Unknown
  Saccharomycetales
  misc_feature (113)..(113): Xaa can be any naturally occurring amino acid
  misc_feature (115)..(115): Xaa can be any naturally occurring amino acid
  misc_feature (128)..(128): Xaa can be any naturally occurring amino acid
  misc_feature (156)..(156): Xaa can be any naturally occurring amino acid
KIKDPKILGIDPNVTQYTGYLDVEDEDKHFFFWTFESRNDPAKDPVILWLNGGPGCSSLTGLFFELGPSSIGPDLKPIGNPYSWNSNATVIFLDQPVNVGFSYSGSSGVSNTXAXKDVYNFLELFFDXFPEYVNKGQDFHIAGESYAHGYIPVFAXEILSHKDRNFNLTSVLIGNGLTDPLTQYNYYEPMACGEGGEPSVLPSEECSAMEDSLERCLGLIESCYDSQSVWSCVPATIYCNNAQLAPYQRTGRNVYDIRKDCEGGNLCYPTLQDIDDELNQDYVKEAVGAEVDHYESCNFDINRNFLFAGDWMKPYHTAVTDLLNQDLPILVYAGDKDFINNTLGNKAWTDVLPWKYDEEFASQKVRCWTASITDEVAGEVKSYKHFTYLRVFNGGHMVPFDVPENALSMVNEWIHGDFSL

SEQ ID NO: 16621 - protein, 433 aa, Picea abies
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPSVKTEVGSGLRNQLEFHREQTGNGYTDQSSNTPVNPLVTSLASQARGEAQMIPSWDANSPHFNVDNEEYAIKSKILAHPQYPSLLGAYIDCQKIGAPPEAVARLDALTREYQNQQRRTVSIGMDPELDQFMEAYCEILTKYHEELAKPFKEAMTFLMKIEAQFNSLGKGTIRISPPAENDKKTEGGGSSEEVEDGSGGETDFQEVDHHAVEDRELKDHLLRRYSGYLSSLKQEFMKKKKKGKLPKDARQKLLDWWSLHDKWSYPSETEKIALAECTGLDQKQINNWFINQRKRHWKPSEDMHFMVMNSHSPHSAALYVERHLMTEGYHLDC

SEQ ID NO: 16622 - protein, 1555 aa, Wolinella succinogenes
MKKLFALVTLLLLGLTLHASTQKLSLRLQWKHQFEFAGFYTAIEKGYYQEAGLEVELKEYENGVNIIQEVLEGKSHFGIWGSGIIKEQMEGKPILLLANYFKRSPLAIVTSPEIKSPGDLKGKRLMLSEVNIDSANFTHMLQGFGLSMKDIQILSTSFNIHDFIDGKVDAYSIFLTNELFDLQRLGVRYNILDPSNYGVELYDENLFGAKEFVLKNPTLVKRFIDASNRGWQYALDHPEEIVDLILERYNTQNKTKEQLLFEARETAKMVLSRSYPIGSIDPHKVRKIGEIFAEARLAPPAKDYASFLFGQIRTSLDLTEAERAYILMRPTLRVQNESDFAPMNYHSDGGQPAGFSIDYIKLLASKVGLKVEYVSGPTWSEFLQMMRDGRLDAMVNIAKSPEREEYLLFTSPYSEIISAVFTKDSRAQEFSSLNDLKGKKLAVVKGFFEEALLKKHYPEIEMVFAEDTLSALKMVAFGKADAAINSLQVGNFLIKKSGLSGMAPAFEVQDPQFRVNLHVATSSSNSTLRNLLEKAKEQVSDSELLLLTSKWFLQGNAPDKEKRITLSEKERAYLKARSTPFTLCVDPLWMPFEKLDSKGNYEGIAADLLKIVFERTGVEAKVLQTKDWVETLNAVKSGQCDILSFSNQTPAREEWLLFSDPLFQDPNVFITHADHPFITNPKSLEGKTIVLPKGTSIEEWVRRDYPWLKLILVETEEEVFKALLERKADLSIRSLTVAAYTIKKEGLFSLKIAGQLPEKDNHFRMGIKPKEPILRDILNQGIHTLTPEEIDRIANKFVSVNIQKGFDYSLLWKILIGMAGIFVGFFYWNRKLTEYNKALQAAKEKAEAATQEKSNFLANMSHEIRTPMNAIIGMTYLAQQTDLTPLQRDYLQKIEGSANALLGLINDILDFSKIEAGKLEIECIDFDLHSVIEHVSTLVELKATEKNLEFVVSYDQGMNMNLHGDPLRLGQILTNLANNAIKFTHEGEVGIYITKQELHRYRFEVRDTGIGLSPGQKEKLFRSFSQADTSTTRQYGGTGLGLAISKQLVEMMNGRIWVESEEGKGSSFIFEIELNEQENAPKESKAFSHKHVLIVDDTPSWQKILARLLKGFHIEVSVASSGEEALRLIKEQPGFYDLILMDWKMPQMDGIETTKLIKESCETPPPTIIMVSSYRQENIVNAAKEQGINVFLQKPINPSLLYNVLLEILGEGIKQSGVQKADSHSLKNELTTRAGSQILLVEDNAMNREIIMGMLQPFGIRIDIAQNGQEAVTLYQENPKRYELILMDIQMPVMDGYEATKILRAQGANLPIIALTANAMKSDIERTKAAGMDEHLNKPIVVEKLFGTLLAHLTPKCAPQENPSLAPQELQSSTLPTLVHTDTLKGIAHLAGDEALYRKLLRDFIEHYENLEIEPASQEGARILHTLKGLSANLGMDELSRLAKECEENPSLTSLASLTQALSQALQELKESGILSDSTPLIPQIAAPEGRVEEIWSELGSLLPKRRPPLCKPLLEELEGYALNERDRALFERLKPLVERYKFSEALKILEERLS

SEQ ID NO: 16623 - protein, 162 aa, Chlamydomonas reinhardtii
MANPEFYGLSTTTLSGQPFPFKDLEGKAVLIVNVASKCGFTPQYKGLEELYQQYKDRGLVILGFPCNQFGGQEPGDASAIGEFCQRNFGVTFPIMEKSDVNGNDANPVFKYLKSQKKQFMMEMIKWNFEKFLVDKSGQVVARFSSMATPASLAPEIEKVLNA

SEQ ID NO: 16624 - protein, 480 aa, Pseudomonas fluorescens
MSDNNKRDDDMQSQDSGLRRGLTARHIRFMALGSAIGTGLFYGSASAIQMAGPAVLLAYLIGGAAVFMVMRALGEMAVHNPVSGSFGHYASQYLGPLPGFILGWTYAFEMLIVCLADVTAFGIYMGFWFPEVARWIWVLGIVLFIGGLNLCNVKVFGEMEFWLSLLKVGAIVAMILGGLGIMLFGISSAAQDQATGAANLWAHGGFMPNGISGVIASFAVVMFAFGGIEIIGVTAGEAQDPKRVIPKAINAVPLRILLFYVLTLFVLMSIFPWPQIGTQGSPFVQIFDSLGISSAATILNIVVISAAVSAINSDIFGAGRMMYGLARQGQAPKGFAQVSKHGVPWMTVVVMAVTLLIGVVLNYLIPENIFLLIASLATFATVWVWLMILLTHVAMRRSMTAEQVAQLQFKVPFWPWAPAAAIAFMLFIFGVLGYFPKTQGALIVGVVWIALLVVAYMLWVKPMAGQAQAIMSDAPLPTDH

SEQ ID NO: 16625 - protein, 381 aa, Solibacter usitatus
MEANRRQIFTALLAAAAARKLTAADGVTIPGKRPLILHNDRPEDLETPVRYLNTWITPVDAFFVRQHLPRPSAIDPAAYRIAINGMVSKESQISLADLQKLPQHTVPATLECTGNGRAFFTPKLPGIQWGRGGVGNAEWTGPRLSDVLKLAGVDTAAKFLEIDGADSGVLQTPDFVRCMPMEKALHPATLLALKMNGEAPEIHGVPARLIVPGWDGTSWVKWVIRLTPTAKESGGFFMNPGYRYPKYALPPGSAPRPAELEVIEGMPVKSTLTVPEDQSKIPLAPTVIRGFAWAGENAIERVEVSTDGGAKWQNAQISTQKLPFAWRLFNLNWTPKEPGYYTILSRATDTAGRVQPIVPAWNPSGYLWNGIDKVGVTVEKV

SEQ ID NO: 16626 - protein, 273 aa, Triticum aestivum
  misc_feature (181)..(181): Xaa can be any naturally occurring amino acid
  misc_feature (203)..(203): Xaa can be any naturally occurring amino acid
  misc_feature (259)..(259): Xaa can be any naturally occurring amino acid
MDHEEIKNVVRKFPAFAYYNVDRKIKPLVELRLELGVPRSGIPGIIRKRPQLCGISLTDNLKPMMAYMENIGVNKAQWSKVICRFPAFLTYSRQKVEMTVSYLTELGVSKENIGKILTRCPHLMSYSVNDNLRPTADYFRSIGADAASLIQKCPQAFGLNIESKLKPITEFFLEREFSIEXEIGIMVNRFGIIHTLSLQENLXPKYEYFLTMGYPRYELVKFPQYFGYSLRAEDKTSGMLRMTGCGVRLIPNQMLSVSXTRFGGILQKKSGGF

SEQ ID NO: 16627 - protein, 1044 aa, Arabidopsis thaliana
MERARRLAYRGIVKRLVNETKRHRNGESSLLPTTTVTPSRYVSSVSSFLHRRRDVSGSAFTTSGRNQHQTRSISVDALKPSDTFPRRHNSATPDEQAQMANYCGFDNLNTLIDSTVPKSIRLDSMKFSGIFDEGLTESQMIEHMSDLASKNKVFKSFIGMGYYNTHVPPVILRNIMENPAWYTQYTPYQAEISQGRLESLLNYQTVITDLTGLPMSNASLLDEGTAAAEAMAMCNNILKGKKKTFVIASNCHPQTIDVCKTRADGFDLKVVTVDIKDVDYSSGDVCGVLVQYPGTEGEVLDYGEFVKNAHANGVKVVMATDLLALTMLKPPGEFGADIVVGSGQRFGVPMGYGGPHAAFLATSQEYKRMMPGRIIGVSVDSSGKQALRMAMQTREQHIRRDKATSNICTAQALLANMTAMYAVYHGPEGLKSIAQRVHGLAGVFALGLKKLGTAQVQDLPFFDTVKVTCSDATAIFDVAAKKEINLRLVDSNTITVAFDETTTLDDVDKLFEVFASGKPVQFTAESLAPEFNNTIPSSLTRESPYLTHPIFNMYHTEHELLRYIHKLQNKDLSLCHSMIPLGSCTMKLNATTEMMPVTWPSFTNMHPFAPVEQAQGYQEMFTNLGELLCTITGFDSFSLQPNAGAAGEYAGLMVIRAYHMSRGDHHRNVCIIPVSAHGTNPASAAMCGMKIVAVGTDAKGNINIEELRNAAEANKDNLAALMVTYPSTHGVYEEGIDEICNIIHENGGQVYMDGANMNAQVGLTSPGFIGADVCHLNLHKTFCIPHGGGGPGMGPIGVKQHLAPFLPSHPVIPTGGIPEPEQTSPLGTISAAPWGSALILPISYTYIAMMGSGGLTDASKIAILNANYMAKRLESHYPVLFRGVNGTVAHEFIIDLRGFKNTAGIEPEDVAKRLMDYGFHGPTMSWPVPGTLMIEPTESESKAELDRFCDALISIREEISQIEKGNADPNNNVLKGAPHPPSLLMADTWKKPYSREYAAFPAPWLRSSKFWPTTGRVDNVYGDRNLVCTLQPANEEQAAAAVSA

SEQ ID NO: 16628 - protein, 328 aa, Triticum aestivum
  misc_feature (304)..(304): Xaa can be any naturally occurring amino acid
MPQTSGSGEDGEFMCSCRCVGSPGNLLESSWPACNASNPVLLGGPMTAVGRRQVGSRSSDAGSWCAAAPGVSSSSSSLGSGIAESDSRMIMEWCDTMAWPLSVHSTGCETMALSHVVRTACTMLDAYTYIAMMGSQGLTEASKIAILNANYMAKRLEKHYPVLFRGVNGTVAHEFIIDLRGFKATAGIEPEDVAKRLMDYGFHGPTMSWPVPGTLMIEPTESESKAELDRFCDALISIREEIAQVENGKADAHNNVLKGAPHPPQLLMGDAWTKPYSREYAAFPAAWLRGAKFWPTTCRVDNVXGDRNLICTLQQASQVAEEAAAATA

SEQ ID NO: 16629 - protein, 365 aa, Unknown
  Rhodococcus sp. RHA1
MSTERFETIVIGAGQAGLATGYHLTRCGQRFVILDAHDRVGDVWRERFDSLRLYSPARYDGLPGWGIPAPAWSWPGKDEVADYFEAYAQRFALPIRTGTTVDGLSRDGDRYVVTAGTDRFEADNVVVASGTWQSPVVPDLAERLDPRIRQLHSSDYRNPSQLQDGPVLVVGCSHSGADIALEASRSHRTTICGPVRGEVPFDIEGRLAHLAVPIMWFMANHVLTERTPVGRKMCTHVRSGGGPLLRVKRADLAAAGVEHFPAKVTGVHDGRPVLDDGTAFDVRNVIWCTGFRKDTSWIQIPVTGSDGWPEQSRGVSPDHPGLYFVGLPFLQAFASMLTGGVGRDAAYVAKHIAKRVVVRSPEAVA

SEQ ID NO: 16630 - protein, 242 aa, Sulfolobus solfataricus
MSGKVYLVGAGPGDPELITVKGLKILQRADVVVYDRLISKELLNFCKIEAEKIYVGKNIGDYVIQDEINELLVKKAMENKVVVRLKGGDPYVLGRGEEECLYVISKGIECEVIPGITSAIAVPAYAGIPVTSRIYSASGFTIISGTKAEDKLIDEDYIPRKGTLVILMGLRKIENMVNILIKLRNEREPVAVIENGTTENQRVFTGELKDLVNIVRSNNVTSPAVIVIGEVVKFREYLWKFK

SEQ ID NO: 16631 - protein, 359 aa, Bdellovibrio bacteriovorus
MTEAFSGFKFFGIAKSTIFERNQLMKAPVRVAVTGAAGQIGYALLFRIASGAMLGADQPVILQLLEIPDEKAQKALKGVMMELEDCAFPLLHSMIATGDPAVAFKDADVALLVGARPRGPGMERKDLLTANGQIFTVQGEAIGKYANPNVKVLVVGNPANTNAYIAMKSAMKHGRVKAKNFTAMLRLDHNRALSQLATKTGKPVASFKKVAVWGNHSPTMYPDVRFATADGAKVPELLKLGTAEGDAWNKDTFIPTVGKRGAAIIEARGLSSAASAASAAVDHIRDWWLGTNGEWVTMGIPSDGSYDIPEGIMYGFPVTCKNGEYEIVKGLEIDAFSREKMNNTLKELNEEKDAVASML

SEQ ID NO: 16632 - protein, 463 aa, Chlamydomonas reinhardtii
MTQSRVEQNLQRVNELKAEATTLERMRKASDLDIKERERIAISTVAAKGPASSSSSAAAVSAPATSATLTVERPAATTVTQEVPSTSYGTPVDRAPRRSKAAIRRSRGLESSMEIEEGLRNFWYPAEFSARLPKDTLVPFELFGEPWVMFRDEKGQPSYIRDECAHRGCPLSLGKVVEGQVMCPYHGWEFNGDGACTKMPSTPFCRNVGVAALPCAEKDGFIWVWPGDGLPAETLPDFAQPPEGFLIHAEIMVDVPVEHGLLIENLLDLAHAPFTHTSTFARGWPVPDFVKFHANKALSGFWDPYPIDMAFQPPCMTLSTIGLAQPGKIMRGVTASQCKNHLHQLHVCMPSKKGHTRLLYRMSLDFLPWMRHVPFIDRIWKQVAAQVLGEDLVLVLGQQDRMLRGGSNWSNPAPYDKLAVRYRRWRNGVNAEVARVRAGEPPSNPVAMSAGEMFSVDEDDMDN

SEQ ID NO: 16633 - protein, 362 aa, Zea mays
  misc_feature (91)..(91): Xaa can be any naturally occurring amino acid
IPGSTHASGESHRQGRGRRASHFCDEDGYDLPSSAYDATPRQNEESSEDNDDTSDATAEDEPERDTEAGEQDQWQGSMPSKFHLYQLSVQXEWIRTDARRTAIGLDLDLESLEWCLENNLSKIGADGYSRMLLFHGNVLQPMESRLVKQKFTNLVHGLDLNSNNGTGSNSCKQMGLADSKCLANLTMSEADFPARDIICAFNYSCCCLHSRKDLVLYFRHVCSVLSERGGIFVMDVYGGISSERKLRLQRKFPSFTYFWEQDEFDIISRQTRISLHFQGGKKQMLRYAFTYHWRLWSIPEIKDCLEEAGFKWVHVWMREMPNTQSGGNAKEYNANRDVKYEESQHFNQGDAWNAYVVGVANV

SEQ ID NO: 16634 - protein, 352 aa, Solanum echinatum
  misc_feature (127)..(127): Xaa can be any naturally occurring amino acid
AWDTSVDIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSIGIYLNAXVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16635 - protein, 360 aa, Prochlorococcus marinus
MKTWVIKIGTSILRGTEETSTEEVIENLSRSFTSFLSKGNKLILVTSGAVGLGCQKLNIKTRPNDLSTLQATAAVGQVNLMSLYDKVFNKLGLNIAQILITKADFNSRESFNNASKTLKRLIDLNVIPIVNENDTVANEELKYGDNDTLSALVALAINANKLILLTDIENLYSKDPRNNKDAQPIKEVHNSELKEIKDKNIQNSNNEWGTGGISTKLISAEIATKGGVEVQLVDGTNKKNLIEIFNDNKIGTLFYPVEKPIGNKKSWLSHAIQTVGKITLDDGASFAIKKKGASLLAVGVKNVEGNFTINQAVKIVNTNDKEVAKGLVSISSDKLRSILNNKENNNSSIIVVHRDVLALS

SEQ ID NO: 16636 - protein, 330 aa, Solanum elaeagnifolium
WDTSVAIEVKVGDSIEIVRFFHCYKRGVDRVFVDHPMFLEKVWGKTGSKIYGPKTGQDYLDNELRFSLFCQAALEAPRVLNLNCSKYFSGPYGEDVLFIANDWHTALIPCYLKSMYQSRGIYLNAKVAFCIHNIAYQGRFTFSDFPLLNLPDEFRGSFDFIDGHEKPVKGRKINWMKAAILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEELYPNKAKGVAK

SEQ ID NO: 16637 - protein, 353 aa, Solanum elaeagnifolium
DAWDTSVAIEVKVGDSIEIVRFFHCYKRGVDRVFVDHPMFLEKVWGKTGSKIYGPKTGQDYLDNELRFSLFCQAALEAPRVLNLNCSKYFSGPYGEDVLFIANDWHTALIPCYLKSMYQSRGIYLNAKVAFCIHNIAYQGRFTFSDFPLLNLPDEFRGSFDFIDGHEKPVKGRKINWMKAAILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEELYPNKAKGVAKFNVPLAHMITAGADFMLIPSR

SEQ ID NO: 16638 - protein, 405 aa, Ostreococcus tauri
  misc_feature (336)..(342): Xaa can be any naturally occurring amino acid
MEEPRGRARVGETNSSAGGFVRVVDANAFARGECDSPFVFAGFNAYGLGELGADFEDGAYMFGVDRGQGRRAATRMLDAASDAGMNAARVWAFSVNERRKTWRRNARGELEHDEAFLTGLDWVVGEASKRRMVLILALADHWHTTSEFLAECVGDADADMSEFYERVECREMYVWHASKILMRYRDEPAVGAYNLINEPRCRGCDESLQRWIDWAAPFVKTLAPNQLLTIGEEGFYAAGEDNARVNPASWAGTTGQDFNRNHASSAIDFAALHVWRDNWAVYSPSVRFDAEAFTRRWIAAHERDARMILRKPLVVEEFGAAPGVDEMNVELIIIIXXXXXXXAESSLRGALFWGLVPESMRAEVDQWDPFAVYPSDGAFELASRFAQSIESSSTRATSCNDESTR

SEQ ID NO: 16639 - protein, 570 aa, Candida albicans
MSEHKWWKEAVVYQIWPASYKDSNGDGVGDIPGIISTLDYIASLGVTTVWLSPMYDSPQDDMGYDVSDYENVYSKYGTLQDMDRLIAGCHDRGLKLILDLVINHTSVEHKWFKESRSSKDNPKRDWYIWKPPRIDSNGNKHPPNNWGSYFSGSAWKYDELTGEYYLHLFAESQPDLNWENKECREAIYNSAIKFWLDKGVDGFRIDTAGMYSKYQHFKDAPVAFPDTEFQPCEIYHKNGPRIHEFHKEMAKVMEPYDTMTVGEVGHSTREQALKYVSAAEKEMNMMFLFDVVELGSDPRDRFRYNGFDLVDLKKAIKSQGEFAEGTDAWSTVFIENHDQARAISRFGNDSPEFRVLSGKAIAMLQCCLTGTLFIYQGQEIGMTNVPRSWPIEEYKDINTINYYRAFKEKYGKDADYKQKEEKLVDVINRLARDNARTPVQWSHQQYAGFSEVEPWMRVNDNYKEINVEDQDGDDHSLLNFYRKLLKLRGEYKDLFVYGEMKFLDFDDKKLFTFAKEAPGSPVAYIVINFSGEDVKFEPLIKGNYKLVLTNVDKDSKDALSPYEARMYVVD

SEQ ID NO: 16640 - protein, 107 aa, Haemophilus somnus
MSEVLHTTDATFDTDVLKSDIPVLLDFWAPWCGPCRMIGPILEELSAELGDKVKIVKINIDENQATPAQFGVRSIPTLIFFKEGKAVATQVGALPKNQLVNFINQNS

SEQ ID NO: 16641 - protein, 702 aa, Alkaliphilus metalliredigenes
MIRTFEMELGGRPFVVELGKVAELAQGSCMIKYGDTFVLVTACASKEPKEGLDFFPLSCDYEEKLYAVGKIPGGFIKRESRPSEKATLTARLIDRPIRPLFPKGYHNDVQVIATVLSVDQDCPPDISAMIGSSIALSVSNIPFMGPTASVSVGMIDGKYIVNPTSEQKELSELELIVSGTKDAVMMIEAGANELTEAQILDAIMFAHEEIKKIVTFIEHIVSEVGKPKSEVIVKETDSELLAEVVSFLDTKLANAIKTVDKTERNENIKAISAEALDYFEEKYEGRSKEVNTILSKQIKVETRKMITSEGIRPDNRKLDEIRPISSEVGILPRTHGTGLFTRGETQVLTVTTLGDLRDAQRIDGLGEEDEKRYMHHYNFPPYSVGETRFMRGPSRREIGHGALVERALKPMIPCKEDFPYAIRLVSEVLACNGSSSQASVCGSTLSLMDAGVPIKGMVAGIAMGLIKEEGQIAILSDIQGMEDALGDMDLKVAGTENGITALQMDIKIAGIDRNIMETALAQAKIGRTHILNKMKEAITSPRTELSAYAPQVTKLKVHPDKVREVIGAGGKVINKIIDETGVKINIENDGTIYIAAPDQESARVALEMIELIVKDPVVGEVYTGKVIKIMDFGAFVEILPGKEGLVHISNLAHERVAKVADVLAEGDLIEVKLMEINPQGKIGLSRKALLPKPEKEAPKKIE

SEQ ID NO: 16642 - protein, 519 aa, Ostreococcus tauri
MIDEDRVTALVPQGDGNSRTPHSRARAMRTLARAPAARCVSIQRSRDRDVVKNARVATPRATIVPRGFRPNARASSRAGVVLDRSRSTVVAKSSSSDEAPRLTRSKTFTETFMTGVDVRAALDAGFGSVALLGATALSLMLANSAASGVWASFWHAHIGPAALGLNMSLHHWTNEGLMALFFFAVGLEIKREFVHGSLKSIKQAALPCIGALGGMIVPMGVYLALNNPAMTASAVVAGWAIPMATDIAFAMGVYNFFKNKLPGGVAAFLLTLATVDDLGAIAVIAVCFAKSLTMSYIAGAAAATGALFLACKKEVTNMAVYAGLGVALWYCLLQGGINADVAGVIAAFAVPGNAPAPAGSDATPEHEGGEPTLLDHLVHKFAPLSALVIMPLFALANTGVPLDASMIGKVFTEPVGQGIMFGLLLGKPVGIAGLSWLAVKAKVGTLPNGMNNVHLLIVGLLGGIGFTMCLFLVEMALAGNAAAANTGKLAVLVSSTLAALIGAGCMARLPDRDAKLKTA

SEQ ID NO: 16643 - protein, 353 aa, Solanum felinum
DAWDTSVAIEVQVGDSIEIVRFFHCYKRGVDRVFVDHPMFLEKVWGKTGSKIYGPKAGQDYLDNELRFSLLCQAALEAPRVLNLNCSKFFSGPYGEDVLFIANDWHTALIPCYLKSMYQSRGIYLNAKVAFCIHNIAYQGRFAFSDFPLLNLPDEFRGSFDFIDGHETPVKGRKINWMKAGILESDRVVTVSPYYAQELVSAVDKGVELDNVLRKTSITGIVNGMDTQEWNSATDKYTDIKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16644 - protein, 445 aa, Porphyromonas gingivalis
MKTQEIMTMLEAKHPGESEFLQAVKEVLLSVEEVYNQHPEFEKNGIIERIVEPDRVFTFRVPWVDDQGKVQVNIGYRVQFNNAIGPYKGGIRFHPSVNLSILKFLGFEQMFKNALTTLPMGGGKGGADFSPKGKSEAEIMRFCQSFMTELWRNIGPDTDIPAGDIGVGGREVGYMFGMYKKLAREHTGTLTGKGFEFGGSRLRPESTGFGAVYFVQNMCKQNGVDYKGKTLAISGFGNVAWGVAQKATELGIKVVTISGPDGYVYDPDGINTPEKFRCMLDLRDSGNDVVSDYVKRFPNAQFFPGKKPWEQKVDFAMPCATQNEMNLEDAKTLHKNGVTLVAETSNMGCTAEASEYYVANKMLFAPGKAVNAGGVSCSGLEMTQNAMHLVWTNEEVDKWLHQIMQDIHEQCVTYGKDGNYIDYVKGANIAGFMKVAKAMVAQGVC

SEQ ID NO: 16645 - protein, 239 aa, Unknown
  Synechococcus sp. WH 8102
MAVVTLAEMMEAGAHFGHQTRRWNPKMSRYIYCARNGVHIIDLVQTAVCMNNAYKWTRSAARSGKRFLFVGTKKQASEVVALEAARCGAAYVNQRWLGGMLTNWTTMKARIDRLKDLERMESSGAIAMRPKKEGAVLRRELERLQKYLGGLKTMRRLPDVVVLVDQRRESNAVLEARKLDIPLVSMLDTNCDPDLCEVPIPCNDDAVRSVQLVLGRLADAINEGRHGNNEQRGGGDAEG

SEQ ID NO: 16646 - protein, 339 aa, Debaryomyces hansenii
MGQLLSHPIEDKTMEHKSYDTITYCIGLMQGYRMSMEDAHNVKVNEDESLAVFGVFDGHGGKTCAEVVSDKLPTMVFRELSSLLKNGNGDLASYMKVLKDSFFRIDRDLTNEDSSNCGTTAIIASIIANEYIIVSNAGDSRCIMSLEGGAPKTLSFDHKPSTMGERVRIENSGGYVVNGRVNEILALSRAFGDFKFKLPYMELLNNQNKYIAANKKYFKHELIHLPPELFLVSVEPDVVVYDLKSLKQPEFVVLACDGIWDCYTNTKLIKIIRDKLSLDWKIHHITEFILNDCVGMANNVTGIGFDNMTIIIVAVHNNNNIDEWYTMMKERVLKEKGLL

SEQ ID NO: 16647 - protein, 353 aa, Solanum ferocissimum
DAWDTSVAIEVKVGDSIEIVRFFHCYKRGVDRVFVDHPMFLEKVWGKTGSKIYGPKAGQDYWDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16648 - protein, 104 aa, Glycine max
MSAAAGGLRQLLTAAVTAGAAEARAAIFGHAVNPLGKRAATKLLRKKLIGEHVAQWYPDDIKRDDPEVMAREEKERLAKLEMLKRRGKGPPKKGQGRRAIKRNK

SEQ ID NO: 16649 - protein, 557 aa, Campylobacter upsaliensis
MNEANKKVQNNIEDLFGEEEDFGKLLDAYDKSKEEAIFEGKIVAIKNDEVYVDIGKKSEGLLALEEIQDDKGNLIFNVGDSIKVATMGSRGGRIVVSHKKALRKEKVVEFIKNYNEENENIFDVKVISKNKGGLVAVDNDGVEFFIPKSQYSFKNSNNPIGKNFKVKIIKVDKEEQSIVASRKRVLEDERKKRKEIISEILDKNELIEGLVKKITTYGIFVDVGGIDGLVHYSEISYKGPVNPSSLYKEGDKVPVKIIKYDKDKKHLSLSIKAALPDPWSEIKDSLEVGDTIKVVVSNIEPYGAFVDLGNDIEGFLHISEISWNKNIKNPKDYISKGEEIDVEVIEINSDERRLRVSLRNLLSKPFDEFSKTHKVGDMTQGIVTSITAFGAFVKIDNVEGLLHNEDASWDRNDKCKELFKIGDEIKVKIIKIDEDHQKISLSTKELKNSPVQEYAKTHKIGDVVKGIIRDIKDFGIFVELSENVDALIHKEDISSAMLETLKIDDEIEAAIAFIDEKKNRIRLSVKNLLRLKEREVLNEINGDDKMTLGDIIKEQLS

SEQ ID NO: 16650 - protein, 151 aa, Arabidopsis thaliana
MASISLSSSTVPSLNSKESSGVSAFASRSISAVKFQFPVRRIEAKKQTFDSFEDLLVNSDKPVLVDYYATWCGPCQFMVPILNEVSETLKDKIQVVKIDTEKYPSIANKYKIEALPTFILFKDGEPCDRFEGALTAKQLIQRIEDSLKVKP

SEQ ID NO: 16651 - protein, 491 aa, Unknown
  Synechococcus sp. WH 8102
MSSLQIVWFKRDLRVDDHRPLLEAAARGPVLPLYVVEPELWQQPDASERQWLFCRESLLELRQALAELGQPLVVRSGDVVQVLERARRQFGVDGLWSHEETGNGWTYQRDKRVGAWARAHGIQWGEIRQFGVTRRMRSRNGWAKRWEEQMAEPITPAPAGVPALEEIDPGVIPERPCPELLPDDCSQRQTGGRSIGLGELRDFLQHRAPCYQRAMSSPKSAFTGCSRLSAYLAWGCLSMREVLQTSRHHSGRGVSSFESRLHWHCHFIQKLEDQPEIEFSDFHPYMRGIRETNAERLAAWTEGRTGVPFVDACMRALKAHGWINFRMRAMLMSFASYNLWLPWRDSGLHLARQFVDYEPGIHWSQCQMQSGSTSINTIRIYNPIKQGMDHDPQGVFIRQWCPELKDVSTIHIHEPWMLGGGRSAPIVDVTTSMQLAKDRIWEIRRSAGFDRHADAIQRMHGSRKAGLKPTASRRRQKRSNDNGVRQLSLEL

SEQ ID NO: 16652 - protein, 725 aa, Symbiobacterium thermophilum
MREEDIRSTAGHGTSNKDWWPNQLNLRILHQHSEKANPMGPDFNYREEFKKLDYWALKEDLRKLMTESQDWWPADFGHYGPLIIRMAWHSAGTYRIQDGRGGAESGAQRFAPLNSWPDNINLDKARRLLWPIKQKYGRRISWADLMILAGNVALESMGLKTIGFAGGRADVWEPEEDIYWGSEQQWLGRDRFGEEGKLEDPLAASEMGLIYVNPEGPGREPDPLKAAQQIRETFKRMGMNDEETVALIAGGHTFGKTHGAASPSHLGPEPEAAPIEEMGLGWKNSYGTGKGGDTITSGLEVTWTSSPTKWTSNFLWNLFGYEWELTKSPAGAWQWRPKNGAGEGTVPDAHDPNKRHAPGMLTTDIALRVDPVYEKIARRFLENPDEFAKAFARAWFKLTHRDLGPRSRYLGPEVPEEEFIWQDPLPKRDYDLIDEGDIAELKKRIQASGMSIREMVMTAWASASTFRGSDKRGGANGARIRLAPQIGWEVNEPEQLRPVLETLEGIQQEFNRSQTGRKRVSLADLIVLAGCVGIEQAARNAGFEITVPFTPGRVDATQEQTDVESFSYLEPVHDGFRNYLKRKFSVPAEHLLIDRANLLTLTAPEMTVLIGGLRVLDCNWGRTKHGVLTDRPGALTNDFFVNLLDMRWKWNATDDENVFEGRDRATGELKWTATRVDLIFGSNAQLRAIAEVYASNDGQEKFVQDFVKAWTKVMNLDRFDLLVKK

SEQ ID NO: 16653 - protein, 760 aa, Oryza sativa
MDTPDRPPRAAATAAVEDSPVFNFINSLSPIPPPKPSDSAHNVQLFKSSDLAPVSSIFASPHVNPAKESKLPIREDSVQLSRESHSPNSVRTRTGATSSIIRMIRCKNIVSENCSITCYLNDSTSSKASQPIQLCGGSAESDTNQNTDGKKDPTTEQDRTDIEFVLLDQCGPEKMDSSQSGNNACENQLSEQHKDELGSFDGGYMFAHQPHSDMLRLAPPFESETQLVNETLQTDNVYCETLLTDGPSGSYTQNSAPDPHLYWAGAVEGCATDYTPQMLPGACQSQLVPNDQINNKLNEPSDYMPMDHNVSSQNLRGMRRRCLFNEKSGAANEGAKNSSARHSTNSTTPRRKISSSDNNLKTLRTPPCALPGIGLHLNALATVPKDKMVPHNDIQSSLNQASNVPSAVGSSPPTDDPHTINDDSSQTAVVAYVGESSQGSPKKKRHKFDNGDGTSCKRCSCKKSKCLKLYCECFHAGVFCSEPCSCQGCLNMPSNMETVLSTREQIESRNPLAFAPKVIRTEPGQELADDSNKTPASSRHKRGCNCKKSSCLKKYCECYQGGVGCSVSCRCEGCKNAFGRREGVALLGIEEAKRGCEEKDGGVKEETTDNDKQLVIYQDSINLTPAESVLATPSVVDYRPLVALPPLSSKKPRSSTKLGGYSSRLEGHLKSDILLSPFESYAEMMLGDGTSNVLKGESSPQTSVKVVSPNKKRVSPPRIGTGLSPICKSGRKLILKSIPSFPSLGVDITNEDPNTSSLAP

SEQ ID NO: 16654 - protein, 404 aa, Thermus thermophilus
MDKVNRRTTLKLMGMGAALLMASGRVRAQGTPTADQVIQGKDPRLIVHNSRTGVLETPLELLREHERTPKEILFIRNNQVLPQGKTLEPIAPDGWIISIEGMVENAQAFDAKILKDLPQVEVEMVLQCSGNGRSFFARAQRASGTQWKHGGMGNVVFKGVPFKVLVEHLKLNIYPGAKYVTVNGKDQPPTLQAPDFEHSVPLEEALEKGILALEMNGEPLPAAHGGPVRFVMPGFYGTMNVKWVDRIRFDVAETFNHNQIPRYRVPNHPIQPGSEFNFTFENSRPNWHQKVKSVIFAPLDGEEVKAGNVLVRGVAWNDGLVPIEAVLVSTDQGRTWIRAKLTSPQSPYAWFHWETYVALSRGEREIWVQAVDKLGRAQPLDGTVHWNPRGYEWNGVDIVKVKVV

SEQ ID NO: 16655 - protein, 180 aa, Solibacter usitatus
MMKMMLLGMAMGAMAFGASSVYDFTLNSIDGAPTPLSTFKGKVVLLVNVASKCGFTPQYAGLEKLYEKYKDQGLVLVGVPANNFGAQEPGSNEEIKTFCSRNYNVTFPMMSKVSVKGADKTPLYQYLTDASANPKTAGEIKWNFTKFLIDKKGNVINRFESAVTPESADMLKAIEAALAQ

SEQ ID NO: 16656 - protein, 216 aa, Caragana jubata
MGRRPARCYRQIKNKPYPKSRYCRGVPDPKIRIYDVGMKRKGVDEFPFCVHLVSWEKENVSSEALEAARIACNKYLTKFAGKDAFHLRVRVHPFHVLRINKMLSCAGADRLQTGMRGAFGKPQGTCARVAIGQVLLSVRCKDGNSHHAQEALRRAKFKFPGRQKIIVSRKWGFTKYNRTDYLRWKSENRIVSMQPLGCHGPLANRQPGRAFINASA

SEQ ID NO: 16657 - protein, 137 aa, Unknown
  Oceanospirillum sp. MED92
MKTPSCEYGVNDNSYQMAGGIEGLTRLVDDFYRFMDELPEAKTIRDMHPEDLTESRQKLAYFLSGWLGGPKLYSQNYGSIRIPMAHKHLPIVEEDSEMWILCMQKAVELQPYEAPFKDYLIEQLRVPAGRITQVCRR

SEQ ID NO: 16658 - protein, 446 aa, Legionella pneumophila
MEIKRVLKDRLSARVCVIGAGPSGIAAIKNLQEHGITNVTVFEKNNQIGGNWVYDEQNEHSSVYETTHIISSKRWSEFEDFPMPVDYPDYPSHSQLLKYFQSYVEHFHLDRYIRFNTVVQKVHRLDDNTWHVIYEDAQGIHEACYDYLLVANGHHWDPFMPVYPGVFDGEILHSHQYKKASIFKGKRVLVVGGGNSACDVAVEISRVAPGTCISMRRGYHIFPKFIFGKPTDVAVAKIQWMPSWLRQKFISLVIRGLQGRYAKYKLMKPDCGPLEIHPTINSELLYFIRHGKIHPRSGISRFEGNTVHFTDRTQGEFDTIIFATGYQISFPFFDKSCIDFSNSTTIPLYRKMMHPEFENLYFIGLCQPQGCIWPLADYQSKIVARIIAGTLKRPDQLHRKIAKEINKPHHRFKSHMRHALEVDYHIFRKELLEMLGQKHKRLKFYP

SEQ ID NO: 16659 - protein, 275 aa, Oryza sativa
MVVADLVWAVDSYGVRLVDWGAAGCSLQLQMVDSSEGLRRLAALLFKCCSLDSSNRPNGLQDPERLARETVFNVNEIEALYELFKKISSAVVDDGLINKEEFQLALFKTNRKDSMFADRVFDLFDTKHNGILGFEEFARALSVFHPNAPIDDKIDFAFKLYDLKQQGFIEKQEVKQMVVATLAESGMNLSDEIIEGIIDKTFEEADTKHDGKIDKEEWRNLVLRHPSLLKNMTLPYLSNSRYRVCKPRSSSTQESGMPLFDRAQQGEHSSSEAVI

SEQ ID NO: 16660 - protein, 202 aa, Triticum aestivum
  misc_feature (75)..(75): Xaa can be any naturally occurring amino acid
  misc_feature (109)..(109): Xaa can be any naturally occurring amino acid
  misc_feature (117)..(117): Xaa can be any naturally occurring amino acid
  misc_feature (146)..(146): Xaa can be any naturally occurring amino acid
MAPTVMASSATSVAPFQGLKSTAGLPVSRRSNGASLGSVSNGGRIRCMQVWPIEGIKKFETLSYLPPLSTEALLXKQVDYLIRSKWVPCLEVQARLGSSSREHNASPGXYYDGRYWXTMWKAALCSGCTDATQVINEVEESKKDYXDAYFRIIGFDNMLKGMRQLNASSNGCKNPARLNHHEGILMHSFVIILGSSITMSKK

SEQ ID NO: 16661 - protein, 2002 aa, Ostreococcus tauri
MRIDQSVARRVQRRHGFEIRSVRINTLAQSANSTAFKTTLHASSGRVVRVERTLDPSRSVYVLRFTLDRDVDGEAVVRGRNAARVHFGLTRESAREWMCLEDAPIDSEYDEETNATRVKFDEETSACTIEIPEYAAPASAQFVLWDAERDAYDEPSGSSASGGAFSVPVGYGYGHARELGASVSSYDAIAKTGEFNIAVLSRKAEACALVLQYGENTMELALNPSSHRTGNVWHVSVPFGGANDVLHAPTREDDVTYGFRFEGDPEGRGGSRFFPAQVLFDPRAIELRKPLNAMEEPTPTPRYMGSLAAVLERRETMTRETSSSANARDDTSSVTLNVDVSTLTSAGTLNAALEELCRLRSVMRFNAVALAPIQARSADGRADAPVSFFAIDPRFGTRADLRAFVNKMRSFGVEVWMRFVLTQTGEGTDEAPRSESLRGVDAASYFQLGESGGLEPAGVPMTTALNPCSAPTMALLTDALRQFALHDGVASFIIETGGGVVRGPLGRSPLLEKLSHDAVIGNAPKKLWLTPSTDECGKMPSWGIIGEINSKYARVVEQFFAGTPGVLNDMSLCLNGSPDIFRANRDARHGMNAIAAKPRLVTSPAAAADDATDPVERAKLATLFTSSGGALIDFDALDPALLPFVAQLAEFRHEFEDVFAADVSVGSVQWIEPYSGGAPNFAASDAPPALACLRRDLTGLTVREIWIAYNGTNTDVAAKLPQAPSGTSWTRRFDTSLPQTERFIAAHAMSAVVVNKPRSVIADVMSGITIAHRASSFKSIPSVASMGNMSEISFASAETADERDAEEIKDAVSSMLASDKAMFVKELTEGKFAATAICHGLGDVASEVREAALMVGRAALSEVDGDGSKYVEALEAYLQSQCGGEPGSHAEDNTRGGIIALYGHAAQVFCDDEGKVRAIEKIVSALSGVKDNGAFIGARSIGNLAADVRERAIEMLIGFKALALESDDVIERRRGAAAMAGVTKGVGLAPLIASDVIGAVKRAIEDKKNPIARAGALLTYAHMCRTAGRGFEPYAIGEAPMVFTLQGDRNNEVREAAHLAQAAVVKALPLTAMKLLSPSLVAGMQHKDWQSKLGSLHIMGDLANRVPQSFMRTLPDIFPTFLDCLFDTHPKVSALAEEILPSMCSCVKNAEVLGMLNLILSALRSPQSETEVCLDKLMETTFVNSMDAPSLAVVLPVILRGLRERTKELKQKAATTFGNICALVDDPRDLIAFIPVLLPELEKAEEHSHPDLREAATRAKNSLLKGIDASSSEKRKEAGEFVQEAIESSGVSVDAETQAYAAALGGWVMDSAPMRIPPAILSNDIKRELTPILESSLADQLDLIEKVSNTSVMLYKGLDETAMQDESTHDYIVDLQGIILAFAGRVLLQRTNFTLERGRTYGIVGQNGTGKTTLLNRVAAKDIAGFPADVSVYYIQHEITSEKEETIVDFMVQMVPEGVARETIVSTLMEVGFDDEKMAATIQSLSGGWRMKLAIARAMLWNADVLLLDEPTNHLDTSAIAWLTNYLKSLKNTTICLVSHDYDFLADVLTDVIHLSEKTLTYYPMGFRDFQALKPEIVAALPSNDNAIAKQANIEGAAAPTEAKKESGFAIDQIGDDQPSHIKPIRFPEPGDLEGVKSRAKVVMYMSNVSFGYPGTSKKILNGATVKITQNSRAALVGLNGAGKTTLLKLLIGELQTDEGVGEVWRHHNLRLSYIAQHSMQHLEDSLENTPLEYLQNRFYQGRDKEVSKRASHNLSKEELAVAQERGNILDVVGRQQRGKHLFYEVRRSGRDESDTDWEMMSALERKDPYVMKMVRNFDEKLKSMQSGMDLRPLTKEEVRLHLENFGIDQDLAMGKIKRMSGGQKSRLVLAAAMWTNPHIIALDEPTNYLDNDTLAALTKALIDFKGGVITISHNEPFVHAVCDELWRVGDGVVVTEGVPGKAPKKLSVAEKRALKMGLDGAEATMKEAQNNKKLTSKEKKEAAAKAKSAKGPIKDLYGRGL

SEQ ID NO: 16662 - protein, 1765 aa, Shewanella oneidensis
MDKSKLRTFRSKILSHIALPLILIMATVYGITSWFNYLSIEKRLYENLAQESSHSASRLQFLLEHAQANTQGLSDFIGLLADKDDINNPEKLKTVLTNRIQRNPDFFGSAIAFKPNTFPNKKLFSPYVYRSGSGFNYLDIGADGYDYTDGNWDWWSKAINQVGGYWSKAYFDEGAGNVLMITYAVPFGVQPDYFGVTTVDLALDRLPEQLGIAPSRLVVLDDQGRLIFHSDKEKVLAASSSGWLDKQNIKNIAFATLLNDGQAGQASFVDDKGTVYLASVAEVAKLKWRVVVMVPKHELFASLLDDIASAILNLSLLTLLLLLTCYIAAKRLTRPLEALESGILAFGQGKAQELTIPKGAVSEIVTLSETFNQMAALLAEREQAILDSRGNRFARLIDGMSDKSFYCSLDPDGQLAQVSEGVTKVLGIPPELLKRKYQRLFSANPLNEKNWEYTDLALKGQNVPPHQIELVDAKGQARRLDVFMQPLVSDTGELMSVEMLFTDVTEQFSAAAWSNAVLEAAPEAMLIVDQNGQIVFSNSRCQQLFGYDAKAMLALQIETLLPEELRHLHTGERLDFLREGRDRPMASARHVRALKSDGGEFVAEIALSILPSDFDGRRQVAASIRDMTQKIMVEQKIRDSELRFRGLVTNIPGAVYRTRIGEVWVIEYVSDNIAEITGYAASQFIENRQRTFTSLILEDDRALCNQHIERALAQQETFEVEYRIRHRDGSIRWVHEKGKASYSEEGLPLWFDGSIDDVTESKLAIDEIEASRQQLTNITESIPCTVYQLRWVSPTDRSFTFLSGAALAMLGLHREELLRDFNIIAERIFDEERPEVISALAGKSDDQLRWIREFRYRHPNGGIRWMEAGASGHYADDGSIIWNGYVMDVTERKSIEEELAVSEAHFKALFDGATIGIVNVDIKGLILDCNYQFCEDMGLSRDELRSTPIFDVLSAQDKDVAKAQFKELVEGKIDHYRGERSFVRPSGEPLWMTVNVSTLLDSQNQFESAVVSMVDMTELKLLSDELLVAKDEADAASKAKGDFLANMSHEIRTPMNAIIGMSQLCLQTQLDKKQKNYLEKIERASQSLLSIINDILDFSKIEAGKLDIENVSFQLDTMLEDLSDMFSERAAQKQIELLFAVAPNVPRHLLGDPLRLGQVLINLMNNAIKFTERGEVLLSLSLVEQQNDDVVLRFSVRDSGIGLTQEQQSKLFKSFTQADTSTTRKYGGTGLGLAISKQLVELMGGSIGVESQLGHGSTFFFTVKLCISSGQKLFVGQELDGMSILVADDNATARDIMRTTLESMGFNVDTVRSGDEAIMRCSQQEYAVALIDWKMPNLDGIETAKQIKQQTKNAPRILMVSAHANQDFLTQIEQLGLAGYISKPISASRLLDGIMNALGRSGILPVRRHQDNIAPELLLPLKGKRILLVEDNEMNLEVATEFLEQVGIILSIATNGQIALDKLAQQSFDLVLMDCQMPVMDGYQATKAIRQRPELAQLPVIAMTANAMAGDKEMCLRAGMNDHIAKPIEVNLLYQTLLKYLGAPVPSLENAEFVVNESLNPLNLDVESVVKWPEHPELDIDRGLQLVQNSKRLYQRIFDRFATSQRNVVDQINKALASNKREDAVRMAHTLKGLAGNLSSSKLAELARQLELHLSENADYQVELDQIQILVASICEAIEKAKPQFEETSTSTAEHLPKDALIAALKQLRQSLEDADSDAVTQMDALKPQMSALLWQQLSPALTMINQYQFDEAVDLIDEVLAKLT

SEQ ID NO: 16663 - protein, 479 aa, Glycine max
MEGGGRRITVSPRPCCGRRVVAKKRPRLVDGFVNSVKKLQRREISSNRDRAFSMTDAQERFRNIRLQEEYDTHDPKGPSSVVLSFLRKRSKIIEIVAARDIVFALAQSGVCAAFSRETNERICFLNVSPDEVIRSLFYNKNNDSLITVSVYASDSYSSLKCRSTRIEYIRRVKPDAGFALFESESLKWPGFVEFDDVNGKVLTYSAQDSIYKVFDLKNYSMLYSISDKNVQEIKISPGIMLLIFAKSSSHVPLKILSIEDGTVLKSFNHLLHRNKKVDFIEQFNEKLLVKQENENLQILDVRTFELTEVSRSEFMTPSAFIFLYENQLFLTFRNQTVAVWNFRGELVTSFEDHLLWHPDCNTNNIYITSDQDLIISYCKADSDDSLSEGNGSINVSNILTGKCLAKIRASNGFPMVKECSCSDDNCSSSACNSGKQKHSSRIRSTVAEALEDITALFYDEERNEIYTGNRHGLVHVWSN

SEQ ID NO: 16664 - protein, 353 aa, Solanum fraxinifolium
DAWDTSVAVEVKIGDSIEMVRFFHCYKRGVDRVFVDHPIFLEKVWGKTGSKIYGPKAGQDYLDNELRFSLLCQAALEAPRVLNLNCSKYFSGPYGEDVLFIANDWHTALIPCYLKSMYQSKGIYLNAKVAFCIHNIAYQGRFSFSDFPLLNLPDEFRGSFDFIDGYEKPVKGRKINWMKAGILESHRVVTVSPYYAQELVSAVDKGVELDNVLRKTGITGIVNGMDTQEWNPATDKYTDVKYDITTVMDAKPLLKEALQAAVGLPVDKKIPLIGFIGRLEEQKGSDILVAAIHKFIGLDVQIVILGTGKKEFEQEIEQLEVLYPNKAKGVAKFNVPLAHMITAGADFMLVPSR

SEQ ID NO: 16665 - protein, 374 aa, Ustilago maydis
MTPNKRSRASSIASNDGATAIATAAAAAVPSSSHAASTLPASGPLVHASQDLDDFQASFWRYQMDLVEQGGDADGNIVDFKSGLPTQGQLPLARIKKVMKSDDQVKMISAEAPILFARACEIFISDLTCRAFLIAEEHKRRTIQRSDVTGAIGRSDLFDFLIDIVPRHESVPSSRLPGGGAARREKTGEGRGLGRSNADASASTKQQQNQAVSYDNHLLHSMAGAYDDAEASSSTTAALTEEGGAGSSSQSYNIPHTSNANVNVGHTPMSHWIHDNSADQHSSQPDDHHATHSHHHAASSIHASHPGGASAAHDHQQPHHHAHHHHLAQHAGSHHSHHHSPLDYVTSSSNAGTPNSIGAGSATGGAWPHTFSGF

SEQ ID NO: 16666 - protein, 430 aa, Lotus japonicus
MAQILAPSTQWQTRITKTSPNASPITSNMWSSLLWKQNKKVARASKFRVLAIKSDGSTINRLEGLLNLDVTPYTDKFIAEYIWIGGTGVDVRSKSRTISKPVSHPSELPKWNYDGSSTGQAPGDDSEVILYPQAIFRDPFRGGNNILVICDAYTPQGEPIPTNKRHRAAEIFSNPKVQAEIPWYGIEQEYTLLQTDVKWPLGWPVGGYPGPQGPYYCAAGADKSFGRDISDAHYKACLYAGINISGTNGEVMPGQWEYQVGPSVGIEAGDHIWASRYLLERITEQAGVVLTLDPKPIEGDWNGAGAHTNYSTKSMREEGGFEVIKKAILNLSLRHQDHIRAYGEGNERRLTGKHETADINTFSWGVANRGCSIRVGRDTEKEGKGYLEDRRPASNMDPYVVTALLAETTLLWEPTLEAEALAAQKIQLKV

SEQ ID NO: 16667 - protein, 197 aa, Rhodopseudomonas palustris
MRTATIKRKTKETDIEVTVDLDGTGVANAATGIGFFDHMLDLLAKHSRIDITVKAVGDLHVDFHHTTEDVGIALGQAVKQALGNMAGITRYATVLMPMDETLTRVVIDVSGRPFLVFKADFPRDKIGEFDTELVREWFQAFAMNAGVTLHVETLYGENSHHIAESCFKGLARALRAAVAIDPKTAGEVPSTKGQLGG

SEQ ID NO: 16668 - protein, 216 aa, Citrus limon
MATATMALSSSFVGKAVNLAPSGNELSNGGRISMRKTGSKSVSSGSPWYGPDRVKYLGPFSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVVLMGAVEGYRIAGGPLGEVTDPLYPGGSFDPLGLADDPKAFAELKVKEIKNG

SEQ ID NO: 16669 - protein, 353 aa, Solanum furfuraceum
DAWDTSVAIEVKVGDSIEIVRFFHCYKRGVDRVFVDHPMFLEKVWGKTGSKIYGPKAGQDYWDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGTFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16670 - protein, 353 aa, Solanum glaucophyllum
DAWDTSVAVEVKVADSIEIVRFFHCYKRGVDRVFVDHPIFLEKVWGKTGSKIYGPKTGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGCEKPVKGRKINWMKAGILESHRVVTVSPYYAQELVSAVDKGVELDNVLRKTSITGIVNGMDTQEWNPATDKYTDVKYDITTVMDAKPLLKETLQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16671 - protein, 331 aa, Gibberella zeae
MPLPAKPLDAISQAFPPKPHFTESNVPDLTGKVTIVTGANTGVGREIAQVLYSKNATVWVAARNEKKGLDAIEGIKKQHPASKGSIKFLKLDLADLTTIGPSAKEFLAQETKLDILFNNAGVMTPPEGSKTEQGYELQLGVNCLGHFLFTKHLTPLLQSTAKSAPKNSVRVIWVSSSAADVLSPKNGFERDNLDYHQPRNLMHKYATSKAGNYYHNTEFARKYKNDGIVSVSLNPGNLASELDRTSPWYMYYPRMFTTYPSINGAYTELFAAFSEEITTENSGIWVVPWGRFMPIRPDVQKGALPESEGGTGMAEFFWNWSEEQIKPYFST

SEQ ID NO: 16672 - protein, 397 aa, Magnetospirillum magnetotacticum
MIVIEEGLPTPLGAHFDGRGVNFALFSQNATRVDLCLFEPGARHEHRTIRLPCRTDDVFHGYLHGLLPGQLYGYRVFGPWDPAAGHRFNPSKLVLDPYAREIAGRIRWHDALYGHRRGGAREDQIDRRDSAPFLPRGVVTRPETPDPIALPASRPLHETVIYEAHVKALTMTHPALSDAERGTYLGLAHPAIIEHLLKLGVTALELLPIQAFADDRFLVEKGLVNFWGYQPYNYFAPEPRYLGDGDASGLRFAIRELAAAGIETLLDVVYNHTAEGDHLGPTLSFRGIDNASYYKLDPDDPRRTVDCTGCGNTLNVAHPRVMRMVLDSLRHWVTAYGVAGFRFDLASSLGRAPLDFSPQAAFFQAVQQDPVLSRVKLIAEPWDIGMGGYRLGGYLNA

SEQ ID NO: 16673 - protein, 234 aa, Glycine max
MAATIITTCKLSLLLSLLSVSLLLGVRSDTLQNVGAIPPTCKRIECPSYDVIHVGNGYEIRRYNSPVWISNSPIQDISLVEATRTGFRRLFDYIQGKNNYKQKIEMTAPVISEVLPSDGPFCESSFVVSFYVPKENQANPPPAKGLQVQRWKTVFVAVRQFGGFVKDSSVGEEAAALKASIAGTKWADAVEKSQKRAGHASVYTVAQYNAPFEYDNRVNEIWFLFDIENELQTV

SEQ ID NO: 16674 - protein, 391 aa, Saccharomyces cerevisiae
MSAAADRLNLTSGHLNAGRKRSSSSVSLKAAEKPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDSHVRAISCLKGFEVGAKGVQLLSSYITEELGIQCGALSGANIATEVAQEHWSETTVAYHIPKDFRGEGKDVDHKVLKALFHRPYFHVSVIEDVAGISICGALKNVVALGCGFVEGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 16675 - protein, 144 aa, Dehalococcoides ethenogenes
MERITLALVAHDNKKQEIVDLVKKHETDLAGLNLVATRTTGKLIQASTDLNVNLLQSGPLGGDQQIGAMVASGVVTAIIFLRDPLTAQPHEPDISALMRVCDVHNVPLATNVSTAEAVLHLIFEHPEELKEHRLKSQLLNSLNS

SEQ ID NO: 16676 - protein, 629 aa, Poa pratensis
MARLRPFAGGAGSVAAVVVVFTGWLLAAGGVSAGDPPLSPKGLNYEVAALMAVKSRMRDEKGVMAGRDINSVDPCTWSMVTCSADQFVVSLQVANNGLSGALSPSIGNLSYLQTMLLQNNRISGDIPPEVGKLAKLKALDLSGNQFVGEIPNSLGQLTQLNYLRLDRNNLSGQIPVNVASLPGLTFLDISFNNLSGPVPKIYAHDYSLVGNKFLCNSSILHGCTDVKGGTHDTTSRPSAKAKNHHQLALAISLSVTCAIIFVLLFVCWLSYCRWRLPFASADQDLEMELGHLKHFSFHELQSATDNFNSKNILGQGGFGVVYRGCLRNGTLVAVKRLKDPDVTGEVQFQTEVELIGLAVHRNLLRLYGFCMTSKERLLVYPYMPNGSVADRLREYRHGKPSLDWSKRMRIAIGAARGLLYLHEQCNPKIIHRDVKAANILLDESFEAVVGDFGLAKLLDRQDSHVTTAVRGTIGHIAPEYLSTGQSSEKTDVYGFGILLLELITGPKTLSNGHGQSQKGMILDWVRELKEEKKLDKLVDRDLKDLFDIAELECSVDVIIQCTLTNPILRPKMSEVLQALESNVTLAENGIDLNREALPYGGSCSFSVRHEDPHDSSSFIIEPIELSGPR

SEQ ID NO: 16677 - protein, 413 aa, Arabidopsis thaliana
MGLGASVLTKTLTFAAAFSAFGDPIPWLIALAFFFARGFIKTGLGNRVAYQFVRLFGSSSLGLGYSLVFSEALLAPAIPSVSARAGGIFLPLVKSLCVACGSNVGDGTEHRLGSWLMLTCFQTSVISSSMFLTAMAANPLSANLAFNTIKQTIGWTDWAKAAIVPGLVSLIVVPFLLYLIYPPTVKSSPDAPKLAQEKLDKMGPMSKNELIMAATLFLTVGLWIFGAKLGVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVHAFLSNLMGGLTHYGIGSAPIFYGANYVPLAKWWGYGFLISIVNILIWLGVGGAWWKFIGLW

SEQ ID NO: 16678 - protein, 629 aa, Poa pratensis
MARLRPFAGGAGSVAAAVVVFTGWLLATGGVSAGDPPLSPKGLNYEVAALMAVKSRMRDEKGVMAGWDINSVDPCTWSMVTCSADQFVVSLQMANNGLAGALSPSIGNLSYLQTMLLQNNRISGDIPPEVGKLAKLKALDLSGNQFLGEIPNSLGQLTQLNYLRLDRNNLSGQIPINVASLPGLTFLDISFNNLSGPVPKIHAHDYSLVGNKFLCNSSVLHGCTDVKGGTHDTTSRPLAKAKNHHQLALAISLSVTCAIIFVLFFVFWLSYCRWRLPFASADQDLEMELGHLKHFSFHELQNATDNFNSKNILGQGGFGVVYRGCLRNGTLVAVKRLKDPDVTGEVQFQTEVELIGLAVHRNLLPLYGFCMTSKERLLVYPYMPNGSVADRLREYHHGKPSLDWSKRMRIAIGAARGLLYLHEQCNPKIIHRDVKAANILLDEGFEAVVGDFGLAKLLDRQDSHVTTAVRGTIGHIAPEYLSTGQSSEKTDVYGFGILLLELITGPKTLSNGHGQSQKGMILDWVRELKEEKKLDKLVDRDLKDLFDIAELECSVDVIIQCTLTSPILRPKMSEVLQALESNVMLAENGVDLNREALPYGGSCSFSVRHEDPHDSSSFIIEPIELSGPR

SEQ ID NO: 16679 - protein, 112 aa, Arabidopsis thaliana
  misc_feature (14)..(14): Xaa can be any naturally occurring amino acid
MASLTASAYSVCAXRPALLLKPTVAIYAPVLGSPPTLTKEGGVRCSMETKHGIVLVMAAGVSAAATAASTAAMTNPATALVDERMSTDGTGLPFGLSDNLLGWILAGVFGRI

SEQ ID NO: 16680 - protein, 294 aa, Symbiobacterium thermophilum
MAFRRIAVIYNPASGRPREREEPLARLAAPLRAAGCEVAICPTARPGHATEIAQARAGEGYDLILAHGGDGTMNEALQGVMGTGAALGFWPGGTANVLAAELHLPHRPEEMARRIRDGRTAEVTVGRANDRYFLLMAGVGLDAAVAGSVDPELKRRFGKAAFFVAAMQFIWRWELAPFVVHLDGEPPVEGRFVVAGNARSYGGGFQFTPDASLTDPDLDVCIFTAEAVGDYLRYVSAALVGLHRNLPGVIYRKARRVSITAAAEHAPLTQVDGEVIGSLPVTLESIPRALRLLV

SEQ ID NO: 16681 - protein, 401 aa, Magnaporthe grisea
MSTNDIKLPEPFASIPRETFLFGPSPIQHLERISEALGGKVNVYAKRDDCNSGLAYGGNKTRKLEYLAAEAKAQGADTLVSIGGVQSNHTRQVAAVSTKLGLKAVLVQEHWVPDWSDPVYGKVGNIQLSRLMGADVKLDPSGFGIEHKNSLAAAVAELQSQGRRPYAIPAGASDHPLGGLGFARWAFEVEEQERQMGVFFDTVIVCAVTGSTMAGMVAGFKLAQKKCGSKPRRVIGIDASATVPQTKEQVLRIAQVTGRKIGLEDGVDNVTTEDVELDDRYHAGIYGVPDQQTKDAIRFGASTEAFITDPVYEGKSLAGMMDMIRKGEIKPGSNVLYAHLGGQLALNAYSDIFIVHRRQSSLGNPMANPWPKHAMHLAEYSPANTWWWSKATMCGCKKHTL

SEQ ID NO: 16682 - protein, 431 aa, Unknown
  Thermotoga sp. RQ2
MQMFCYQCSQTAKGVGCTEYGVCGKSPTVARLQDNLVFAIKGISAYYYHARELGYDBPEIAGFLDEALYSTLTNVNFDAQSFVEYALEAGRMNLKAMQLLKKAHIETYGEPTPVEVETGTKKGKGIIVTGHNLKALEELLKQVEGTNVYVYTHSEMLPAHGYPGLRKYKNLVGNLGKAWYDQRKLFAVYSVAILGTSNCVLIPSESYRDRMFTTSIARLPGVKHIDGYDYTEVIEKAKSLPDLEEKPGSYKLRTGFSTSVVVSLADKIKELVEAGKIKHFLVVGGCDVPFKRNEYYREFVQKLPKETVVITLACGKFRINDLDLGDIEGIPRLIDVGQCNDTIVAIEIAQALAKVFGVEVTELPLTLVLTWMEQKAVAILWTLLALGLKNIYVGPVLPAWVNEDILKVLTAEFGLKTISEPEKDIKEILKV

SEQ ID NO: 16683 - protein, 240 aa, Thermus thermophilus
MGRVYLVGAGPGDPELLTLKAYRLLKEAPVVLYDRLVDERVLALTPGEKVYVGKEEGESEKQEEIHRLLLRHARAHPFVVRLKGGDPMVFGRGGEEVLFLLRHGVPVEVVPGVTSLLASGLPLTHRGLAHGFAAVSGVLEGGGYPDLRPFARVPTLVVLMGVGRRVWIAKELLRLGRNPREPTLFVERASTPKERRVLAALEEVAEGKVEVRPPALWILGEVVRVFAEKEAPVDALALGG

SEQ ID NO: 16684 - protein, 108 aa, Prochlorococcus marinus
MPEYNIKVQFEQKTFSFLCSEDQDIISAAKMNGIDLPSSCCSGVCTDCASMILEGSVDQEDAMGLNDDLREKGFALLCVAYPKSDLNIVIGKEVEDDLYNDQFGKYQK

SEQ ID NO: 16685 - protein, 586 aa, Coccidioides immitis
MGVEHKQGSGMIADAEAMRVASWDEGLQKQPEGSFAQRIINSFKRDPNAYISQPISSNTEGFDAEGAAAATAASPLKRRLKSRHLQMIAIGGSIGTGLFVGSGRSLATGGPASVVIAFCLIGIMLYATIHALGELAVMYPVAGAFAHYSTRFLDPAWGFAMGWNYAILWLTLLPLEIVAAAITVGYWEADVSPAAWVAMFYVLIVVINLFGVLGYGEAEFVFSIIKVIAVIGFIILGIVLNCGGGPNGDYIGGRFWHNPGAFNNGFKGLCSVFVTAAFTFGGGELVGLAAAETANPRKSIPTAVKQVFWRIVLFYIVSMVIVGLLVPYTDERLLNGSSTDVKASPFVIAISDAGIKGLDSVMNAVILISVLSVGNAAIYGSSRTLTALAEQHQAPALLAYIDRKGRPLMSILVASCFGLLGFLAATPKQQEAFTWMLAISGLSSVFTWASICLAHIRFRRGWKIQGHSLDELPFRAQGGVITSWIGFIINCIVLVAQFWTGFAPIGYGELSHSERVKTWFSTYLAAPIVLTFYITYKLWYRTSIVHAKDMDLTTGRRDLNLQHLIAEEKAERESWPKWKRVYKAFC

SEQ ID NO: 16686 - protein, 418 aa, Xylella fastidiosa
MSHIRHLAQQCRDAARILATLSTDAKRRLLETMATALNTDAATILAANAADLDAARTQQVGTAMLDRLALDPQRLAAMADALRDIAALPDPVGQVTRDDRRPNGIHIQKIRVPLGVIAMIYEARPNVTADAAALCIKAGNGIILRGGSEAIRSNIAIATALQRALRLASLPETALILVQDMARHTMLELLQLSDLIDLVIPRGGEGLIRFVAEHARIPVIKHYKGVCHQFVDASADIKMAIRLLIDGKTTRPAACNALETLLVHTDIAPRFLPAAAAALRPYGVQLRGDHATCTLLPDVLLATDADYAAEYLDLILAIRIVPNLDAALEHIRRYGSDHTEVIVTADPAHADTFVQQLHSAVVMVNASSRFSDGGALGLGAEIGISTTRLHAYGPMGLDALTVERFVVRGQGQVRHCPP

SEQ ID NO: 16687 - protein, 509 aa, Xylella fastidiosa
MFNTHHSEHELLRYLRMLADKDLAMDRTMIPLGSCTMKLNATAEMIPVTWQEFACIHPLAPVVQWSGYRQLIDELEAMLAECTGYDAISLQPNSGAQGEYAGLLAIRAYHRSRGEERRNVCLIPESAHGTNPASAQLCGMQVVIIKCDRSGNVDVDDLRMKAEKYSDTLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRSLEKVSGVSAEDIAKRLIDFGFHAPTLSFPVAGTLMVEPTESESQQELDRFVDAMIQIRGEIAAIEKGHLDPEDNPLKQAPHTAVQVMASQWGHAYSRELAAFPLGVLHHAKYWPPVARVDNVYGDKHVMCACIPVEAYKEKGDSEIQDLIEEDASRC

SEQ ID NO: 16688 - protein, 506 aa, Coccidioides immitis
MTGNIVDHAFKMFIGGLNWETTDQSLKDYFSQFGEVQECTVMRDGATGRSRGFGFLTFKDPKTVNTVMVKEHYLDGKIIDPKRAIPRDEQERTSKIFVGGVSQDANEQDFKKFFMQFGRVVDATLMIDKDTGRPRGFGFVTFDSEAAVEACLSQPLEILGKPIEVKKAQPRGNLRDEDDRRLRARGFQGDRFKDEKSGSTDVSQQGAQGQTNLANTMTPQMMAQYWQRMQQYFAMMQQQMALAAAQGQGMAGAAAMGGMNPAMAQQMQQLKQMQQMNPMAGGQPQGAAMNQPAQGAVPQGMQGMMNPMMMQQMQQMQQMQQLQQMQQMQNQPQGGPGYGGPGMGGQMSGAKPGNMNQGMTSGPGAMGGGNFSGPRGGPGYNAQEQLAFEQQKYEQQQQVRRVIDPRNYGGYQQGTTGNWDNGYEEQPNIPTGPQAGMGRGQPAGRGGMSPSPGLAPKQPQKIPTPQPQSSPPANAPTGPRNAGKPGANYRGGGRGVHRGFHPYARG

SEQ ID NO: 16689 - protein, 297 aa, Streptomyces lividans
MDLTGRRAVVTGGASGLGAETVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFDFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDVQPGGVAAHALDPEAADRLWEYGADTLSAG

SEQ ID NO: 16690 - protein, 456 aa, Triticum aestivum
STRTTRPGSPTPSSLSTPRRTGSASSPARRSSSPTWSRSASPPPSPRSSPTKTPTWPPRPPPSSPTSPTPTTPRTSPGCRPSPTRSSTPTRSTWFVHNLSRLSEVDPDEAEAVHHSLAVLENLIDLRPHLADLVCDRTKVLRWLLARVKARDFEANKQYASEILAILLQNSPANQKRLGQMNGVDGLLQAVAMYKSRDPRTTDEGEMLENLFDCLCCVLMPLGNKERFVKAEGVELMIIIMKQKKSAYSSAIRTLDFAMTRFPPACERFVDVLGLKTAFAAFMGKIPVNKKNKNESYQEELEERIISLVASLFGGITKGSRRIRLLGKFVENECEKIDRLMELYIRYSDRVKAETERFESLDLDDLEMDDDERYNRKLEAGLYTLQLVALILGHIWHSGNSQMRTRIELLLRQNKLTKDDVKEILQEYHDNIGDLDGPEEKEKAQGRTKEIIAALS

SEQ ID NO: 16691 - protein, 109 aa, Unknown
  Synechococcus sp. CC9605
MSDVATYTVRAEFEGETHSFSCRSDQTVLNAAEAAGITLPSSCCSGVCTTCAAVISEGSVEQPDAMGVKGELQQQGYSLLCVAFPRADLTLKAGQEDALYEAQFGQYQK

SEQ ID NO: 16692 - protein, 386 aa, Clostridium thermocellum
MAGKRDYYEILGVDRGASDAEIKKAYRKLAKQYHPDMNPGDKAAEAKFKEINEAYEVLSDPQKRARYDQFGHSAFDPNGFGGGGFGGGFTGGFGDFDFGGFGDIFEAFFGSGFGTRTSSARRGPQKGADLKYSMEVSFEEAAFGTEKEVTVSRLEICPTCSGSGTKPGHQPVTCRQCNGTGQVQYKQRTPFGQIVNVRTCDVCHGEGKIITNPCETCGGKGRVRKHTKLKVRIPAGIDNGETISLRGEGEHGIKGGPSGDLFITIKVKPHPIFKRHGNDVNCEIPITFTQAALGAEIEVPTLDGKEKIVIPEGTQTGTVFKLKGKGIPFLRSSGRGDQYVKVNIEVPRKLNEKQKEVLRQFAELVGDEVHEQRKGFFNKMKDALGM

SEQ ID NO: 16693 - protein, 659 aa, Hyphomonas neptunium
MTNEMNPSPADFASMFESSAAASAMQEGQVIPATVLRIDNDAVVVDIGLKTEGRIPTKEFMLEDKQPAPGDLIDVYLDRIENALGEAVLSRDKARREERWIKLEKSFSKGEPVKGAISGRVKGGFTVDLGGVNAFLPGSQVDIRPVRDVGPLMGEVQPFAVLKLDRVRGNIVVSRRAILEESRAEQRAEIVSDMAEGDVRKGIVKNITDYGAFVDLGGIDGLLHVTDMSYKRINHPSQVVEVGQEVEVQIIKINPETQRISLGMKQLGTDPWDNISSRYPVSARLKGTVTNITDYGAFVELEDGVEGLIHVSEMSWTKKNVHPGKILSTSQEVDVEVLDVDSEKRRISLGLKQTMDNPWSAFLAENPVGTEIEGEVRGITEFGLFVGLGPDLDGMVHINDIAWDKSGDQAIEAFTKGDRVKAKVLDVDVDKERISLGIKQLSGDPIESAVSSSGESAGGGGGGLKRGATVTCTVTEITSGGIEVEFGTPAVKSFIRRSDLSRDRADQRPERFAVGDKVDAKIITVDRATRRVSLSIKALEIAEEAEAVAQYGSADAGASLGDILGAALASSKGKPKAAADTDSLDDRGRLDAPQGEADDLKTLKGLGPAFEKKLNEAGVFHFWQIAALSDEQIADLEEELAIQGRFERDGWKDQADSLA

SEQ ID NO: 16694 - protein, 229 aa, Zea mays
  misc_feature (226)..(226): Xaa can be any naturally occurring amino acid
MARYFRSSNLASRIFDRQLISPLPGATVNTIRQFYENLVPSYTIYDIDCPDYSFRKFTDDGKYLVAFSRNHQDLIVYRPIWFTYSCNEECETHELPPKAKKFDSFFKQLYSIPLASSNEYICKDFFLYMECHRFGLFATSTAQSNESTATEGAIHGVPLIEKITFHLVRLEDGVILDEKAFCNDFINLAHSIGAYMYEDLLCIVSLRYQTIHILQIRDFRHLGEVXHIG

SEQ ID NO: 16695 - protein, 306 aa, Gibberella zeae
MASVNFSPDTDIPSLNGKVILITGGNSGLGLESTRQLLKHDPAKIFLACRSKAKYDQAIAELQEQGSKTDAVSFLSLNLASLESIKSAVRQFQQESTRLDVLLNNAGIMMTPEGLTEEGYEIQIGTNHMGHAFLTHLLLPVLEETTKINPDVRVICLASMGEAMAPKNPYQFEQFKTTMSNFSTSARYYISKLANVHYAAALAERHPSLKIISIHPGIVQTNLTGPAVSNSLIMGTLTRLFFSVVGVNSSKGALNQLWALSDPKAESGVFYHPVGVTGKGSKLSQNKDARESLWEWTEKEIKQHLS

SEQ ID NO: 16696 - protein, 636 aa, Rhodopseudomonas palustris
MAGKLRIRSRLRLLARRHPRITMAGRAVMAFSAGFGGAYGLLLGSNPETSGYDPHAFAVGASFLFALACLALAVQTMRLRRMRGRLRLLTASQEPPPDLQPNQSKTRALIAARESADAANHAKSRLLAMASHEIRTPLNGIIGMSRLLLDTPLSAEQATYAKAVKTSGEALLALTDELLDYARIEAGKIELDCRPFVLSSLIEDIIELLAPRAQARGLEIAADIDERLPVSLIVDAARLRQVLLNLCGNAIKFTETGGVALIVERGDQSGELRIIVRDTGIGIAPDAQARIFHEFEQADAGIARNFGGTGLGLSISDRIVAAMGGRIALESKPGEGSTFTITLPLSTAENDRATAAFAPPDLHGSSVMIVSAHGVEASLAARRLERWGAETCLCDDLAAAIARLPERSWHAVLIDHALGSDAIETLAREAQARATHRLVMLTPAARHELLPDLPAAFTGYLVKPLRSASLAARLGTAVEVATPSIADGDPPPVQDASSAITHEAFAILVAEDNDINALLIRALLHRLGHHAEIVGDGRRAVEAWGAADNTGTPFDLVLMDVQMPILDGLAAARQIRTLEAERARSRVPILALTANTLAEDREACLESGMDGFLVKPIDPDRLAAILAGVAAAHQAA

SEQ ID NO: 16697 - protein, 398 aa, Oryza sativa
MGDLSAADPPPVSAIGFEGYEKRLEITFSEAPVFADPDGRGLRALSRAQIDSVLDLARCTIVSELSNKDFDSYVLLSPACLSILIKIVIKTCGTTKLLLTIPRILELAEGLSMPLAAVKYSRGMFIFPSAQPAPLRSFSEEVAVLNRYFGHLKSGGNAYVIGDPAKPGQKWHIYYATQHPEQPMVTLEMCMTGLDKEKASVFFKTSADGHTSCAKEMTKLSGISDIIPEMEICDFDFEPCGYSMNAIHGSAFSTIHVTPEDGFSYASYEVVGFDASTLAYGDLVKRVLRCFGPSEFSVAVTIFGGHGHAGTWAKELNADAYKCNNMVEQELPCGGLLIYQSFDATEDVPVAVGSPKSVLHCFEAENMVNPAPVKEGKLGNLLPWGEDALEENDGVFDE

SEQ ID NO: 16698 - protein, 380 aa, Bartonella quintana
MKVDYYEILGVTRECDDKKLKSAFRKLAMQYHPDRNAGDKEAERRFKEIGEAYEVLKDPQKRAAYDRFGHAAFENNNQGGGNPFGGFAAGGFSDIFEDFFGEIMGGGHRKRSDGRERGADLSYNMEVTLEEAFSGKTAQINIPSSIVCDSCEGSGAKKGSKPQICGTCHGAGRVRAAQGFFSIERTCHACNGRGEVITDPCPKCQGTRRVEKNRSLSVNIPAGIEDGTRIRLSGEGDAGIRGGPNGDLYIFLSVKPHEFFQREGADLHCRIPLSMVTAALGGEFEVSDLDGIKARVKIPEGTQNGRQFRLKGKGMPMLRRQQVRGDLYIHITIETPQKLTQEQRELLQKFEKLSNHENSPQSHGFFSRMKEFFENISGQN

SEQ ID NO: 16699 - protein, 556 aa, Zymobacter palmae
MYTVGMYLAERLAQIGLKHHFAVAGDYNLVLLDQLLLNKDMEQVYCCNELNCGFSAEGYARARGAAAAIVTFSVGAISAMNAIGGAYAENLPVILISGSPNTNDYGTGHILHHTIGTTDYNYQLEMVKHVTCARESIVSAEEAPAKIDHVIRTALRERKPAYLEIACNVAGAECVRPGPINSLLRELEVDQTSVTAAVDAAVEWLQDRQNVVMLVGSKLRAAAAEKQAVALADRLGCAVTIMAAEKGFFPEDHPNFRGLYWGEVSSEGAQELVENADAILCLAPVFNDYATVGWNSWPKGDNVMVMDTDRVTFAGQSFEGLSLSTFAAALAEKAPSRPATTQGTQAPVLGIEAAEPNAPLTNDEMTRQIQSLITSDTTLTAETGDSWFNASRMPIPGGARVELEMQWGHIGWSVPSAFGNAVGSPERRHIMMVGDGSFQLTAQEVAQMIRYEIPVIIFLINNRGYVIEIAIHDGPYNYIKNWNYAGLIDVFNDEDGHGLGLKASTGAELEGAIKKALDNRRGPTLIECNIAQDDCTETLIAWGKRVAATNSRKPQA

SEQ ID NO: 16700 - protein, 410 aa, Alkaliphilus metalliredigenes
MSNPFQTALSTLKAASEVAGLEPNVVKMLSQPKRIFEFTIPMKMDNGDLEIFTAYRVHYNDALGQTKNGIRFVPNLDLDTVKALGFWMTVKHAVSGIPAGGGKGGIRVDPKKLSEGELERLTRSYIRKLPMKGAWVDIPGADIGTSAKTQGWMLDEYEEIMGFHSPAAINDKPAELNGTVGSMEATGTGAFFVTMEAVKDLSIPKGSTVVIQGFGNVGRIAGRLLHQEGYVVIAVSDISGGIYNPQGLDVEKLEAYVDETGSIKDFPGTTVVSNEALLQLECDILMPSAVQSVITEQNAHNIKTKLIMECANGPTTPAGEAILEKRGIIIVPDVLTNSGSAIVCSFERTQGLTDTYWDIETVNSKLKERIVKAYKETTTTAKDKNTSLRNAAWVNGLTKVAKAMKARGWV

SEQ ID NO: 16701 - protein, 550 aa, Parvularcula bermudensis
MKASDLLVKCLENEGLKYIFGVPGEENADFMISLEGSSITFVMTRHEQGAAFMAEAYGRLTGEPAGCLSTLGPGATNLITGVADSNMDRAPMIVLTGQGATGRQHKESHQVMDVVRMFDPVTKWAHQIVDADTIPEIVRKAFRLAKEEKPGAVLIELPEDVAKRDATTAPLNVIRVRRPSIDDKTADYLYDELIKAKRPVILAGNGAIRRRASKQLRQFCEATGIGCLSTFMAKGAVDRHAPYSLFTLGLGSRDFVADAIDGADLVLVIGYDMVEYHPKLWNPWADKKVVHIDFIPAEVDRFYAPCLECVGDIAHTLWALNERIKTRGLPTYDLGYQANVRQRMIADFEAHKDDVGEGPIRPQKALWDLREVMGPEDVVLSGVGAHKMWTARYYQCDEPNTCLIPNGFCSMGQPLPGAVGARLSLPPERKIFGVVGDGDFMMNVQELETARRLNADINLMVWVDDGYGLIAWKQENEFHKHTDLSFGNPDWMKLAEAFDWHGQWVERPEDLKAALMAALNHQGPSFVALPIDYRENRKLTERLGEIEVQL

SEQ ID NO: 16702 - protein, 186 aa, Triticum aestivum
MEDGRALRRMSIPTRRSRSADFHNFSERRRRDKINEKLKALQELLPNCTKTDKVSMLDEAIDYLKSLQLQLQMLVMGKGMAPVVPPELQQYMHYITTDPAAQLMQMPPSEPPRPFQITHANPPQRESDFLSQMQNHLHPSDQPQINFLRPPKLQLYTPEQRGVVGSSSGHNGGWIPERNSSYNFME

SEQ ID NO: 16703 - protein, 353 aa, Solanum hindsianum
DAWDTSVAIEVKVGDSIEIVRFFHCYKRGVDRVFVDHPMFLEKVWGKTGSKIYGPKAGQDYLDNELRFSLFCQAALEAPRVLNLNCSKYFSGPYGEDVLFIANDWHTALIPCYLKSMYKSRGIYLNAKVAFCIHNIAYQGRFAFSDFPLLDLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16704 - protein, 177 aa, Photobacterium phosphoreum
MKHTIEVMISEQDVQERIKELGKQITEHYKDSTDLVMVGLLRGSFVFMADLARAIDIPHEVDFMTASSYGNTMHSSRDVRILKDLDDDIKGKDVLLVEDIIDTGNTLSKVCEILSLRGPKSISICTLLDKPERREVDVKVDWYGFIIPDEFVVGVGIDYAQKYRHLPFIGKVIPDAE

SEQ ID NO: 16705 - protein, 834 aa, Debaryomyces hansenii
MVNLSSSKFHITEPADEDIQLTLVNGNQKGHEDSCNRSSTPKFGSISRFFFNKEQSVSSDVSNADSTVSSNTDSLNHNHGSKSGVTNSEAREDEHDDAKQQPGLSKLKSFLRLSSNSLLLSNNGPNDNGEQNGPKGTDVITPNAESVTPVRSNEEKTKLKHESDRNEEGHNGNKDGSNVSTKQEASAGMMKKFMLGRKRSVSSPTSPATGNRKPQQSNLLINTESPKDIPEIITENTESPVISSNLYFAHQGLPPHMNNHNKNNHTLAASAANEDDISVALRHNDSVFSLNDGGPLKPPNVYQSKLSASDESGSEHEPIPEHTTESGLKTPEESTLQNKNKLEVPPHTLPHPGQASPFQKTLRRVASAPLVHRLLNDSNTRLPQTRAYVSNDDDFDITEHIGELKSGRPRTLSRGRMYSSASTKIMDAQVNQNSFKKIRLLGKGDVGKVYLVKENLSNRLYAMKILSKKEMIERNKIKRALAEQDILATSNHPFIVTLYHSFQSNDYLYLCMEYCMGGEFFRALQTRETKTISETDAKFYAAEVTAALEYLHLMGFIYRDLKPENILLHQSGHIMLSDFDLSKQSESTKNPEIFFSKTSHGLSSSNNHNGPTLDTKACIDGFRTNSFVGTEEYIAPEVIRGKGHTSAVDWWTLGIFIYEMLFGTTPFKGRDRKKTFGNVLKKEVKFLETRSISSSCKSLIKKLLIKDEAKRLGSKTGASDIKNHAFFKNTQWALLRHQKPPMIPVLSKNKRADKVERYDSEEDQITDSTTDVSENKDILNDPFANFSSVTLHYNELDSGDDQMVYNEADNTVYTSVAYTMTNDSSPKPKHFLKR

SEQ ID NO: 16706 - protein, 353 aa, Solanum hirtum
DAWDTSVAIEVQVGDSIEIVRFFHCYKRGVDRVFVDHPMFLEKVWGKTGSKIYGPKAGQDYLDNELRFSLLCQAALEAPRVLNLNCSKFFSGPYGEDVLFIANDWHTALIPCYLKSMYQSREIYLNAKVAFCIHNIAYQGRFAFSDFPLLNLPDEFRGSFDFIDGHEAPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLIPSR

SEQ ID NO: 16707 - protein, 304 aa, Bacillus licheniformis
MKRARIIYNPTSGREIFKKNLAQVLQKFEQAGYETSCHATTGEGDAVQAARHAAEREFDLIVAAGGDGTLNEVINGLAPLEHRPKLGVIPVGTTNDFARALGIPREDILKAVDTILEGEARPIDIGRVNGQYFINIAGGGRLTELTYDVPSKLKTMLGHLAYYLKGMEMLLPSLRPTEVEIEYDGKLFEGEVMLFLVMLTNSVGGFEKLAPDSSLNDGMFDLVILKRANLAEFIRLVGLALRGEHINDEHIIYTKANRVKVTVKDKMLLNLDGEYGGELPGEFENLYRHIDVVMSKEKARKLDD

SEQ ID NO: 16708 - protein, 453 aa, Flaveria bidentis
MAVVKLSPWANYSSSKSEIKSSSSSSSSKSSLSAYVINVSSSPRLSFYNPYPRRLHHQRLSSPASIRCSVTSSDQIQAPLPAKQKPECFGVFCLTYDLKAEEETKSWKKIINVAVSGAAGMISNHLLFKLASGEVFGPDQPISLKLLGSERSFAALEGVAMELEDSLYPLLRQVSIGIDPYEIFQDAEWALLIGAKPRGPGMERADLLDINGQIFAEQGKALNAVASPNVKVMVVGNPCNTNALICLKNAPNIPPKNFHALTRLDENRAKCQLALKAGVFYDKVSNVTIWGNHSTTQVPDFLNAKIHGIPVTEVIRDRKWLEDEFTNMVQTRGGVLIKKWGRSSAASTAVSIVDAIRSLVTPTPEGDWFSTGVYTNGNPYGIAEDIVFSMPCRSKGDGDYEFVKDVIFDDYLSKKIKKSEDELLAEKKCVAHLTGEGIAVCDLPEDTMLPGEM

SEQ ID NO: 16709 - protein, 223 aa, Glycine max
MGRRPARCYRQIKNKPYPKSRFCRGVPDPKIRIYDVGMKKKGVDEFPFCVHLVSWEKENVSSEALEAARIACNKYMAKFAGKDAFHLRVRVHPFHVLRINKMLSCAGADRLQTGMRGAFGKPQGTCARVAIGQVLLSVRCKDSNSHHAQEALRRAKFKFPGRQKIIVSRKWGFTKFSRADYLKYKSESRIVPDGVNAKLLGCHGPLANRQPGQAFLSSATATA

SEQ ID NO: 16710 - protein, 159 aa, Enterococcus faecalis
MSIEVGAKLPGKVSGITNFGAFIDLGEGKTGLVHISEVSNGFVKDIHDVLTVGDEVTVKVTSVGDDGKIGLSIRKAQEPAEGQQPKREFQRRENNYENRDRNPRAGGKKPFNKPQANNNNNKQDFDSLMSSFLKDSDDRLSSLKRNTEGKRGGRGGRRG

SEQ ID NO: 16711 - protein, 373 aa, Solanum tuberosum
MPSRISDSCRPHHSQKHFDLNSIKELPESHAWTSSNDHYTQENSCNFESIPVIDLDNNNNNNNNNILDHIGHACKKWGAFQIINHSISEKLLQDIEVAGKTLFSLPMQQKLKAARSPDGVTGYGAARISSFFSKLMWFEGFTIVGSPIEHARQLWLKDYNKFCEVIEEYEKEMEKLAGRLMWLILGSLGITKDDVKWAVGPKGETKEGCAALQLNSYPACPDPGRAMGLAAHTDSTILTILHQNNTSGLQVYQEGNGWITVPPIPGALVVNIGDLLHILSNGSYPSVLHRAVVNRTRYRLSVAYLYGPPSGVRVSPLSKLVDHRHPPLYRAVTWSEYLGTKAKYFDKALSSVRLCVPLNGFTDAKDHKGVQVG

SEQ ID NO: 16712 - protein, 564 aa, Unknown
  delta proteobacterium MLMS-1
MFCYQCEQTAKGEGCKTIGVCGKKPEVAALQDLLIYALQGLSLVAVAGRKVGVNDEEVNLFTCEAVFSTLTNVDFDPERFVALIKRTVSLREALLPKVQAAGGQVDSSVAAVTFTPAADQAEMVKQGEEIDMKNSADDDADIQSLKHILLFGLKGVAAYADHAKILGQEDDQVYAFIQEGLVNLLRRDMGLQDWVGLVLKCGEINLRAMELLDAGNTGSYGHPVPTEVPLGAKAGKAILVSGHDLKDLEMLLKQTEGKGINIYTHGEMLPAHGYPELKKYPHFYGHYGTAWQNQHKEFGEFPGAILMTTNCIQKPQESYKGNIFTTGLVGWPAVAHVDDHGCPSLLDKVKSAVGLNYAGQGKDFTPVIKKAQELPGFAADNDKGKVMVGFGRNAVMGVADKVIEAVKGKDIRHFFLVAGCDGAKPGRNYYTEFVEKVPSDCVVLTLACGKFRFFDKDLGDIGGIPRLLDVGQCNDAYSAIQIAVALSQAFECGVNDLPLSLVLSWYEQKAVAILLTLLHLGIKDIRLGPSLPAFVTPNVLNVLVENFDIKPISTPDEDLKAILG

SEQ ID NO: 16713 - protein, 181 aa, Enterococcus faecalis
MIEKDIEKVLISKEEILAKSAELGKQLTEEYQGKNPLVVGILKGAVPFMADLTREINTYLELDFMDVSSYGNATVSSGEVKIVKDLDTNVEGRHILIVEDIIDSGRTLAYLVDLFRYRKAASVKIVTLLDKPEGRVVDIKADYVGFDVPNEFVVGYGLDYAETYRNLPYIGVLKPEVYESN

SEQ ID NO: 16714 - protein, 281 aa, Saccharomyces cerevisiae
MSNHSEILERPETPYDITYRVGVAENKNSKFRRTMEDVHTYVKNFASRLDWGYFAVFDGHAGIQASKWCGKHLHTIIEQNILADETRDVRDVLNDSFLAIDEEINTKLVGNSGCTAAVCVLRWELPDSVSDDSMDLAQHQRKLYTANVGDSRIVLFRNGNSIRLTYDHKASDTLEMQRVEQAGGLIMKSRVNGMLAVTRSLGDKFFDSLVVGSPFTTSVEITSEDKFLILACDGLWDVIDDQDACELIKDITEPNEAAKVLVRYALENGTTDNVTVMVVFL

SEQ ID NO: 16715 - protein, 323 aa, Unknown
  Bradyrhizobium sp. BTAi1
MQLGIVGLGRIGGNIVRRVLRTGHACVAYDRDPKLSQRLSAEGAFAAQSLKDLVAIMERPRHVWLTLPAGEATDDTLHQLSPMLDAGDVLIDGGNSFYKDDIRRARELAAMGLHYVDVGTSGGIERGYCLMIGGEKEIVDRLDPIFSVLATGNRNIPCTPGREGRDARVERGYIHAGPSGAGHFVKMVHSGIEYGLMQAYAEGFEILKQAIAEELAAELRFDFDLADVAEVWRRGSVISSWLLDLTASALAADPKLSNFEGYVMDSGEGRRAVSAALEEAVPIPVLSAAQYARFGSRQQHSFANKLLSAMRNGFGGYQEPARG

SEQ ID NO: 16716 - protein, 452 aa, Deinococcus radiodurans
  misc_feature (277)..(277): Xaa can be any naturally occurring amino acid
MTASSPVTRSSIQDLKQHIGQSVEVLAWLQDKSGKGKIQFLKLRDGSGFVQGTVFKGDVAEDVFEAAKRLTQEQAVRVTGEVRADERAPGGVELSVRDLSVISENVGEYPITPKEHGIEFLMDHRHLWLRHRRPWAIMRVRDCVQRGIVEFFHGEGFVRFDAPFFTPNAAEGTTELFEIDLFGEDKAYLSQTGQLHAEAGAFALRQGLHFGPTFRAEKSKTRRHLLEFWMVEPEVAPSSHAENMALQERMVSHLARKVLSECAAELEMLGRDVSKLXGAAEGNYPRVTYTEALEIIRQHIEDKDLPPNVQEDVQPVEWGDDLGAPHETILGHHFDRPVMVEKYPAAIKAFYMQPDPEDPRVALCDDMIAPEGYGEIIGGSERIHDYELLKSRIEEQGLPLEAFDWYLDLRRVGSMPHAGYGMGLERFIAWMTGIDHIREAIPFPRMLTRMKP

SEQ ID NO: 16717 - protein, 269 aa, Unknown
  Synechocystis sp. PCC 6803
MPVVSLADLLESGVHFGHQTRRWNPRMDQYIYTARNGVHIIDLVQTAQLMEDAYEYVRSSTINGKKFLFVGTKRQAAGIISQEAQRCGAHYVNQRWLGGMLTNWETIRKRVDRLKELEALEASGGIDRRGKKEGSMLRRELGKLQKYLGGIKNMRKLPDVVVIVDQRREHNAIHECQKLGIPIIAMLDTNCDPDVVDVPIPANDDAIRSIKLIVGKLADAIYEGRHGQPDVSDDYEEFDEGLDGDNLEVEAAEEVEEAAEAEVAATPEA

SEQ ID NO: 16718 - protein, 263 aa, Unknown
  Oceanospirillum sp. MED92
MTVYFIGAGPGDPELMTLKGHRVLQECPVVLYAGSLIPREVLDAVEGKAEKIIDTATIDLDQITEHIVQAHKEGKDVARLQCGDPSLYGAIGEQIRRLEAEGIDYEVIPGVSAVAASAAYLKKELTLSGVSQTIIMTRYEGKTPFPERERLPQLAQSGATLAIHLGVTRIHKIVEELIPHYGEDCPVAVCYRSSWPDQDKVTGTLKDIVAKVREKGFTRTALILVGHVLDSDDFADSYLYDKDQAHVFRKKEHKAKIVKETTE

SEQ ID NO: 16719 - protein, 403 aa, Wolinella succinogenes
MRTLLAPSVHWVGVKDPELAIFDIVVPTEHGTTYNSYLIQGSEKCALIDTSKANFSKEYFTHLEKHLPLQKIDYIVVQHTEPDHAGCLREFLERHPEVTLIHSKPCKRFIQTLTNLPFNSMAIESGDELDLGGKTLRFFSTPFLHWPDTMMSYLVEDKILFSCDVMGSHFTSETNPEIFNSLLDEKDYLASIEAFKYYYAMIMRPYKEHIIKAFELLEKLDVQMIAPSHGPILDMEPRFFFDWYRARAKNYLLRLNGQKVTIIYASAYGNTAKMMESVKAGLLDAGVEVAVFDASSSAMAEMIDSIELSTGILLGTSTINAKAPEPILHLIANLVVLSMNGRKAGVFGSFGWSGEGIAMTERICEVMKMKIVQEPYKVQMAPSSAQLEEGREWGYNFGLKIIE

SEQ ID NO: 16720 - protein, 217 aa, Cryptococcus neoformans
MFTNSVHSKFFNLGQVIETHRGAGIFQEAIDRAVKLLQEGNWIHIFPEGKVNQQLTNPEGGLLRFKWGVGRIIMDSEIMPEIIPMWISGFDQIMPETRGFPRFVPRPGAHISITVGQPLTSQIQPLVKTWKDMASKEKGTLGIGGEWEQKVKGEGLAGQQQREVRDKGQLIHGREKEVRIKIVEALQEGMRKLGHDVERREGRFERGLWSHSTRQSV

SEQ ID NO: 16721 - protein, 312 aa, Mycobacterium avium
MAPHDKRHRDWSEADVGDQSGRVVVITGANTGIGYETAAVLAHRGAHVVLAVRDLEKGNAALSRIVAASPNADVTLQQLDLASLASVRSAAEALRAAYPRIDLLINNAGVMWTPKQVTEDGFELQFGTNHLGHFALTGLLLDHLLGVRDSRVVTVSSLGHRLRAAIHFDDLHWERRYDRVAAYGQSKLANLLFTYELQRRLAAAPDAKTIAVAAHPGGSNTELARHLPGIFRPVQAVLGPVLFQSPAMGALPTLRAATDPAVQGAQYYGPDGFLEQRGRPKLVESSAQSHDEQLQRRLWAVSEELTGVHFPV

SEQ ID NO: 16722 - protein, 321 aa, Bacillus anthracis
MNSVSEEKIYDVIIIGAGPAGMTAAVYTSRANLSTLMLERGIPGGQMANTEDVENYPGYESILGPDLSNKMFEHAKKFGAEYAYGDVKEVIDGKEYKTIIAGKKEYKARAIIVASGAEYKKIGVPGETELGGRGVSYCAVCDGAFFKGKELVVIGGGDSAVEEGVFLTRFASKVTIVHRRDTLRAQKILQDRAFQNEKVDFIWNHTIKEINEANGKVGSVTLVDVNSGEEKEVKTDGVFVYIGMLPLSKPFVELGITNENGYLETNERMETKVPGIFAAGDVREKMLRQIVTATGDGSIAAQSAQHYVEELLEELKTVSEK

SEQ ID NO: 16723 - protein, 525 aa, Unknown
  Shewanella sp. MR-7
MLDANLKNQLQTYLQNLKRPVELVVSADESRKSQELKSLANDIVSLSTLVSLKEAQGPRTPAMTVVNPELNTQISFAGLPMGHEFTSLVLALLHTGGHPIKLSDEIIEQIRNLPGKYEFETYVSLTCQNCPDVIQALNMMAAINPNITNVMIDGALFQDEVASRNIMAVPSVYLNGEAFAAGRISIGEILNKLDTGAASRKAEELSQKAPYEVLVVGGGPAGAAAAIYAARKGLRTGVVADKFGGQVAETVGIENFISVKATEGPKLVANLEAHVRDYEVDIMDNQKAVKLASDGLFELELASGAKLRSRTILLATGARWREMNVPGEKEYRGKGVAYCPHCDGPLFKGKRVAVIGGGNSGIEAAIDLANIVEHVTVLEFDSKLRADDVLQRKAASMGNIHIITEAMTTEVTGDGTRVNGLNYTDRATGESHHIALEGIFVQIGLVPNAEWLKGTVDLTPRGEIIVDERGQTSVPGVFAAGDVTNSPYKQIIIAMGSGANASLGAFDYLIRHSDDSTETTATKAA

SEQ ID NO: 16724 - protein, 130 aa, Cucumis sativus
GMMNNCWFTVKTNVCKPHKGEIGIIFEHPTVPGNQSGGWMDGERHLEISTESNQTLKKSISTPSMNTASNTYSLSEVKKHNSPQSAWIIVHGHVYDCTRFLKDHPGGSDSILINAGTDCTEEFDAIHSDK

SEQ ID NO: 16725 - protein, 237 aa, Coccidioides immitis
MYSQRPLSYAPTPYSYTPNPALSASINLDEEVKLSSTPAERDLYESLAEIYSIILTLDGLEKAYIKDAVTESHYTETCARLLKQYRSSLSDENVSNEFVDLDSFKRTWGLECPRATERLRIGLPATVEQPSHNPSQPPAAGPASGSLILAATENFITFLDALKLNMVSKDALHPLLSEVIQSVNKVTDEDFENRGKIIQWLITLNQMRATEELAEDQARELAFDIEQAYQGFKATLN

SEQ ID NO: 16726 - protein, 97 aa, Unknown
  Synechocystis sp. PCC 6803
MASYTVKLITPDGESSIECSDDTYILDAAEEAGLDLPYSCRAGACSTCAGKITAGSVDQSDQSFLDDDQIEAGYVLTCVAYPTSDCTIETHKEEDLY

SEQ ID NO: 16727 - protein, 332 aa, Unknown
  delta proteobacterium MLMS-1
MTVKSCFPQPDRSRLDSKPPPPEEIRDLVIIGGGPGGLTAGIYAMRAALDTVLVEKGLPGGQLNNTATVENWPGTETISGVELAEKMTAHAKANGLEIMAREVKEIEPGDDHHCVYLDNGEQIPTRAVIIGSGGQPRQLGVPGETENYGKGVSYCAVCDGFFFRDKTVVVVGGGDTAMEEALYLAKIATKVYLVHRRQEFRAGMILQKRVLAEEKIEVLLNGVVTEIKADGGGVTAAEVQNRESGEKVEITTDGVFVFIGFEPDNSLVPAGIRMNVDGYVITDEKCETCMQGIFVIGDLREKPIKQIVTAAADGCIAAQAAARLVEHRAAKR

SEQ ID NO: 16728 - protein, 213 aa, Thermus thermophilus
MSAAQPNPVYRASWHLARFLLRLLFHYRVEGAEKVPAEGPVILAANHLSILDPIVVGAGIRRPVSFMARADVFRLPFLSWLLPRLYAIPVERGSGDLSAVKGAIRALERGMAFGIFPEGTRSRTGKLQPFKTGVAAIALRTGSPVVPVAVVGTEEAWPVGKKLFRPCRPVRVIYGDPIPVPRKSKVSHRELEALTREIEARVRDLLPPRYWGS

SEQ ID NO: 16729 - protein, 254 aa, Brassica rapa
VTEAVLSGLGSSFLPGGKRSITALGSGVGTGAARFGRKTLIVAAAAAQPKKSWIPAVKGGGNFLDPEWLDGSLPGDFGFDPLGLGKDPAFLKWYREAELIHGRWAMAAVLGIFVGQAWSGVPWFEAGADPRAIAPFSFGSLLGTQLLLMGWVESKRWVDFFNPDSQSVEWATPWSRTAENFANYTGDQGYPGGRFFDPLGLAGKTRDGVYEPDREKLERLKLAEIKHSRLAMLAMLIFYFEAGQGKTPLGALGL

SEQ ID NO: 16730 - protein, 429 aa, Dunaliella bioculata
  misc_feature (147)..(147): Xaa can be any naturally occurring amino acid
MQLNLQKNVGVAQKQATVTPAFNVRGNVARKVQAGSNAAARRASSVVRAVDAPEKAAKQFGVFRLSYDVNNEDKEMMKNWKKTINVAVTGASGMIANHLLFMLASGEVYGKDQPIALQLLGSERSYEALEGVAMELEDSLYPLLREXSIGIDPYEIFAGADWALMVGAQPRGPGMERSDLIQKNGQIFQTQGRALNEVADRNCKVVVVGNPCCTNAFIAMENAPNLPRKNFHALTRLDENRAKSQLAMKAGKFYTSVSRVAVWGNHSTTQVPDFLNAKIGGLPAMNVIRDNQWFKDQFTPKVAMRGGALIKKWGRSSAASTAVSVADSIRSLITPTPPGDCFSSGVCSDGNLYGIQEGLNFSFPCRSKGDGDYEICNDFIIDDWLRMKIKAAEEELIQERDCVSHLIGREGGACAIGPNTPDTSVPGEK

SEQ ID NO: 16731 - protein, 155 aa, Pseudomonas fluorescens
MSDFPGDVLSEQATFGAGCFWGAEASFRALPGVLDTRVGFARSDLGDATLIEVVQVDFDPRLISYSRLVEHFWTLHDPTSVDRQGADVGAKYRSALFFNSAEQSRLALVARQQLDASGQLGKPVATVILPLGEFQKANEEHQRYLEKHGGSACSI

SEQ ID NO: 16732 - protein, 408 aa, Propionibacterium acnes
MAKTRPKVLSIVLAGGEGKRLMPLTMDRAKPAVPFGGTYRLIDFVLSNLANSGLTQIAVLTQYKSHSLDRHISITWRMSTMLGSYVTPVPAQQRLGPRWYQGSADAIYQSLNLINDQSPDYVVVFGADNIYRMDVDAMLQYHIDSGLGCTVAGIRVPRKDASAFGIIDADQNHKITEFLEKPADPPGLPDASDESFASMGNYIFSREALVQALHDDAHSADSRHDMGGDVIPRFVNAADAQVYDFRDNEVPGNTEKDADYWRDVGTIDAYHDAHMDLVSVEPEFNLYNPDWPIWTMQEQAPGAKFVMRGSCDDTLVSAGCIISGTDIYRTVLGPRARIERWARVDESIVMNNVAIGSNATVHRAILDKNVIVPDGAQVGVDHDHDRARGFTVSPGGVTVVGKGITVPY

SEQ ID NO: 16733 - protein, 174 aa, Unknown
  Rhodococcus sp. RHA1
MTLPAFHAPTPTDMRRSMGRFTTGVAVVSADDGDGSPSAMTISSLTSISLDPAILLVSLTHGSRTTEAVEAAGSFAVSVLGSRQEALARRFATRGGARFDDLPCDRSRSGLPLIKDALAQLECRVHSAHDIGDHRVFYGEVTDMRCREGTGLVFYSGRFGDFHDFGHDEVPWLF

SEQ ID NO: 16734 - protein, 327 aa, Pseudomonas fluorescens
MLFAISALASTLAAQATSRTEPKPDWSTQDMPSQNGRIVLVTGGTSGMGYEDALALTRAGAEVIIAARNAERGREAIANIRQAVPEARVQFETLDLANLQSVRDLANRLQGRLPRLDVLINNAAIMSPPVRGVSADGYEMQLATNYLGHFALTGLLMPLLRKSDDGRVVSLSSIAAGRAVLNFDDLQAERAYDPFTTYSQSKLAVLKWSIELQQRSDAAGWGIRSIAAHPGVAVTELIARGPGLDSEFGKQWAVERDMYHSAAQGALPTLYAATAPEAVGGAYYGPTGDNEKRGPLGFAKMPPAAADRSNSDALWQLSERLTGVTYR

SEQ ID NO: 16735 - protein, 497 aa, Xylella fastidiosa
MSEEILVNVTFGETRVAVVENGLLQELHIERDGCRGVVGNIYKGRVQRVMPGMQAAFVDVGMERTAFLHVNDVVRSAPADSSVIDTDETTVPPLSEIPIVELLRDGQELMVQVLKEPIGTKGARLTTQISIPSRYLVLLPQSKMVGVSLRIEDEAERARLKAVVTDLAAQYGDYGYIVRTNAEGQSADVLVEDIAYLSRLWGVVERRGRELPVCSLLYEDLSLSLRSVRDLIRKDVEKIKVDSKEAFAQLQGFVTKYMPVLADKLELYVGDHPIFDLYGVEDEIGRALDRQIPLKSGGYLVIEQTEAMTTVDVNTGSFVGKRTLEETVFRTNLEAAQALARQLRLRNLGGIIVIDFIDMQDAEHRCQVLRVLEKALIRDHAKTTLYDFSPLGLVEMTRKRTVESLQRQLSETCQECGGRGTIKTAETVTYEIFRDITRAVRQFDAVRLLVIASPNVVSRMTDEDSAAVAELEAVLGKAIRFQADPHYLQEQYEVVLL

SEQ ID NO: 16736 - protein, 480 aa, Oryza sativa
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 16737 - protein, 353 aa, Solanum hoehnei
DAWDTSVTVEVKVGDSIEMVRFFHCYKRGVDRVFVDHPMFLEKIWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESHRVVTVSPYYAQELVSAVDKGVELDNVLRKTSITGIVNGMDTQEWNPATDKYTDVKYDITTVMDAKPLLKETLQAAVGLPVDRKIPLIGFIGRLEEQKGSDILVAAIHKFIGLDVQIVVLGTGKKKFEQEIEQLEVSYPNKAKGVAKFNVPLAHMITAGADFMLVPSR

SEQ ID NO: 16738 - protein, 450 aa, Bacillus thuringiensis
MSTHVTFDYSKALSFIGEHEITYLRDAVKVTHHAIHEKTGAGNDFLGWVDLPLQYDKEEFARIQKCAEKIKNDSDILLVVGIGGSYLGARAAIEMLNHSFYNTLSKEQRKTPQVLFVGQNISSTYMKDLMDVLEGKDFSINVISKSGTTTEPALAFRIFRKLLEEKYGKEEARKRIYATTDKARGALKTLADNEGYETFVIPDDVGGRFSVLTPVGLLPIAVSGLNIEEMMKGAAAGRDDFGTSELEENPAYQYAVVRNALYNKGKTIEMLVNYEPALQYFAEWWKQLFGESEGKDQKGIFPSSANFSTDLHSLGQYVQEGRRDLFETVLKVGKSTHELTIESEENDLDGLNYLAGETVDFVNTKAYEGTLLAHSDGGVPNLIVNIPELNEYTFGYLVYFFEKACAMSGYLLGVNPFDQPGVEAYKKNMFALLGKPGFEELKAELEERLK

SEQ ID NO: 16739 - protein, 353 aa, Solanum hyporhodium
DAWDTSVAIEVQVGDSIEIVRFFHCYKRGVDRVFVDHPMFLEKVWGKTGSKIYGPKAGQDYLDNELRFSLLCQAALEAPRVLNLNCSKFFSGPYGEDVLFIANDWHTALIPCYLKSMYQSREIYLNAKVAFCIHNIAYQGRFAFSDFPLLNLPDEFRGSFDFIDGHEAPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16740 - protein, 176 aa, Vibrio fischeri
MKHTVEVMISEQEVNQRVKELGQQISEHYKDSEGLVMVGLLRGSFVFMADLARAIDVPMTVDFMTASSYGNNMESTRDVRILKDLDDDIKGKDVLLVEDIIDTGNTLSKVCEILSIREPNSITICTLLDKPSRREVEVNVDWIGFSIPDEFVVGVGIDYAQKYRNLSYIGKVVPQE

SEQ ID NO: 16741 - protein, 221 aa, Zymomonas mobilis
MKTPGHQRVKTARRRTAASTRWLERQLNDPYVQKAQAEGYRSRAAFKLIELDERFSLLKNARRIIDLGIAPGGWSQVARKKAPQAKIVGIDLLEAAPIEGVTIFQNDFTDPEAQKKLIEALGGAADLVLSDMAANTIGHAQTDHLRTMALVEEAAVFASETLREGGSFVAKVLAGGADKDLVALLKRLFGQVKHAKPPASRRESSEWYVIAQNFRGEAYQG

SEQ ID NO: 16742 - protein, 872 aa, Streptomyces coelicolor
MRTKRLRDRLALLLAAALGVAGLAAVPAANAADTDDAAEIHGLKGEYYTQSAPGAFDFHELKATGFDPQVDFNSLEPRLAFATGQSDDVSVRWTGKLVPEETGAHTFSIIGDNGFRLWVGGQLAIDHWVDDWDREQTAQPIELTAGQSYDIKLEYFEHYGGSNLHLRWTEPGGSKEAIPQSAFRLPDGFDYNGATATTVQSTGRTLKLDFASPLAAPPAGLTDHLEAVIGGATWPLGETKPDPADPSALLVTLDQPVVGNKDGDAPGTADVRYDGEGGLTDTEGNVVNAFWSSGGNESTYELRTDWADEVGPDNALPEYPRPQLTRDDWQNLNGRWQFAAAEAGEQPPVGKNLKERILVPYPVESQLSGVQRHEDRMWYRRTFTVPRDWHIGSAQRLKLNFGAVDWQSEVYVNGTKVADHKGGYDKFSADVTDALKPGRTQELIVGVYDPTDAANGENPPLGKQRLDPSGIWYTPSSGIWQTVWMEPVARDHVDSLKLTPHVDGAASTLTVEPKGVRDGVRVRATAYAGHRKVATVSGRTGEPLPLKIRDPRLWSPDDPFLYDLKVTVGHDRVESYFGMRSIAVEKVDGVPRTMLNGKPTFLMATLDQGFWPDGLHTAPTDEALAYDLRLHKQLGFNSVRKHIKVEPDRWFYWADRLGLMVWQDMPAMTAGRNPSTAARAEYEREMKEMIDEHVSHPSIIMWVTFNEGWGQYDIGRVAAQAKAWDPTRLVNNQSGLNLGADGGAGDIMDEHGYPSPALPPSPDGERALVTGEYGGLGLAVPGHAWSVQQSYVDVDPQTYTDDYLTKLDEVRALVCRGSNGAVYTQISDVEGELNGLTTYDRKVLKPDVERVKAAQEALIHDASQPTPAGCTA

SEQ ID NO: 16743 - protein, 472 aa, Unknown
  Synechococcus sp. WH 8102
MSQSHFGLIGLGVMGENLVLNAERNGFSSVVYNRTYAKTEEFLNGRGQGRNIQGATDLQDFVGKLERPRRILMMVKAGPAVDAVVDQISPYLEEGDLLIDGGNSDYHDTERRVKELESKSFGFIGMGVSGGAKGALEGPSMMPGGTKASYDAIESLVNKMAAQVDDGPCVTYIGPGGSGHLVKTVHNGIEYGIEQILAEGYDLMKRVKGMNGEQMADVLAQWNATEELSSYLVEITEVCLRTKDPEDGADLVEKIMDQAGQKGTGLWTVVTALQMGASVPTIYASLNGRVMSSLKPERVAAESILKGPVIKDFDLGTPDDAMAPLMDATVLSCIASYAQGMELLRIASRDLDYSLQMPSIAQIWKGGCIIRARLLQRIQDAFAANPDLTNLMLDPWFADQINRRLPGLAKVVAGAAESGIPVPCFSSTLDYINSYRTGRLPQNLVQAMRDCFGSHTYQRVDKEGAFHTEWLG

SEQ ID NO: 16744 - protein, 399 aa, Streptomyces coelicolor
MLGIVLAGGEGKRLMPLTADRAKPAVTFGGTYRLVDFVLSNLVNGDILRICVLTQYKSHSLDRHITTTWRMSSLLGNYVTPVPAQQRLGPRWFLGSADAILQSLNLVHDEQPEYVAVFGADHVYRMDPRQMLAQHIESGAGVTVAGIRVPRAESPSFGVITPGSDGQTVTGFLEKPADPPGLADDPGCVFASMGNYVFTTKALVEALHRDAEDPDSVHDMGGSILPQLTDRGEAALYDFSANHVPGETTRDQGYWRDVGTLDAYYDAHMDLIAERPAFNLYNRDWPVYTHSTQLSPARFNAGGIASESIISAGCLIRGQVTRSVLSPGVVVDPGAVVQGSVLHDNVHIGRGAVVRGAVLDKNVQVPPGATIGVNPQRDGELYTVSKGGVIALGKGQRVP

SEQ ID NO: 16745 - protein, 159 aa, Unknown
  Erythrobacter sp. NAP1
MTTIADFEVTTNRGETLDLATKKGKVLLVVNTASKCGFTPQYDGLEKLYQDFKDKDFEVLGFPCNQFGAQEPGNADEIAEFCKVNFGVTFPLMAKIDVNGPDASPLYDWMKSEKKGVMGSKSIKWNFTKFLIDREGNVVKRYGPQDTPRMIAKDIEKLI

SEQ ID NO: 16746 - protein, 470 aa, Moorella thermoacetica
MDAKNTAAGSYGKVLAGLLAIIVYIILTNLPTPANLPPQGQKALAFMVAVVIVWVFEVIPIGISAALFLMIMDILKVFPMKDAMANFATTTLFFILSAFIIAITFINTGLGNRVSLMVSAIFGQKTDRVLLSFMLPTAIISSVLADIPTAVIFSSIAYPLLQKNGCLPGKSNFGKALMLGIPIAAAIGGIATPAGSGLNIMSISLLKNTAGVEINFLQWALIGFPMAILLTLAAWYIVLKFYPPEFDHVRGLEDIAKARQDLGPLTVNEKKFIAIFSVTLVLWFTQPWNHIDPSVVAIITASSFFLPGVKLATWDDVKGKLSWDVLLLLGTANSLAMAIWQLKGAAWLANTVLGGLAGVGLLIVLFAVTAFGIFSHLIIPVGGAVVAVAIPVLAVLAKNTGINPALLVIPIAYTASCVFLLPLDPIPLTTYHYKYWKFWDMMKPGFLISLVWLVLMVIFMYIGQGVGIIR

SEQ ID NO: 16747 - protein, 508 aa, Pichia angusta
MQLSTLWEPPIVNPRNLKATSIPIFNLWNVYGRNFFFGWFGFFVCFLSWFAFPPLLHGMLKKDLRLTAVDISNNNICGLTGTLLGRFILGPLNDKYGPRITLTGVLVAGAIPTAFVPLVTNVAGLHAIRFFISFLGSSFICCSQFCAVFFDNNIIGTANAISAGWGNAGGGVAFFVMPAISNALENRGYSLHHSWSYSFVIGPFLILMITAILIFVFGSDCPRGRWSLRGDILGINMDNMLVKSVSVTRHFSKEGELTSVFVEPVNAIDKVVVEPNQDQEILEVADIINGDEIIEDPSLNDVVKICLSPRTMLVGLCYMCSFGTELAVESIISNLFGQKMTNWSTSKAGAWGSMLGLLNVVARPAGGIISDFLYQRFKTTKAKKFWMIFTGLMQGIFLIWIGLVPELSIAGLIVSVSFLCLWFEMGNGANYACVPVVNRHHSGIVSGVTGAMGNLGGILFSLVFRYTISNGVNNYFKAFWIIGIVCTAVNLVCVLIPIREERPRKAEN

SEQ ID NO: 16748 - protein, 174 aa, Pasteurella multocida
MTQQAIFAGGCFWCVEAVFNQIKGVEKATSGYINGTTENPTYKEVCTGETGHAEAVKVEFDATVISYEKLLDIFFSIHNPTQLNHQGEDVGTQYRTGIYYLNDEQEQLANKKIAELQPHFAEKIVTEVLPAQTFYPAEDYHQGYLLQNPQNSYCNLVATPKFLKAKVKFEEIWK

SEQ ID NO: 16749 - protein, 414 aa, Xanthomonas oryzae
MTIKTLALQCRDAAQVVSQLSSQAKCALLQAMAAALEADAGTILAANARDLEAARAKGTASAMLDRLALDDKRLAGIAAALREVALLPDPVGRITREDVRPNGIRVQKVRVPLGVIAMIYEARPNVTADAAALCIKAGNGVILRGGSEAIHSNTAIARALQRALREANVPEAALTLVEDLRRETMLELLQLNDIVDLAIPRGGEGLIRFVAEHARVPVIKHYKGVCHLFVDASAEMELALRLLIDGKATRPSACNSLETLLVHADIAERFLPLAAQALRERKVELRGDAATRAVLPEIAPASDDDYAAEFLDLILAMRVVADLDTALAHIRQYGSDHTEVIATQDPDNAERFVQSLRSAVVMVNASSRFSDGGELGLGAEIGISTTRLHSYGPMGLEALTVERFVVRGEGQVRH

SEQ ID NO: 16750 - protein, 480 aa, Alkaliphilus metalliredigenes
MNTLGKSHFYIDRRPLITLFLIKYKNAILLLFSFVVFFIFISNDNIPQDLSIQAYQALVIFLFANFLWITNVIPLAITSLMVMGLLATFNVLPDEKIYSFFGNSALFFIIGAFIISAGISTSGLNKRIAYYFLSRFGDKPHRLTLSIFLLSAFLAHVMPAHAVAAMLFPILMSISKRLELEQSSILGKYMFFALAWGSVLGGVVTLLGGARNPLALGILEEATGESIGFLDWMIAVAPPIYLIMLIVSIYLVKKVSASTRDTEILKELFSEAGERMSKIQLKEIKALLILVGTIYMWIFQSKRFGIANVALISAALFFVLNVIDWEDAKKEINWGAIFMYGGAIALGKALEETGLLEYINQHYISNMNFSTLGLILVVFSISVFLTEGVSNAAVVVILLPVVIRTTIALGLPSTLAVYLVAVPSGLAFMFPMSSPPNAIAFSSGYIKTSDSLKIGFILNMLSIAVITVFALTYWRIIGIY

SEQ ID NO: 16751 - protein, 166 aa, Brassica napus
MESEGKIVFTEEQEALVLKSWSVMKKNSADLGLKLFIKIFEIAPTAKKLFSFLRDSPIPAEQNPKLKPHAMSVFVMCCESAAQLRKTGKVTVKETTLKRLGANHSKYGVVDEHFEVTKYALLETIKEAVPEMWSPEMKSAWGQAYDHLVAAIKAEMQAFSLIYILI

SEQ ID NO: 16752 - protein, 397 aa, Unknown
  Magnetococcus sp. MC-1
MNAKIRKMLHNPAASGILIFLAAVAAMAVENSAWNTHYNAFLDIPVSVQFADLTIAKPLLLWINDGLMAVFFLLVGLELKREFLEGELSQPSNVILPVVGAVGGIALPAAIYTLINQGNPAALDGWAIPTATDIAFALGILALLGKRVPASLKLFLLTLAIIDDLAAILIIAFFYTSELSPASLMIAGSAIGTLILMNRLGVTGISGYMVVGIVLWIAVLKSGVHATLAGVVLGFVIPLKGEEPGELSPLHQLEDDLHHVVGLGILPLFAFANAGVSLQGLTPSILLDPVPLGIALGLFLGKQIGVFGFVWLSIKSGLAKLPEGFTWKQLYGVALLCGVGFTMSLFISSLAFEHGSSALVSGAPDMGSARLGILTGSILSGIFGYILLRFSLPKPPQ

SEQ ID NO: 16753 - protein, 1118 aa, Unknown
  Shewanella sp. MR-7
MGLKYMAFDWFSQFFISSQDSLLLNVYYNPLLVTISILIAIFSAFMAFQVTTQAVLSQSKSRQQIMLLTGSVVLGGGVWSMHFIGMLAFDLCSPVTYDFGLTALSLLPSIGASWVALNLLSKPSFKFSQVLISGILVGAGIGTMHYVGMAAMDMAPLLRYDPWIFALSIVVAVLLAIIALWVRTGLNQLIASNMSAITSNFIASIVMGLAISGMHYTGMAAARFVKPEGLELSEQSSEISFYLALGVSVTTVIIICLVLIVNVIFKYKDLSLLAKSNEDRMRAMMNTAVDGIITIDGQGIIVNVNKAVTTILGWSPAELLGENVKKIVPESIRPHHDGYLARYINTREAQIIGTGREVEAQHKAGHSVPVRLSIGHVMQGKAHYFVGFLSDLSLRNEMEQELKNNEAKFRSLITNIPGIAYRCKSTEGWPMVFISEAVLNITGYPAEDFELPHPKRFFSDLYYPDDIESIYAQAQPPTFSMEYRIIRADGEVRWLFEHGNYILDETSNEVWIDGFLMDITERKVMEQDLVTAKNNAEQAAAARAAFLANMSHEIRTPMNAIIGFSDILLESVLDNEQHKQLSTINRSAKSLMHLLNDVLDSAKLDKGKLELENRVFCLTDEIDTVISTLWLQAKKQRLSLEVDIAPSMAANFIGSPERIRQVLINLIGNAVKFTCEGKVTVSVFPQNDNLVTFEIIDTGIGMTPEQLNRVFEAFAQADASMSRKYGGTGLGTTISKQLVELMGGQLEAESTLGQGSTFRFTIPLQPSSEPLETERADHGSLPPLTLLVVDDIQQNIDLLSVWLTRQGHKVITARDGEQALLRMQKADIDITLMDLQMPVMDGLTAAKMRREQEAESQLPHMPIIALTASVLEQDKSAAEQAGMDGFANKPIDFALLTREIARVLQLNPPQAEFESLQPLGNQLVDEAKGVKLWGSKPQFIKELMKFIAQWPEKSQALQQAISEQDTATIKLLSHSLKGVSGNLGLLQWMSYFAQLEKLTQAESLSFEAMEAIIAKISDSLVEIGDYIESTTVSSASGSELAQSGTDDPAQLLAHIDALLASVVHHSFDESDLEALTARIDEHLRLSVTIITEALDNFDFDIAHNELLELRRIITANQE

SEQ ID NO: 16754 - protein, 401 aa, Unknown
  Marinobacter sp. ELB17
MNRKLQAVLVAVVIAASGAFYAAFASAEKNTVVGNPYAPTDSNLAVATVAGGCFWCVEAGYEKIPGVVEAVSGYAGGETPNPTYRSVSSGGTGYTEAVQVYYDPQQITYEGLLQGLWRMMDPTDDQGQFVDRGTHYRPAIFYHSQEEKQKAEAAKKALQESGVYDNPVVIEIVPAGTFYPAEDYHQDYYKKNPVRYKLYTFNSGRYQFIESVYGKDYELDFSQFKPAANSSGNAGADQNAEQASGASAGFNPEAFVKPPQDELKKLLSSIQYNVTQKDGTESPFNNAYWDNKEPGLYVDVVSGEPLFSSRDQYKSGTGWPSFTRPLDPGMVKEHEDRAFFMTRVEIRSSYADSHLGHVFDDGPAPTGKRYCMNSASMRFIPLAQMADAGYGDFIDAVESVN

SEQ ID NO: 16755 - protein, 265 aa, Brassica napus
  misc_feature (242)..(242): Xaa can be any naturally occurring amino acid
MGSIEEESPLIEEGLISQEPKLYAQDGSVDLHGNPPLKEKTGNWKACPFILGNECCERLAYYGIAGNLITYLTTKLHQGNVSAARNVTTWQGTCYLTPLIGAVLADAYWGRYWTIACFSGIYFIGMSALTLSASVPALKPAECIGTFCPSATPAQYAMFFGGLYLIALGTGGIKPCVSSFGADQFDDTDSRERVKKASFFNWFYFSINIGALVSSSLLVWIQENRGWGLGFGIQPVFMGLAXASSFFGTPLTGSEAGAAYHPISK

SEQ ID NO: 16756 - protein, 490 aa, Coccidioides immitis
MTVTAPRRRPSRKGSMADMPKDLLEQVKELEELFTVDQARLKKIVDHFVKELEKGLSVQGGNIPMNVTWVMGFPTGHEHGTFLALDMGGTNLRVCEIFLCEKKGEFDITQSKYRIPEELKSGNADDLWEYIADCVQQFIEYHHEEENLPDLPLGFTFSYPATQEYIDHGVLQRWTKGFDIDGVEGEDVVPMLEAALAKRGLPIKVAALINDTTGTLIASAYTDPEMRIGCIFGTGVNAAYMENAGSIPKIAHYNLPPDMPIAINCEYGAFDNERVVLPLTQYDVVIDRDSPRPGQQAFEKMTAGLYLGEIFRLVLLDLIDNKGNLIFEGQDVSSLRKPYCLDSSFLAYIEEDPFENLSETRDLFERTLGIKATKPELELCRRLAELVGTRAARLSACGVAAICKKKNIKSCHVGADGSVFNKYPHFKARGAKALREILDWADDEEDKVIICSAEDGSGVGAALIAALTLERVKQGNLAGIRKTDTMKKLL

SEQ ID NO: 16757 - protein, 51 aa, Passiflora adenopoda
NGEVMPGQWEYQVGPAAGISAGDQLWMSRFILERIPQIAGVVLTFDPKPIQ

SEQ ID NO: 16758 - protein, 466 aa, Arabidopsis thaliana
MLIKETNLGSFNLGGIFQRLLYCVPLKKSIYFVDRIGNYTDGSVSKTLNSTSSVFPQATEKENNFCLLRKGQLQDVYEHVLVNNALLICKVVLPERRISKKTLEARDPRYVNLEDKSLKVNGSSQLVNNGTRYRLEPDGNGYNYASAMKGAKVVDHNKEAKGASNVLGKDHDKYLRNPCSVSDKYVVIELAEETLVDTVRIANFEHYSSNPKEFSLSGSLSFPSDMWTPAGSFAAANVKQIQSFRLPEPKWTDQIGKETEAQKKKDDVVKTINIIGDKKYEVKEKHNVLKVMMQKVKLIEMNLSLLEDSVKKMNDKQPEVSLEMKKTLVLVEKSKADIREITEWKGKMKLPMNLIFFEQEKELRDLELWKTLVASRVESLARGNSALRLDVEKIVKEQANLESKELGVLLISLFFVVLATIRLVSTRLWAFLGMSITDKARSLWPDSGWVMILLSSSIMIFIHLLS

SEQ ID NO: 16759 - protein, 419 aa, Geobacillus stearothermophilus
MKYLPQQDPQVFAAIEQERKRQHAKIELIASENFVSRAVMEAQGSVLTNKYAEGYPGRRYYGGCEYVDIVEELARERAKQLFGAEHANVQPHSGAQANMAVYFTVLEHGDTVLGMNLSHGGHLTHGSPVNFSGVQYNFVAYGVDPETHVIDYDDVREKARLHRPKLIVAAASAYPRIIDFAKFREIADEVGAYLMVDMAHIAGLVAAGLHPNPVPYAHFVTTTTHQTLRGPRGGMILCQEQFAKQIDKAIFPGIQGGPLMHVIAAKAVAFGEALQDDFKAYAKRVVDNAKRLASALQNEGFTLVSGGTDNHLLLVDLRPQQLTGKTAEKVLDEVGITVNKNTIPYDPESPFVTSGIRIGTAAVTTRGFGLEEMDEIAAIIGLVLKNVGSEQALEEARQRVAALTDPTSRSAAGTMEFEA

SEQ ID NO: 16760 - protein, 169 aa, Zea mays
MAEESPQSIYDFTVKDIEGKDVSLSQFKGKTLLIVNVASKCGLTDANYKELNVLYDKYKDQGLEILAFPCNQFLGQEPGNNEEIQQTVCTKFKAEFPIFDKVDVNGKNTAPLYKYLKAEKGGLLIDAIKWNFTKFLVSPDGKVSQRYSPRTSPLQFEKDIQTLLGQASS

SEQ ID NO: 16761 - protein, 419 aa, Geobacillus stearothermophilus
MKYLPQQDPQVFAAIEQERKRQHAKIELIASENFVSRAVMEAQGSVLTNKYAEGYPGRRYYGGCEYVDIVEELARERAKQLFGAEHANVQPHSGAQANMAVYFTVLEHGDTVLGMNLSHGGHLTHGSPVNFSGVQYNFVAYGVDPETHVIDYDDVREKARLHRPKLIVAAASAYPRIIDFAKFREIADEVGAYLMVDMAHIAGLVAAGLHPNPVPYAHFVTTTTHMTLRGPRGGMILCQEQFAKQIDKAIFPGIQGGPLMHVIAAKAVAFGEALQDDFKAYAKRVVDNAKRLASALQNEGFTLVSGGTDNHLLLVDLRPQQLTGKTAEKVLDEVGITVNKNTIPYDPESPFVTSGIRIGTAAVTTRGFGLEEMDEIAAIIGLVLKNVGSEQALEEARQRVAALTDPTSRSAAGTMEFEA

SEQ ID NO: 16762 - protein, 356 aa, Oryza sativa
  misc_feature (312)..(312): Xaa can be any naturally occurring amino acid
MAAMATTASSLLKTSFAGARLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLVDPRAERKPAHLFLDELGVAYDEQEDYVVIKHAALFTSTVMSRLLARPNVKLFNAVAVEDLIVKEGRVGGVVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMGPTFGAMMISGQKXAAHLALKALGRPNAIDGTIKKAAAAAAHPELILASKDDGEIVDA

SEQ ID NO: 16763 - protein, 257 aa, Burkholderia thailandensis
MANTLDKFRLDGRRALITGSGRGIGLTLARGLAEAGAAIVINDRDEERVAALAKRFRDDGFAADYAVFDVSEHALVRSAIDDFEARNGAIDILVNNAGIQRRAPLDAFEPGDWHALMRVNLDGVFNVAQAVARHMITRRCGKIINICSVQSELARPTIAPYAATKGAVRMLTKGMCADWARHGIQANGLAPGYFETELNRALVDDAAFSDWLCKRTPAGRWGRVDELCGAAIFLASAASDFVNGQTLFVDGGLTSAV

SEQ ID NO: 16764 - protein, 112 aa, Unknown
  Synechococcus sp. CC9605
MKKVEAIIRPFKLEDVKVALVEAGIIGMTVSEVRGFGRQKGQVERYRGSEFTVEFLQKLKIEVVVEDDRVEEVVESIADAARTGEIGDGKIFISPVESVVRIRTGDRDSTAL

SEQ ID NO: 16765 - protein, 326 aa, Triticum aestivum
  misc_feature (23)..(23): Xaa can be any naturally occurring amino acid
  misc_feature (168)..(168): Xaa can be any naturally occurring amino acid
MEAETAAKRARENEGAAAADGAXGEQAGVSAVIPGWFSEISPMWPGEAHSLKVEKVLFQGKSDYQDVLVFQSSTYGKVLVLDGVIQVTERDECAYQEMITHLPLCSIKDPKKVLVIGGGDGGVLREVSRHSSVEQIDICEIDKMVVDVSKQFFPHLALGFEDPRVSLXHIGDGVAFLKNAPEGTYDAVIVDSSDPVGPAQELFEKPFFESVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPSFARRVIEAKAN

SEQ ID NO: 16766 - protein, 644 aa, Antirrhinum majus
MATGIQNQKIVPENLRKQLAIAVRSIQWSYAIFWSNSVAQPGVLEWGDGFYNGDIKTRKTVQSVELNQDQLGLQRSDQLRELYESLSLGETNTQAKRPTAALSPEDLTDAEWFFLVCMSFIFNIGQGLPGRTLARNQAVWLCNAHRADTKVFSRSLLAKSASIQTVVCFPYSEGVVELGATELVPEDLNLIQHIKTSFLDSPATVPKIPNYVSNSITNNNDLICEALEHANIPENDLDQLLNCPDTNICSPDNSLDDFADNLLIDESNLAEGINGEVPQTQSWPFMDDAISNCLNSSMNSSDCISQTHENLESFAPLSDGKGPPETNNCMHSTQKCNQQIENTGVQGDEVHYQGVLSNLLKSSHQLVLGPYFRNGNRESSFVSWNKDGSSGTHVPRSGTSQRFLKKVLFEVARMHENSRLDAGKQKGNSDCLAKPTADEIDRNHVLSERKRREKINERFMILASLVPSGGKVDKVSILDHTIDYLRGLERKVDELESNKMVKGRGRESTTKTKLHDAIERTSDNYGATRTSNVKKPLTNKRKASDTDKIGAVNSRGRLKDSLTDNITVNITNKDVLIVVTCSSKEFVLLEVMEAVRRLSLDSETVQSSNRDGMISITIKAKCKGLKVASASVIKQALQKVTMKS

SEQ ID NO: 16767 - protein, 103 aa, Yarrowia lipolytica
MSGRGKGGKGLGKGGAKRHRKILRDNIQGITKPAIRRLARRGGVKRISAQIYEETRNVLKSFLESVIRDAVTYTEHAKRKTVTSLDVVYALKRQGRTLYGFGG

SEQ ID NO: 16768 - protein, 318 aa, Prochlorococcus marinus
MEIIESDVVIIGGGPAGCTCALYTSRSNLKTVVLDKNPSVGALAITHQIANYPGVPVDISGEKLLTLMREQAVQYGTDYRRAQVFGIDTSGEWKMVYTPEGTFKARALVLASGAMGRPASFKGEADFLGKGVSYCATCDGAFYKNREVAVVGVNKEAIEEATVLTKFASTVHWITSSDPKSDNEEAMELMASSNIKHWSRTRLLEILGDDMGVNGVVVKNKQEENPINLNLDGVFVYMSGSKPITDFLGDQIALKEDGGVIVDDFMSTNSDGVWAIGDIRNTPFKQAVVAASDGCIAAMSIDRYLNSRKNIRVDWIHS

SEQ ID NO: 16769 - protein, 353 aa, Solanum laciniatum
DAWDTSVAVEVKVGDSIEIVRFFHCYKRGVDRVFVDHPMFLEKVWGKTGSKIYGPKAGRDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16770 - protein, 273 aa, Streptococcus pyogenes
MMKRQFEDVTRIVIKIGTSSLVLPTGKINLEKIDQLAFVISSLMNKGKEVILVSSGAMGFGLDILKMEKRPTNLAKQQAVSSVGQVAMMSLYSQIFAHYQTNVSQILLTRDVVVFPESLANVTNAFESLISLGIVPIVNENDAVSVDEMDHATKFGDNDRLSAVVAGITKADLLIMLSDIDGLFDKNPTIYEDAQLRSHVAVITQEIIASAGGAGSKFGTGGMLSKVQSAQMVFENKGQMVLMNGANPRDVLRVLEGQPLGTWFKQIEEVTHD

SEQ ID NO: 16771 - protein, 348 aa, Cytophaga hutchinsonii
MSSNNQVLIEEKINETADAVTLVLKQHDSIKNYKSGQFITLLLNIGGEKVRRSYSFSSSPETDSKPSITIKKIQDGKASTYLFNTIKAGDSLEFQQPAGIFTLDKASSESLVFIGAGSGITPLISMIKTALANKKFKKICLIYSNRNEDSVIFKKKLEELKAAYSNFEVIYTYSQPHDTSLPKGRLNQSQFIKIIEHIKDLAVAKTDYFLCGPDGMLEEVKHGLEILQVASSKIHKESFVTTNENDSVFVSVPEHAGDANEVTIMYQGSEYKFTVKPGKTILQSALDEDIDLPYSCMSGLCTACMGKCLSGKVEMGDQDGLSEKEVKNGYVLTCVGRPAVAGTVIEID

SEQ ID NO: 16772 - protein, 351 aa, Solanum lasiocarpum
WDTSVAIEVQVGDSIEIIRFFHCYKRGVDRVFVDHPMFLEKVWGKTGSKIYGPKAGQDYLDNELRFSLLCQAALEAPRVLNLNCSKFFSGPYGEDVLFIANDWHTALIPCYLKSMYQSRGIYLNAKVAFCIHNIAYQGRFAFSDFPLLNLPDEFRGSFDFIDGHETPVKGRKINWMKAGILESDRVVTVSPYYAQELVSAVDKGVELDNVLRKTSITGIVNGMDTQEWNPATDKYTDIKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16773 - protein, 242 aa, Photobacterium profundum
MATVSMRDMLKAGVHFGHQTRYWNPKMKPFIFGARNKVHIINLEKTVPMFNDALAEINKIAARKGKVLFVGTKRAASESVKESAISCDQYYVNNRWLGGMLTNWKTVRQSIKRLKELEIQSADGTFEKLTKKEALMRTREMEKLEKSLGGIKNMGGLPDAMFVIDADHEHIAIKEANNLGIPVFSIVDTNSNPDGVDFVIPGNDDAIRSIQLYTGAVAQTVTEARNQDIVVQAEQDGFVAEA

SEQ ID NO: 16774 - protein, 303 aa, Unknown
  Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 16775 - protein, 311 aa, Unknown
  Synechococcus sp. WH 8102
MADLQHWLITGASSGIGRLAAERLQQQGHRLTVICRSQQRADQTLGWLTGESRVLLADLADLDQVQAIGHALLEKDEALDGLLLNAGLQYAGHRQVRWSAQGLELTIAVNHLAHQRLVMDLLPLLLRSHAPRLVITASEVHNPASGGGRVGRPAGLGDLSGLKKHSEMVNGERPFDADKAYKDSKLCNLLMGRHLAERHPQLPVICWSPGLVIPRGRDGFFRNSREANPLGQALFGFVARDLLRLTEHPQRAAELLERLVLDPAMPSGFSYWSNTLLAPGRHRFERAETSAEAADEAKAARLWQVSEQLVV

SEQ ID NO: 16776 - protein, 566 aa, Bartonella quintana
MSQYNPTTADFEVLLMESFQTNDLNEGSVVKGRIIAIEKDMAIIDAGLKVEGRIPLKEFGAKGKDGSLQIGDEVEVYIERIENAMGEAVLSREKARREESWIRLEEKFNAGARVDGVIFSQVKGGFTVDLDGAVAFLPRSQVDIRPIRDVSPLMHNSQSFEILKMDRRRGNIVVSRRTVLEESRAEQRSEIVQNLEENQIVEGVVKNITDYGAFVDLGGIDGLLHVTDMAWRRVNHPSEILNIGQTIKVQIIRINQDTHRISLGMKQLESDPWESISARYPVGKKITGAVTNITDYGGFVEIEPGIEGLIHVSEMSWTKKNIHPGKLLSTSQEVEVVVLEIDPSKRRISLGLKQTFENPWVAFANKFPVNSQIEGEVKNKTEFGLFIGLEGDVDGMVHLSDLDWNRPGEQVIDTYNKGDIVKAVVLDVDIEKERISLGIKQLSSDKVGEAAAAGELRRGSVVTCEVTAINDNGIDVKLTNHNLETTIRRADLARDRDEQRPERFSIGQRVDAHITAFDKKTRKLSVSIKALEIAEGKEAVAHYGSTDSGASLGDILGAALKKQEQD

SEQ ID NO: 16777 - protein, 463 aa, Unknown
  Erythrobacter sp. NAP1
MTKPQILWLRRDLRMADNPALYHAAKAGPVVCVYVLDDEAPEHHRMGGASRWWLHHSLESLSKSLGTRNAKLILRRGDAVEELTTVANAVGADTIHANTHYEPWWRKAQKKLKDEIDLQLYDGVYLFPAGHVTTGSGDPYKIYTPFYKALRQELPPRDVLPEPETLSSPDDWPASDELADWNLLPTKPDWSGGIADFWEVGEDAAHERLSEWEDHVADYEDKRNFPSVDKTSRLSPHLHFGEISPVQVWHALKHKRSDGWNSFESELIWRDYAANVICEYPAYASENYREDYDKLEWRDPDSDEKAAKDLKKWQEGKTGYPIVDAGMRQLWQTGWMHNRVRMITASFLIKHLLIDWRKGEQWFWDCLVDADYSSNAVNWQWNAGTGVDSNMFSRIMAPLTQSEKFDAAAYIREYVPELADLDEPYIHDPEEHGRLPKAYPAKMIAHKEGRERAMSAYKDMKNG

SEQ ID NO: 16778 - protein, 353 aa, Solanum lidii
DAWDTSVAIEIEVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSYFPLLNLPDEFRGSFDFIDGHEKPVKGRKINWMKAGILESDRVVTVSPYYAQELVSAVDKGVELDNVLRKTSISGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16779 - protein, 185 aa, Yarrowia lipolytica
MTLGPKQERQSLFTLRFWHSRLAGTLTLQKVPFLTFEVTTASNRTTKMLIPKEDRKKIHQYLFQQGVCVAKKDFNQPKHEDIDTKNLYVIKALQSLTSKGFVKTQFSWQYYYYTLTDEGVEYLREYLHLPEGVVPETHKKTAREETASQGRGGRPERGPRRQEGEYRRYNSNKESAPGNYQPSFQ

SEQ ID NO: 16780 - protein, 474 aa, Bacillus licheniformis
MRVYTTTKLTGLLLGPISFLLILGLIPEAELAYAPRIVLAVTAWTAVWWITEAVPIPAASLLPVILLPTLGGLDMETTAKAYGDPIVFMYMGGFIIAIAIEKWNLHKRMALHILKRIGAESHRIVLGVMAATAFLSMWISNAATALMMLPVALAVIKEVQEKEILKGESLQKFSKSILLAVAYAASIGGLATLVGSVPNAVFAAMSKQMLNHEIMFFEWFLFGFPVSILFLAILYVYLTKIKFKVSAFQGKKPDFIDHDLKALGAMTREEKSVFTVFLLTACLWMFKFILPFQISDTSIAIFGAVLLFLIPSTKDERILEWKDMQSLPWGLLLLFGGGLSLAAGFSATNLTAWIGGKLKLLEGHPYLFVLIILTAAILFMTEIMSNTAVANMVIPMTIGLGAALQVEPYGLMAAAALASSCAFMLPISTPPNAAVFSSNLLTIKDMVRAGFWLNIAGVFLIVISAYFWLPAVFQ

SEQ ID NO: 16781 - protein, 685 aa, Unknown
  Magnetococcus sp. MC-1
MQELDPQLMLAGINDGALGSIFLDDQEQIVFWNRWMERASGLKRAEVLGRPLREVFPELVGGRLLRAVATALETGLPALLSHKLNLWPLPLYPSYAVRPHGPRLCQQIMINALRPHGEKRFVLIQIQDISHTVQREQLLQEQTRVLMQREEELTASRLKADQANQAKSEFLANMSHEIRTPMNAIIGMADLLLETELNKDQRRYVQIFARAGASLLELINDVLDLSKVEADRLELEHRPFDLWALVEGAVEIFTLRTQEKGVKLDFELSARAPRYVISDQKRLRQILVNLLGNAVKFTQSGQIQLWVDVRDCEDAGGWLYFRVQDSGIGMSKAQQKSIFEPFVQADASVTRQHGGTGLGLAICKKLVELLSGDIWLESELGQGSRFHFTARFTHTALVAESERAFTSAKLHGRHVLLLGSQPQNRVLLESVLRRAGCQITTVTHQAQLAGHLLEPPAGLRPFHAVLVDCYNSMARVHQQIASVRANGSVMPMVLLVGEARQEDIQIAADLGVLLLERPVSHGRLLEALGATMEQGEAALLSSSLSPTAAIEMLKQVPLKILLTEDSVDNAVLFKAYLKQYPLEITHAANGAEALTLFEQHHYDLVFMDLQMPVMDGYSATRAMRFFEKQQRRPPTPILALTAYALSGDADKSRDVGCDAHLVKPIKKLELLSSIAQYGLKISLES

SEQ ID NO: 16782 - protein, 51 aa, Passiflora coriacea
NGEVMPGQWEYQVGPAVGISAGDQLWMSRYILERITEIAGAELTFDPKPIQ

SEQ ID NO: 16783 - protein, 51 aa, Passiflora biflora
NGEVMPGQWEYQVGPAVGISAGDQLWMSRFILERITEIAGVVLSFDPKPIQ

SEQ ID NO: 16784 - protein, 250 aa, Oryza sativa
QFITHGITTIRKTLSEVEAEGHVLPDGTLVIDGKTVSVVYFRAGYTPNDYPSEAEWAARLLLEQSSAVKCPSISYHLVGTKKIQQELARPNVLERFLENKEEITKIRKCFAGLWSLDDEEIVKSAIQKPELFVLKPQREGGGNNIYGIDVRETLIRLQKEGGDALAAYILMQRIFPKASLSNLVRGGVCHEALTISELGIYGAYLRNNDKVVMNEQSGYLMRTKVSSSDEGGVAAGFAVLDSLYLTDKAM

SEQ ID NO: 16785 - protein, 51 aa, Passiflora capsularis
NGEVMPGQWEYQVGPAVGISAGDQLWMSRFILERITEIAGAVLSLDPKPIQ

SEQ ID NO: 16786 - protein, 117 aa, Triticum aestivum
  misc_feature (7)..(7): Xaa can be any naturally occurring amino acid
  misc_feature (24)..(24): Xaa can be any naturally occurring amino acid
GLAPAPXRDPDPCPRCGSRDTKFXYYNNYNTSQPRHFCKSCRRYWTKGGSLRNVPVGGGTRKSGSSSSASATATPTSTGAPPKSPRSSKNSKRRRVRPDPVSGPAPTLVPGNATDTD

SEQ ID NO: 16787 - protein, 305 aa, Enterococcus faecalis
MIVQSILDTIGATPLFEFTSEQYPMPEGTKIYAKLEYLNPGGSVKDRLGVHLLKEAMKTGKINQATTIIEPTAGNTGIGLGLAASQLGLKTIFVVPEKFSQEKQQLMQALGAKIVPSPTEQGIVGAITSAQDLAKEIPNSYVPLQFENPDNPAAYYEGLGPEIVQDLGGKITSFVAGLGSGGTFAGVGRYLKEQNSKTQLWGVEPEGSILNGGPAHGHEIEGIGVEFVPPFLKQIPVDGFYTISDEDGFFWVKQLAKKSALLVGSSSGAAFAAALREARRLPAGSTIVTIFPDGSDRYLSKNIYS

SEQ ID NO: 16788 - protein, 604 aa, Zea mays
MQGLAPPTSVSIHRHLPARSRARASNSVRFSPRAVSSVPPAECLQAPFHKPVADLPAPSRKPAAIAVPGHSAAPRKADGGKKQLNLFQRAAAAALDAFEEGFVANVLERPHGLPSTADPAVQIAGNFAPVGERPPVHELPVSGRIPPFIDGVYARNGANPCFDPVAGHHLFDGDGMVHALRIRNGAAESYACRFTETARLRQERAIGRPVFPKAIGELHGHSGIARLALFYARAACGLVDPSAGTGVANAGLVYFNGRLLAMSEDDLPYHVRVADDGDLETVGRYDFDGQLGCAMIAHPKLDPATGELHALSYDVIKRPYLKYFYFRPDGTKSDDVEIPLEQPTMIHDFAITENFVVVPDHQVVFKLQEMLRGGSPVVLDKEKTSRFGVLPKHAADASEMAWVDVPDCFCFHLWNAWEDEATGEVVVIGSCMTPADSIFNESDERLESVLTEIRLDARTGRSTRRAVLPPSQQVNLEVGMVNRNLLGRETRYAYLAVAEPWPKVSGFAKGDLPTGELARFEYGEGRFGGEPCFVPMDPAAAHPRGEDDGYVLTFVHDERAGTSELLVVNAADIRLEATVQLPSRVPFGFHGTFITGQELEAQAA

SEQ ID NO: 16789 - protein, 470 aa, Chlamydophila pneumoniae
MNKKKRFLSLLFLTAVLLGIWFSPHPASINSNAWQLFAIFTTTIMGIIFQPVPMGAIAIIGISTLLLTQTLTLEQGLSGFHNPIAWLVFLSFSIAKGIIKTGLGERIAYFFVSALGKSPLGLSYGLVITDFFLAPAIPSVTARAGGILYPVVTSLSDSFGSSAEKGTQDLIGSFLIKVAYQSSVITSAMFLTAMAGNPLVAALAGHVGVSLSWVLWAKAAIIPGLPSLFLMPIILYKLYPPKITSCEEAIRSAKLRLKEMGPLKKEEKTILMIFFLLVVLWTFGDLLGISATTAALIGLSLLILTNILDWQKDVIANTTAWETFIWFGALIMMASFLNQLGFIPLVGDSAAALVSGLSWKIGFPLLFLIYFYSHYLFASNTAHIGAMYPIFLAVSISLGTNPIFAALTLAFASNLFGGLTHYGSGPAPLYFGSHLVTVQEWWRSGFALSIVNIVIWIGIGSLWWKALGLI

SEQ ID NO: 16790 - protein, 504 aa, Solibacter usitatus
MGGAPQRKKVVFFFPAFSSQEATAPLGILAVSTPLLNAGYQVQLIDSTITPNFQRRVIEELKDAICLAVSLVTGPMIRETVQIAREVKRLYPKMPIVLGGWHPSLLPDQTLAAEYIDAVVVGQGEEALLAVVQRLEAGESLEGIPGVGYKEDGRIRFNVTRALRPLKEMPPKAYHLADFDAYQRVCGRRWAMYTSSLACPYNCGYCTNDGVYGRKWNALDPAQVVEETTDLVSRYNLELLWIVDDNFLVDRERAVGIAEGLVRRGVKFDWSIQASTNLVIRLTVEELKLLRRAGLTQMSQGADTGSAKMMHLMGKDFQDLDAIYGAADKLTQAGIRPSFNLIFGYPGEGEKERRESVALMMNICRRYPGAEFWTNIFTPYPGSPIMKRAFELGIEVPKTLEGWADFFPRYTVLPWLKGREHERLQNMREYMRVAFHRVPIGKYRTPALSRLLFELISVPARWRLDHHVYSFPVELWARKTAQKVLTPPKPKVDAQQLSAEPVTC

SEQ ID NO: 16791 - protein, 647 aa, Nocardia farcinica
MCGLLGFLTADAATSEVVDQVYNALHCMRHRGPDERGTWHDDHLVFGFNRLSIIDIEHSHQPLRWGPPENPERYALTFNGEIYNYLELREELAAAHAAEFGDAPMFRTEGDSEAIVAAYHYWGAEAVAKLRGMFGFAIWDTQTRELFLARDPFGIKPLFLATGPGGTAFGSEKKSLLDLLPALRLSDDLDPRALEHYTVLQYVPEPETLHKGIRRLESGTYAVVRPGAAPQVTRYFTPRFPVRPFAPGSAQTRYNEIAAALEDSVAKHMRADVTVGSFLSGGIDSTAVAALAMRHNPNLITFTTGFEREGYSEVDVAAESAAAIGARHIVKVVSPAEFAAAIPEIVWYLDDPVADPALVPLYFVAKEARKHVKVVLSGEGADELFGGYTIYREPLSLKPFEYLPRGLRRLAGRLSERIPDGTRGKSLLHRGSLTLEERYYGNARSFNDAQLRAVLREFRPEWTHQDVTAPIYAQSRGWDPVARMQHLDLFTWLRGDILVKADKMTMANSLELRVPFLDTEVRRVAEQLPFDQKITKDTTKYALRQALEGIVPAHVLHRAKLGFPVPLRHWLRGTELYDWAHTQIAESQTDHLLDKAAITAMLVEHRAGRADHSRRLWTLLVFMVWHGIFVEDRIKPDIQEPVYPVTL

SEQ ID NO: 16792 - protein, 467 aa, Solibacter usitatus
MADILLTHSNHLYSDRKQLRKMQPYPPLQTLLAAACLRRAGYEVALFDAALEDPETGFERALARHNPRLVAVCEDNFNFLTKMCLLRNRELACWMARTACRTGVPAVVNGSDAADRAAEYLAAGFRYVLEGEVEESIVEVARLMLDGEGAMPLRGIAFSDPQSGQVRQTPRRAPITGLDALPMPAWDLIDAEPYRRAWTEAHGYFSMNMVSSRGCPYRCNWCAKPIWGDSYHCRSAHLVAEEMLAIKSQFRPDHLWFADDIFALSQQWTLEFADAVEALGAQIPFKMQSRCDLMTRPTVGALARAGCTEVWMGVESGAQDVLDAMDKGTRLWQVYEARESLCRHGIRACYFLQFGYPGETWTEIEKTLALVRETRPDDIGVSVSYPLPGTAFHKMVSSQLGPKENWADSDDLDMMFQGAFTSGFYRALADALHVEVREGREAAEGAWSTVFALKETCARKLPIWISC

SEQ ID NO: 16793 - protein, 237 aa, Triticum aestivum
MHDVSNIYLNQRRCCSGPARCYRQIKNKPYPKSRYCRGVPDPKIRIFDVGQKKRGVDEFPLCVHLVSWEKENVTSEALEAARIACNKYMAKHAGKDAFHLHVRAHPYHVLRINKMLSCAGADRLQTGMRGAFGKPTGMCARVHIGQVLLSVRCRDAHAAHAQEALRRAKFKFPGRQRVIVSGKWGFTKFKREEYLKLRSEGRIVPDGVTAKLLTWHGSLEGRPRGKGVFPPSVAGSA

SEQ ID NO: 16794 - protein, 439 aa, Solibacter usitatus
MDLLLTHGYFLHEDAKELQIMKPYAPLGLLYLSSYLRGKGFEVEIYDSTFGSREELFRILETQAPATLGIYANLMTRANALAILERATACGWKVLMGGPEPANYAGEYLAAGADAVISGEGELALEAILGGTAREQVPGLIFRAGDGSTVNTGPARLLPDLDAQPWPDRERVDIGQYLRVWRERHGAGSVSVITARGCPYHCRWCSHSTYGKTHRRRSAMDVVNEVQWILERYAPEQVWFADDVFTIHHGWLDQYAAEMKRRGLRVPFECITRADRVNARVAAQLAELGCDRVWIGSESGSQRLLDAMERGVTVAQVRDAVGQLKQNGIRTGMFFMWGYEGEELSDIEATYEHVKACQPDVFFTTISYPIKGTPYYEEVASKLVQLGEWRSTTDREVKIRGRRSRHFYQLADQLLRSETPDQAAAVRQRLADAYREVEA

SEQ ID NO: 16795 - protein, 484 aa, Solibacter usitatus
MIILFHPRSTKPKNRRLPLSVLYLGAVLEGREDYEIVDGNADPDPMATIDALMRQHKVELLGVSVMPGPQLRQAVAVSKAVREKYPRVPIAWGGYFASLYTEASLNARYVDFVVKGQGEDTLLELLAALRGPRNFQDVRGMSFKDQFGLHVHTAERPLKAPDDFPWPPYHRLDPAKYIARTFLGTRTAVHQASIGCPFRCNFCGVVPVYDREKMEPAARTASILRYLQAQYGVNAVQFYDNNFFLREEHARELAERIAPLNLRWWCEARVDIVLGYSDDTLRKLREAGCVMIFFGVESGNDVALRNMKKQLTSEQTLELARRIREFDIVPEYSMIFGNPADAERDLEANIAFVRRVKKVNPAVEIVVQTYVPTPQRNGVWGDVDVRFPASPDEWLTDRWYPYLIRTDPKLPWLPDHVKRRIRNFETVMNSRWPTTQDMRLPGWGRTLLKSLSSWRYAVGAYDFPGELRLAQRLVRLRQPRLESL

SEQ ID NO: 16796 - protein, 497 aa, Unknown
  Ozonium sp. BT2
MDSFIFLRSIGTKFGQLESSPAILSLTLAPILAIILLLLFRYNHRSSVKLPPGKLGLPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSSSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEEFRPSRFEDEGGHVTPYTYVPFGGGLRTCPGWEFSKIEILLFVHHFVKNFSSYIPVDPNEKVLSDPLPPLPANGFSIKLFPRS

SEQ ID NO: 16797 - protein, 176 aa, Glycine max
  misc_feature (86)..(86): Xaa can be any naturally occurring amino acid
FLFFGSRGGNKPLTSFGDLLANFEKPGLVDFFATRGGPCQFMGPPPKEISPRLKGKKPGGEIVSGKFPSLGGKKRIGALPPFFLFXGGEPFFSFGGAFAADSLLERLEAGPKVKQKPLFNGDPKKVFFWEVWSPPRFGWRGSLVLTSFRPFWRGLCFSKSKGFPPKIFVLFAGAFF

SEQ ID NO: 16798 - protein, 266 aa, Sulfolobus solfataricus
MIYSRSKLPSEGEILIATVKQVFDYGSYVSLDEYGGLQAFLPWSEVSSKWVKNIRDVLKENRKVIVKVIRVDRRKGTVDVSLKKVTDDERRKKNLQWKKIQRLDKILELVSQKLKLSEKDAWEQVAWKLEAKYGDPITAIEKAVKEGEKILIDAGVPEIWVKPLLEEASKHAEERKVKMSGLITVRTNEPLGVEKIKEVISKALENIEQDYESLLNIKIYTIGAPRYRVDVVGTNPKEASEALNQIISNLIKIGKEENVDISVVKK

SEQ ID NO: 16799 - protein, 629 aa, Streptomyces coelicolor
MIIGVVSGQEPEEATPSLSARSTVRWRTFVRTETSSAVFLLAAVAAALVWANVGPHSYEAVWQARFTVGFDTRRLSLTVHEWINSGLMSLFFFVVGLEARRDFDMGELRDRRWLLLSAIAGLGSMIVPALIFVLVNAGRESVHGWGTAMSTDTAFALGVLAVFGSRLPASLRAFLLSVSVVDDLVALLVIAVFYSDEIRLPALLVAVCALLAIALLRLAGVRGALYCAVLSVVVWVALHEAGVDPVVAGLAVGVLVAAYPAPRGDLEQASRLFRLFREQPTPELHRSAVQGLDAAISPNERLEQRFLPWVSFGIVPLFALANAGIELSGPALADAFTSPVTLGIVLGCVVGKVIGTVGSMAAARLLSGGRLRPNVGWGSVTVGGAIAGSAFTVSLLIASLAFDGAELEEARIGILVTLVGAFLTSWAVTAVIGLLPERRRARALLGDVDPLTDLAVPVDRRHDRIRGPESAVVTVVEYGDFECPYCGQAEPVVRDLLGQESDVRYVWRHLPLRDVHPRAQLAAEASEAAARQDRFWEMHDLLLERQNALAAPDLLRYAGELGLDVERFRQDLRDHLGARRVAEDVDSADLSRVSGTPTFFINGRRHHGAYDIAALTRAVELARQRALTG

SEQ ID NO: 16800 - protein, 479 aa, Streptomyces coelicolor
MSTTAQIGVTGLAVMGRNLARNFARNGYTVAVHNRTASRTHALVEEFGSEGDFVATETAKEFVAALERPRRLVIMVKAGDPTDAVIREFAPLLEPGDMIIDGGNAHFADTRRRERELREQGIHFVGTGISGGEEGALHGPSIMPGGSKESYESLGPMLEKISAKAADEAPCVTHVGPDGAGHFVKMVHNGIEYADMQLIGEAYQLLRDVAGYSPAQIAEIFRAWNTGRLDSYLIEITAEVLSHVDGATGKPFVDVVVDQAEQKGTGRWTVQIALDLGVPVSGIAEAVFARSLSGHAALRDASRGLAGPQASPLGESEAAAFADRVEQALYASKIVSYTQGFHEIAAGSEEYDWDIDLGAVSAIWRGGCIIRAAFLDRIRAAYDARPDLPSLLSDETFAQEIAAAQDDWREVLVAATRQGVPTPGFAAALAYYDALRAERLPAALTQGQRDFFGAHTYRRTDRDGAFHTLWGGDRSEVTA

SEQ ID NO: 16801 - protein, 353 aa, Solanum mahoriense
DAWDTSVAIEVKVGDSIEIVRFFHCYKRGVDRVFVDHPMFLEKVWGKTGSKIYGPKAGQDYLDNELRFSLLCQAALAAPRVLNLNCNKYFSGPYGEDVLFIANDWHTALIPCYLKSMYQSRGIYLDAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVTAIHKFIGLDVQIVVLGTGKKKFEQEIEQLEVLYPNKAKGVAKFNVPLAHMITAGADFMLVPSR

SEQ ID NO: 16802 - protein, 353 aa, Arabidopsis thaliana
MARTVSLWRREAVFLTAMLATETGVVGISTLFKVATSKGLNLYAFLGYSYLLASLLLLPSLFFTDRSRSLPPLSLSILSKIGLLGLLGSMYVITGYIGIEYSSPTLASAISNITPALTFILAIIFRMEKVSFKERSSVAKVMGTILSLIGALVVVLYHGPRVFVASSPPYINFRQLSPPLSSSNSDWLIGGALLTIRDIFVSVSFILQAKIMSTYPAAFTVSFLYIVSVSIVTSMIGLVVEKNNPSVWIIRFDITLITIVTMAIITSVYYVIHSWTVRHKGPLYLAIFKPLSILIAVVMSAVFLNDSLYLGCLIGGLLITLGFYAVMWGKANEEKDQLLLVSGKERTPLLLNG

SEQ ID NO: 16803 - protein, 353 aa, Solanum mammosum
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDINTVMDAKPLLKEALQAAVGLPVDRKIPLIGFIGRLEEQKGSDILVSAIHKFIGLDVQIVVLGTGKKTFEQEIEQLEVLYPNKAKGVAKFNVPLAHMITAGADFMLVPSR

SEQ ID NO: 16804 - protein, 112 aa, Ralstonia metallidurans
MKLIIAVIKPFKLDEVREALSDVGVSGITVTEVKGFGRQKGHTELYRGAEYIVDFLPKVKIEVAVPDEVVERAIEAVEKSARTGKIGDGKIFVAPIEQVIRIRTGETGGDAL

SEQ ID NO: 16805 - protein, 426 aa, Zea mays
MPTITHYVLDPFLETGSPAQAEKATPKPPPSPPDKATPVPVATVRARSSPASLYATPESTTLPDSPSSFPGTWSPYIINHKRRGASLAKTFSQGDAGSEGSQPNLPVMLPALPKGGEPTAVQEPEFVFQQSGNDQAEGDSGVDEAPINGKNEMLLKGKGSVTAKIEHEQPEFEFHRGNLEALVNPVNVRRPLNGEAPKISESDTIEWRKPSSPLGTSVGTPGAEFYDAFEEISSDGGTRSSRGMDDDLREMRLSLLMEIERRTQTEEELEIWQQEWKNLSHHLSLVALSLPSPSIAEDSDCLKVDPGAELCQQITVSQLVAAAIARGFARAEVESEMETMIATKNFEIGRLSDRVQYYEAANREMSQRNQEAIEMSRQQQGRKKRQKWFWASVGLAVTLGATAIAWSYVPSSQPRASADSNSTVSD

SEQ ID NO: 16806 - protein, 250 aa, Unknown
  Erythrobacter sp. NAP1
MLSEKRALVTGSTSGIGLAVARALRAEGAEIILNGLGDEGEISRLCEELGATFNGANLMDPAAIEAMMEEVGPVDILVNNAGMQHVSPVEDFPPEKWDAVIALNLSAVFHTTRLAVPGMKAKGWGRIINTASAHSLAASPFKSAYVASKHAIAGFTKTIALELAQDGVTANCISPGYVWTPLVENQIPDTMAARGMTREQVMNDVLLAKQPTKKFVQPEEVGAMAVFLCSDAAGNVTGANWSIDGGWTAE

SEQ ID NO: 16807 - protein, 345 aa, Solanum mapiriense
DAWDTSVAVEVKVGDSIEIVRFFHCYKRGVDRVFVDHPMFLEKVWGKTGSKIYGPKAGQDYLDNELRFSLFCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGYEKPIKGRKINWMKAGILESHRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAIGVAKFNVPLAHMITAGA

SEQ ID NO: 16808 - protein, 531 aa, Unknown
  Synechocystis sp. PCC 6803
MNNQQLWQRYQDWLYYHGGLDFYLDVSRMGFSDALVEDLQPKFAKAFQDMVALEKGAIANPDEQRMVGHYWLRNPALAPNDGIRAEITEPLRQIKAFVADVHQGNIKPPTAPKFTDLLAIGIGGSALGPQFVAQALAPNFPPLAIHFIDNSDPDGIDRVLNCLKAQDKLKSTLVVTTSKSGGTPEPRNGLAETKAVFEAQGLHFADYAVAVTMPGSKLSQQAQTEQWLQAFPMQDWVGGRTSELSAVGLLPAALQGIDIQAMLDGAKTMDEATRVRELRQNPAALLALAWYYAGDGQGKKDMVILPYKDRLLLFSRYLQQLVMESLGKERDLDGNVVHQGIAVYGNKGSTDQHAYVQQLRDGVPNFFATFIEVLHDRQGPSLELEPGVTSGDYLSGFLQGTRQALFENQRDSITVTIPEVDATSVGALIALYERAVSFYGSLVNVNAYHQPGVEAGKKAAASILELQKAILSTLQNESGPIALEALATKVQAPEQVETVYKIVRHLAANDRGVTLQGDRQFPQRLQIQWRS

SEQ ID NO: 16809 - protein, 309 aa, Unknown
  Candidatus Kuenenia stuttgartiensis
MTKIYDDITATIGNTPLVRLNKISKGLDCIITAKMESFNPMASVKDRIGIAMIEAGEKAGLIKKDTVLIEPTSGNTGIALAFVAAARDYKLILTMPDTMSLERRELLKAFGAEIVLTPGSEGMKGAINKAEEMLQNIPNSFMPQQFKNDANPEIHRKTTAEEIWNDTDGQIDIFVGGVGTGGTITGVGEVIKKRKPSLKVIAVEPSGSAVLSGGKPGPHKIQGLGAGFVPEILNTKIIDEIVKVENEQAFALSRQLARDEGILVGISSGAAAYAALQVAARPENKGKLLVVVFPDTGERYLSTVLFKEL

SEQ ID NO: 16810 - protein, 51 aa, Passiflora sexflora
NGEVMPGQWEYQVGPAVGISAGDQLWMSRFILERITEIAGAVLSFDPKPIQ

SEQ ID NO: 16811 - protein, 599 aa, Porphyromonas gingivalis
MENLKNIQPREDFNWEEFEAGGVHAAVSRQEQEAAYDKTLNTIKEKEVVMGRVTAINKREVVINVGYKSEGVVPATEFRYNPELKVGDEVEVYIENQEDKKGQLVLSHRKARAARSWERVNEALEKDEIVKGYVKCRTKGGMIVDVFGIEAFLPGSQIDVRPIRDYDAFVEKTMEFKIVKINQEYKNVVVSHKVLIEAELEQQKKEIIGKLEKGQVLEGIVKNITSYGVFIDLGGVDGLIHITDLSWGRVAHPEEIVQLDQKINVVILDFDEDRKRIALGLKQLMPHPWDALDSELKVGDKVKGKVVVMADYGAFVEIAQGVEGLIHVSEMSWTQHLRSAQDFLHVGDEVEAVILTLDREERKMSLGLKQLKPDPWADIETRFPVGSRHHARVRNFTNFGVFVEIEEGVDGLIHISDLSWTKKIKHPSEFTEVGADIEVQVIEIDKENRRLSLGHKQLEENPWDVFETVFTVGSIHEGTVIEVMDKGAVVSLPYGVEGFATPKHMVKEDGSQAVLEEKLPFKVIEFNKDAKRIIVSHSRVFEDEQKMAQREANAERKAEAKAAQKEAAAEAANPAQAVEKATLGDLGELAALKEKLSEN

SEQ ID NO: 16812 - protein, 208 aa, Unknown
  Magnetococcus sp. MC-1
MLFMKKKITMVAPQEALPGRGIPMPVEDQHWVLKTPMRGPWPGMQQLLVGMGCFWGAERRFWQQPGVHMTAVGYAAGYTPNPTYEEVCANKTGHNEVVLVVYDPQQTDLERLLRLFWEAHNPTQGMQQGNDVGTQYRSGIYLAHEAELALALATRDAYQQRLSGAGLGTITTEILPMPPFYYAEAYHQQYLAKNPGGYCGLGGTGVVF

SEQ ID NO: 16813 - protein, 254 aa, Unknown
  Azoarcus sp. BH72
MAKVTLVGAGPGAADLLTVRAVRAIGQADVLLADALVTEEVLALAKPGARVLRVGKRGGMKSTAQDFIHRVMARYARRGCAVARVKGGDPFLFGRGGEEAEYLEALGIEVEVVPGLTSGIAVPAAVGIPVTHRAHTHGVTLVTGTAGDGRDEPNWAALAKCGTTLVIYMGLGRLLNIVARLIAAGMPPDTPAAAIASGTLPGQRHVKGTLADLPLRVTAEGLSSPAIIVVGEVAALARVPGLAMDESDVRALAA

SEQ ID NO: 16814 - protein, 415 aa, Unknown
  Azoarcus sp. BH72
MRKQKLVMVGNGMAGVKTLEELLKHAPDAFEITVFGAEPHGNYNRILLSPVLAGEMSLPEIMLNDIGWYRAHGITLHAGRRVVEIDRARRIVRADDGTEAAYDRLLLATGSAPFILPVPGRELPGVIAYRDIADTEAMIDAARQHRHAVVIGAGLLGLEAANGLVLRGMDVTVVHLGGWIMDRQLDQPAAELLQASLEAKGMRFRLQAQTAALLPGTGGRVAAVQLQDGSTLPADLVVMAAGIRPNTALAEAAKLRCERGIVVHDTLQTVTDPRIYAVGECVNHRGTAYGLVAPLFEQARVCANHLAGHGIGRYTGSVTSTKLKVTGVDVFSAGDFMGGEGCDEIVLHDRAGGIYKKLVLKENRLAGAVMVGDTADGAWYFQLVREGGDVSALRDHMMFGQRFTQSQLAGAACPG

SEQ ID NO: 16815 - protein, 137 aa, Spinacia oleracea
MATITASSSASLVARASLVHNSRVGVSSSPILGLPSMTKRSKVTCSIENKPSTTETTTTTNKSMGASLLAAAAAATISNPAMALVDERMSTEGTGLPFGLSNNLLGWILFGVFGLIWALYFVYASGLEEDEESGLSL

SEQ ID NO: 16816 - protein, 308 aa, Daucus carota
MDFFPANFMLHHHQEQDHRRNHIQNPASQFIDSSQNLLPPQDFHGTIGSFLGKRSMSFSGGDHHQQQLNEESNIHGDHVDDLSDPEDDDGSGTVGSGGSKKRRLNMEQVRTLEKSFEMGNKLEPDRKLELARALGLQPRQIAIWFQNRRARWKTKQLEKDYDLLKSQFDAVKAENDSLQSHNQKLHAQIMALKNGEPTESINLNKETEGSSSNRSTENSSEIKPDFSRTSPAIDSHPHKLTSIPLFPPPNNNNKSSFFRLQQPAAFHMSRPSDHPHQQSVKEEHFCNMFTGVEDQTAFWPWLEQQPFN

SEQ ID NO: 16817 - protein, 924 aa, Unknown
  Azoarcus sp. BH72
MEPHMNLADLGLKANETRSVCCYCGTGCGVIVERDGGRITGVRGDPAHPANFGRLCTKGSTLHLAAAPGGRALYPELRSTRADSRRRVGWDEALDTAADRFAVIIREHGPDAVAFYISGQLLTEDYYVFNKLARALVGTNNIDSNSRLCMSSAVAGYKGTLGTDSVPASYEDLALADHLLITGANPAWAHPIVFRRIEEAKRANPDLFITVIDPRRTETAEFADLHLQIAPGTDVLLYNAMLHVLLWEDLIDRDFIRDHTSGFDALREQLADCSPAKIAGLCGVPADKIVEAARRFGKARGAVSLWCQGLNQSHHGVANNSALIHLHLATGQIGRPGAGPFSLTGQPNAMGGREVGAMATILPAHRDPANADDRADLARLWGVPALPEAPGLAAVQMFDAIGEGRIKAVWIACTNPAQSLPDQDKVRAALDKAEFVVVQEAFADTETVPYADLLLPAASWGEKSGSVTNSERRVSRVRGVVPAPGEARPDWAIAADFARRLQARLAPAAAAGFDWADEAAVFAEHVSLSAGRDCDMSGLSYGVLEALGPQQWPYPQGAGGGTPRLFTDGRFNTADGRARFNPVGFPVRHAPLPEPTDAAHPFVLTTGRLRDQWHGMSRTGKVAALWGHTPRAEVAVNPADLDRRGLAAGQLVKVASRRGALVLPVAADSGVAPGQAWIPMHWGGATLAQSGTNLVTSAATDPVSKQPALKQAAVSIAPVDFGWRAAWAAQARDGAEAVAWMAALQPRLAAFGYAALSLAGRERSVVVLQVADTAPAPAERLADIDQLFGCVAEDHAVLAFRDSRRGIDKRARIADGTLVAIRLVGEVAAADWLIAAIVAGEPAEPLRPWLFAPLSRPPAGLARAERTVCNCFGIGEQQIREAIGGGADLDALQGALKCGTACGSCLPALRRMVAEGAVAEVAGA

SEQ ID NO: 16818 - protein, 394 aa, Ashbya gossypii
MPATSLDLSDHSYLDSALSATLDSTDAFEGPEKLLEVWFYPSVSALPNAKGLRSISLDEWCSMLELVKCEVLSSKKTAHMDAFLLSESSMFVFEHKLTLKTCGTTTTLLCLPRLLAMVESHLGWVMKSPGSDKFHPYKVFYSRRCFMFPSKQHPIHRNWGDEVDYLNQFFLGGKSYVIGRSDQNDHWNLYITETNKTLASGLTSDERDETLEILMTGLDSGSARQFVADRTQSPSEEGLAACNAPGHVYGLEITKATGLDCVYDNQKSVPFVHDAFAFMPCGYSSNIIMDDKYYYTLHVTPEDGWSYASFESNVPVQDVSCGRQTQHDIVCRILDVFRPTDFCMTFFAKDLLSDRILQLMHLLDSLPNYVKRDKVIHELDEYQLIYLRYQRPAQ

SEQ ID NO: 16819 - protein, 271 aa, Wolinella succinogenes
MVTMKDLLECGVHFGHQTRRWNPKMKKYIFGVRKNIHIIDLQKTLRYFRYTYNVVRDAAAEGKTVMFVGTKKQASETIKQYADTINAPYVNYRWLGGMLTNFSTIKKSIRKLEVIEEMEASGQIELLTKKEKLMLTRKKEKLEKYLGGVRHMKKAPDMLFVVDAAKEKIAVAEARRLGIPVVAPLDTNCDPDVVDFPIPGNDDAIRSIQLFCKEMAEAIQEGRALAGSEEGEATEEVTPASEAEKQEVLAEAMSEEGDALQESEVVEEEEK

SEQ ID NO: 16820 - protein, 376 aa, Zea mays
MSAEPTSPPLSTAQVRGSLIPPLPDDLAVHCIALLPRAAHPSLALVSRAFHALLCRHPEPLLAARRTLRCSEPHVLLSLRPPSSASPIFFLLLPHPGWPPLPLPSPPVPVSSSASAATDGARLFLVGGSVSAVPSASVQILDPRARSWSAGPRLSSTREFAAAVAHSGALFVAGGCIPSSPFWAEALDLSTPNAKWRAVASPAHLREKWMHGCASLDGKVVVVADRGGLSYDPSAPPAEAWAPVSPVLDMGWKGRAAVVEGILYSYDYLGQVKGYDPYTDSWSTVEGLEGELPKFLCGATLADVGGLLYLGWEGKWKGKLKGKMEMRSMVVIEWASIQITRVQEGRLRGKVVSRDTVLFPDMPRGSTITHCIALEL

SEQ ID NO: 16821 - protein, 219 aa, Unknown
  Populus alba x Populus tremula var. glandulosa
MTDVKLHGFWASPFCYRVIWALKLKGVEFEHIEEDLTNKSELLLKYNPVYKKIPVLVHGGKPIAESLVILEYIEETWPENPLLPTDPYERAMARFWIQYGVTKGAALVALYRASGEELEKAVKEVVEVLRVLEEQGLGDKKFFGGDSINLVDISYGLFTCWFAAMEEAMGVKVLEPSTLPRLHAWAQNFIEVPLIKENIPDNDKLLLFMKGFREKLVNE

SEQ ID NO: 16822 - protein, 639 aa, Unknown
  marine gamma proteobacterium HTCC2143
MQKKFIGLSKAQISSAIESADLRVLLMVIFHLTGDKSWLQEPYLPSRDVRLIADESAGFSEHIQAVIRAEAVKLLSAEELTAVVEDPGDELMLTLMQTCLGERIPAEYAPMMREQMGFCSPLEDIPVTASSALKRKPVVIVGAGVSGLAMGTTLKQLNIPFIIVEKNAEVGGTWWQNRYPGCGVDTPNHAYSFSFGERYRWDRYFAPREQLQDYMQHTATAMGLRPSIRLQTEFKKARWNEQKQCWDITISDSQGTEEIEAVALVTAIGQLSLPAIPVITGIKDFAGTIFHTANWPSGLDLKGKRVAIVGTGASAMQIVPTIADDVSSLTIYQRGAQWARPIPRYHDSISEDGQWLLEKVPFYAAWFRFAMFWRYGDGLLPSLHKDPEWAHPERSLNRSNDRHRQEMTDYIVSSLGDRDDLVEKCLPDYPPYGKRILLDNGWYDTLRKPQVELVTDKISHVDSGGVHTQTGDQREADIIILSTGFQVGLLSARLDIVGRDGTSLEHHWGPDNPKAHLGINVAGFPNLFCTQGPNTGLGHGGSAIFQSECQAKFIGACLARMNANNISSIDIKQDAQDQYVARVDAEHEKMIWTHPGMSTYYRNEAGRVVSVMPWRLVDYWKMTSTPNFDDFRQTVSSLD

SEQ ID NO: 16823 - protein, 175 aa, Glycine max
  misc_feature (84)..(84): Xaa can be any naturally occurring amino acid
ASSMISSPAVTTVNRAGARMVAPFSALKNMDGFPTTNTNNDITSIGINGGTPQCMQEWPTLGYKKYDTLSYLPDLDDALLTKEXKYLLKNGWIPCLEFQLEHGFAYRDHDRSPRYYDGRYWTMRNLPMFGCTDAYHVIKDLQEVNTVYPNGFIRIIEFNNFLQEQRISFIAYKTP

SEQ ID NO: 16824 - protein, 112 aa, Bdellovibrio bacteriovorus
MKKIEAIIKPFKLDDVVDALSEVGVEGITVSEVRGFGRQKGRTEVYKGAEYVVDFLPKIKIEVVLPTALVDSAVEAIRKTAHTGKIGDGKIFVLPVDSALRIRTGEKDEQAL

SEQ ID NO: 16825 - protein, 488 aa, Solanum tuberosum
RTRHNRPAIREPVKPRVPLRLLFRVASVAGGIQFGWALQLSLLTPYVQELGIPHAWASIIWLCGPLSGLLVQPLVGHMSDKCTSRFGRRRPFIVAGAVSIMIAVLIIGFSADIGWLLGDRGEIKVRAIAAFVVGFWLLDVANNMTQGPCRALLADLTQKDHRRTRVANAYFSLFMAIGNILGFATGSYSGWFKIFPFTLNTACTINCANLKAAFIIDIIFIATTTCISISAANEQPLDPSRGSSHTREEIGESSHGQEEAFLWELFGIFKYFPGVVWVILLVTALTWIGWFPFLLFDTDWFGREIYGGEPNDGKNYSAGVRMGSLGLMLNSVLLGLTSLFMEKLCRKWGAGFTWGVSNVVMSLCFIAMLIITAVRSNIDIGQGLPPDGIVIAALVVFSILGIPLAITYSVPYALVSSRIDALGLGQGLSMGVLNLAIVFPQIVVSLGSGPWDELFGGGNSPAFVVAALSAFAGGLIAILAIPRTRVEK

SEQ ID NO: 16826 - protein, 262 aa, Zea mays
  misc_feature (100)..(100): Xaa can be any naturally occurring amino acid
  misc_feature (117)..(117): Xaa can be any naturally occurring amino acid
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRXRRVVLLFAAEVAFVVAXAALVLTLAHTHERRSMLVGIVSVFFGTGMYAAPLSVMKLVIQTKSVEYMPLFLSLASLANSICWTAYALIRFDLYITIPNGLGVLFALGQLGLYAMFYKNTKQIMEARRRKADQQSTMMEVVTDASATPPPPPNNNNGGGGGNGY

SEQ ID NO: 16827 - protein, 320 aa, Crocosphaera watsonii
MKIAHNITELIGHTPLVQLNRIPQAEGCKAQIVVKLEGMNPAASVKDRIGVNMINAAEKEGFIIPGKTLLVEPTSGNTGIALAMAAAAKGYKLILTMPETMSQERRAMLKAYGAQLELTPGSEGMGGCIRRGQELAETLPNAYMLQQFNNPANPEIHRLTTGEEIWEDTDGRVDFLIAGVGTGGTLTGVAEVIKQKKPSFQAIAVEPTSSPVLSGGSPGGHKIQGIGAGFVPGVLKVELIDEVVTVTDEEAMSYGRRLAKEEGLLSGISTGAALCAAIKVGQRPENIGKLIVMVQPSFGERYLSTPLFQDVEPPQLAMVH

SEQ ID NO: 16828 - protein, 164 aa, Cytophaga hutchinsonii
MATVDKTQSIYSIKVTTLDGQPFDLSTLKGKKILIVNTASKCGYTPQYEELQQLHALHGDSVAVLGFPCNDFGGQESGSESEIGAFCTKNYGVTFQMFEKVHIKGNEQHPLYKWLTDPALNGWNKDAPTWNFCKYLINEKGELVNFFGSGVKPMSKTVLDAIRK

SEQ ID NO: 16829 - protein, 461 aa, Helicobacter pylori
MIKQTLIILAPFFIATLLYFLGAPDGLRPNAWLYFCIFMGMIIGLILEPVPSGLIALSALVLCIALKIGASDKVASANKAISWGLSGYANKTVWLVFVAFILGLGYEKSLLGKRIALLLIRFLGQTPLGLGYAIGLSELCLAPFIPSNSARSGGILYPIVSSIPPLMGSTPNNNPDKIGAYLMWVALASTCITSSMFLTALAPNPLAMEIAAKMGVNEISWFSWFLAFLPCGVVLILLVPLLAYKTCKPTLKGSKEVSLWAKKRNRAWGGFLKKFCSALPYWLYWVGFLANLACMRVRRLLSWFWRFVRLAMKTSLKTRARSIFFYCLDRCSRWLAGLKMGFILSAMRLKIFSMLTWIRRSCLLPSFICRIIFSQASPLMARYSRFLGLVRTFKGSICKNACFCFLGLWGFRPMAQAHPPFITGAGIFKARIFGNGGLFLAFCISCFACAHLGSNSSLIGG

SEQ ID NO: 16830 - protein, 670 aa, Ipomoea tricolor
MAENPGGAAHLQSLLQTAVQSVHWTYSLFWKLCPHNGMLVWSDGYYNGAIKTRKTVQGTEVSAEEASLHRSQQIKELYESLSATAEESNGGGQQPARRPSAALSPEDLTESEWFYLMCISFSFPSAVGLPGKAYAKRQHIWLTGANEVESKVFSRAILAKSARIQTVVCIPLMDGVVELGTTERVKEDYEFIQHIKNHFMEPQPHHHHPKPALSEHSSSEPPSQQLHSPVMASGHHHHHHQVRAEDEDEEEEEDEEEEEEEEEDDDDDDDEAEELESDADVGPKNHQTGDHVMAAAEEEENINAMVAETNVGASELMQFDMSESIRVGTPPDDASTDLDSDFHLLPQMPHCQNPTFLSQGAPMEEFPREDTHYSETISSILRHQCGQWSDDFSTTVAAADYVVHSASSAFSRWTTAASSTCSSHRSAQWALKYTLLTVPFLQAKNSHGGGAADTIPSSKLCKAAPQEEPNVNHVLAERRRREKLNERFIILRSLVPFVTKMDKASILGDTIEYVKQLRRRVQELEAARGNPSEVDRQSITGGVTRKNPAQKSGASRTQMGPGLNKRGTRTAEGGGRPANDTEEDAVVHVEVSIIESDALVELRCTYRQGLILDVMQMLRELGLEITTVQSSVNGGIFCAELRAKVKENMKGRKATIMEVKKAIHSIIPQF

SEQ ID NO: 16831 - protein, 343 aa, Unknown
  Coffea arabica x Coffea canephora
MAGAEPQFKATMLLLGLLLVATLDFTGAQTGVCYGRLGSNLPSPADVVALCNQRNIKRMRIYDPHQPTLQALGGSNIEVILGVPNTDLQNVAASQANANNWVQINVRKYPNVKFRYIAVGNEVSPLTGTAQYTNFLLPAIRNIFNAVSAAGLRNQIKVSTAIETGLVANGYPPSAGTFQPQAQNFIKPIVQFLAGNGAPLLVNVYPYFSYTGNPKSIALEYALFTSSGITTPDGVKYQNLFDALVDATYSALEKAGGSSVQIVVSETGWPSAGGQATSIDNARTYNNNLIKHVNGNSGTPKRPGRAIETYIFDLFDEDQKSPEYEKHFGLFLPNRQPKYPISF

SEQ ID NO: 16832 - protein, 353 aa, Solanum montanum
DAWDTNVAVEVKVGDNTEIVRFFHCYKRGVDRVFVDHPMFLEKVWGKTGSKIYGPKAGKDYLDNELRFSLLCQAALEAPRVLNLNCSKYFSGPYGEDVLFVANDWHTALIPCYLKSMYQSRGIYLNAKVAFCIHNIAYQGRFAFSDFPLLNLPDEFRGSFDFIDGYEKPVKGRKVNWMKAGILESHRVVTVSPYYAQELVSAVDKGVELDNVLRKTCITGIVNGMDTQEWNPATDKYTDVKYDITTVMDAKPLLKEALQATVGLPVDGKIPLIGFIGRLEEQKGSDILVAAIHKFIGLDVQIVVLGTGKKEFEQEIEQLEVLYPNKAKGVAKFNVPLAHMITAGADFMLVPSR

SEQ ID NO: 16833 - protein, 968 aa, Prochlorococcus marinus
MSKAELKDFTFKSRHIGPTNEDEALMLQHLGYENAEEFISSVIPNEIFDSENNGVSIPDGCDQNKALTEINIISKKNVEHRSLIGLGYHSTVIPPVIQRNVLENPNWYTAYTPYQAEISQGRLEALFNFQTLISELTGLPISNASLLDEATAAAEAISLSLTVRKNKNANKFLVDQEILPQTLDVLKTRCEPLGISLEMFDNNNFEIDKNVFGILIQLPGKNGRIWDPTKIINDAHKCNAIVTIAIDPLAQVLIKPMGEFGADIVVGSAQRFGVPIAFGGPHAAFFATKEIYKRQIPGRIVGQSVDVEGNQALRLALQTREQHIRRDKATSNICTAQVLLAVLSSFYAVHHGPKGLKQIAENVVKYRSNFESILMNLEYPIEKYSAFDSVDVYCSEASEVIQLASEEGYNLRVLPIGSDFENAKGFGVTFDELTCDEEIYKLHQILAQVKGKKTHDLSNFIFENASLIDIPLREKSWLEQSVFNQYQSETDLMRYIHCLVSKDFSLVQGMIPLGSCTMKLNAAAELLPIEWREFSSIHPFAPHTQLTGFHEIINDLENWLSALTGFQGVSLQPNAGSQGEFAGLLVIRSWHQSLGEGHRNICLIPTSAHGTNPASAVMSGFKVVSVKCDEYGNVDLEDLKNKSKIHSKNLAALMVTYPSTHGVFEPNIREMCQVIHQEGGQVYLDGANLNAQVGICRPGSYGIDVCHLNLHKTFSIPHGGGGPGVGPIAVADHLVPYLPGHSIIKCGGQKAISAVSAAPFGSAGILPISWMYIRMMGSDGLRKASSIAILSANYLAKRLDPYYPVLFKDPNGLVAHECILDLRPLKSQLGIEVEDVAKRLMDYGFHAPTISWPVAGTLMVEPTESESLPELDRFCDAMIGIREEIEQIKLGKIDPINNPLKQSPHTLKTVTSDDWDRPYSRKEAAYPLPDQEKYKFWPSVSRINNAYGDRNLICSCPSVQDLEDINSV

SEQ ID NO: 16834 - protein, 968 aa, Unknown
  Magnetococcus sp. MC-1
MESPAAQLSQAQAYLQQGQLQQAINSYQNLLAQHPESVAAWQGIGSALLAAGQPLQAVDFFERALALDPQHYPSILALGTLYQQQGRLERAVQLFLRGAQLQPNQPLVHFNLGVVLAAQGRTEQAQSAYRKALALNENIPEAWLNLGNLLSRTGELQQALVCYQQALQRRPSFTQAGFGLANTLTTLKRHTEALTILEPLCQQNPDHAEMMILYGHLLRSQNRQHQARSVFQRILAQQPNHFAARYGYATILLDLGRADLALPQMQQAARLNPSHQGLRSDLAFAQHYLSTSPKALYHEHRLFQTLIAEALSQQSMRHQPCKEPHKPLKIGFVSSDFRRHPVSFFLEAPFEHHDGESFAFYGYSNSPVRDATTQRLQGWAQAWREIFGLTDSVVAQQIVADGIDILVDLNGHTGGNRLALFALQPAPVQVSWLGYPDTTGLEAMAYRLTDTISDPESEGGRYMSETPIYLPHGFHCYRPPDEAPKVLYQQLRTGQGVRLASFNTLTKMGHEVLRLWAEILTRLPQATLLLKNGGFGSQAVVDDYLQRFESLGIDSKRIRCMGVTDTLEEHLNLYNQVDIALDTFPYHGTTTTCEALWMGVPVVTLQGDHHVNRVGGSLLHQVGLHKLVASTPKQFVDLVVGLAQDHKRLRTLRGSIRHKMQNAPLRDELGFTRNLENAFRQIWKMACATPTVSAPQPAYWMDLAPAEKKPTLRLIHHLARSGGTLICKCLGSMEQAMLLSEINPRGVHRFNPRQQAHQWYAVGDANRAESMPWDDEEAFLEAMQEIHAAAQHRNANLLVRDWTHVDFTGYPFRRPQWHLTLAETLSKRFRVRSLFTTRHPLDQWLSLVKYAQQGGAGVSVSLSLYMEGYRRFAQLCADHGFVRYEDFTVDPDARLQEMCEKLEIPFDAGYQQRWASYTNITGDTIGTRGAQQIKPLSRRPVEAGLHRQLQENSDYQQILSLLGYQDVE

SEQ ID NO: 16835 - protein, 320 aa, Burkholderia xenovorans
MTTQQQPLISGFGVETQPEEVMAGIDLHGKVAIVTGGHSGIGLETTKALVKAGAKVVVGARGVDKAMESLAGLENVDVVELNLADPDSVDNFATSYLRTHNSCDILVNNAGIMATPLTRDSRGYELQFATNHLGHFQLTVQLWDALAVAGSARVVALSSLGHRFSAINFDDLNYLTRPYDPWRAYGQSKTANALFAVHLDRLGKGAGIRGFAVHPGRIPTTNLSRHMTDEEKKAATQAVQVGPDYVPSPLKSIAQGASTSLWAATSAQLSGKGGVYCADCDISPIVADDSPDVRGVRRWAIDPDQAVRLWDVSLDLVARR

SEQ ID NO: 16836 - protein, 294 aa, Saccharomyces cerevisiae
MKTLVHVASVEKGRSYEDFQKVYNAIALKLREDDEYENYIGYGDDLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 16837 - protein, 278 aa, Pseudomonas stutzeri
MDQPLTFPAALSAAFAPGEVALVGAGPGDPGLLTMRAWSLLQQADAVVYDRLVSDGLMALLPASCSRHYVGKTSGYHSLPQPEINQLLVDLALQNKRVVRLKGGDPFIFGRGAEELEFLLQRGIDCQVVPGITAAAGCSAYAGIPLTHRDLAHSCQFITGHLQTNGELHLPWDALAQGGQTLVFYMGLASLGEISRNLISAGLPVDTPAALIGNGTRENQQVVRCTLRQLPSMADEQHLTPPTLTVIGRVVSLFADRQVEHPARLHGDPAPKAEALCN

SEQ ID NO: 16838 - protein, 356 aa, Zea mays
MACLTDLVNLNLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHREHIAAYGEGNDGRLTGRHETADINTFSWGVANRGASVRVGRETEQNGKGYFEDRRPASNMDPYVVTSMIAETTIIWKP

SEQ ID NO: 16839 - protein, 336 aa, Streptomyces avermitilis
MSTPVKAAVFGTGSWGTAFGMVLADAGCDVTLWARRAELADAVNSTRTNPDYLPGVELPENLRATTDPAEAARAADFTVLAVPSQTLRGNLAEWVPLLAPDTVLVSLMKGVELGSAMRMSEVVEDVAKVGADRIAVVTGPNLAREIAARMPAAAVVACANEAVAQRLQAACHTPYFRPYTNTDVVGCELGGAVKNVIGLAVGIADGMGLGDNAKGSLITRGLAETTRLGLVMGADPLTFSGLAGLGDLVATCSSPLSRNHTFGTNLGRGMTLQETIAVTKQTAEGVKSCESVLDLARRHGVDMPITETVVGIVHEGKPPVVALKELMSRSAKPERR

SEQ ID NO: 16840 - protein, 132 aa, Bacillus licheniformis
MSIEVGSKLQGKVTGITNFGAFVELPGGSTGLVHISEVADNYVKDINDHLKVGDQVEVKVINVEKDGKIGLSIKKAVDRPQSSRPARPKNDFRSKETFEQKMNKFLKDSEDRLSSLKRNTESKRGGRGARRG

SEQ ID NO: 16841 - protein, 446 aa, Shigella boydii
MSKQQIGVVGMAVMGRNLALNIESRGYTVSIFNRSCEKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVHRALYLGKIVSYAQGFSQLRAASEEYNWDLNYGEIAKIFRAGCIIRAQFLQKITDAYAENPKIANLLLAPYFKKIADDYQQALRDVVAYAVQNGIPVPTFSAAVAYYDSYRAAVLPANLIQAQRD

SEQ ID NO: 16842 - protein, 377 aa, Unknown
  Oceanospirillum sp. MED92
MSKRDYYEVLGVSRDSSDRDIKKAFRRMAMKYHPDRNPDDKEAEESFKEVNEAYEVLSDAQKKAAYDQYGHAGVDPNMRGGHGGGFEGNFSDIFGDVFGDIFGGGGGRGGRSSVQRGADLRYNMEMTLEEAVRGVEKEIRVPTLVGCETCDGSGAKPGTSAKICGTCGGQGQVRMQQGFFSVQQTCPTCHGEGKVISDPCNDCHGHGRIEKTKTLNVKIPAGVDTGDRIRLAGEGEAGTHGGPAGDLYVQVHVKDHPIFERDGKHLYCEVPISFVDAALGGELEVPTLDGRVKLKVPSETQTGKMFRLRGKGISPVRGGSTGDLLVKVVVETPVNLSSRQKELLREFQDEMEQGTHKHSPKKHGFFDSVKKFFEDMT

SEQ ID NO: 16843 - protein, 204 aa, Gossypium herbaceum
VKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 16844 - protein, 438 aa, Thermus thermophilus
MRVFIDEIARHVDQEVELRGWLYQRRSKGKIHFLILRDGTGFLQATVVQGEVPEAVFREADHLPQETALRVWGRVREDRRAPGGFELAVRDLQVVSRPQGEYPIGPKEHGIDFLMDHRHLWLRHRRPFAVMRIRDELERAIHEFFGERGFLRFDAPILTPSAVEGTTELFEVELFDGEKAYLSQSGQLYAEAGALAFAKVYTFGPTFRAERSKTRRHLLEFWMVEPEVAFMTHEENMALQEELVSFLVARVLERRSRELEMLGRDPKALEPAAEGHYARLTYKEAVALVNRIAQEDPEVPPLPYGEDFGAPHEAALSRRFDRPVFVERYPARIKAFYMEPDPEDPELVLNDDLLAPEGYGEIIGGSQRIHDLELLRRKIQEFGLPEEVYDWYLDLRRFGSVPHSGFGLGLERTVAWICGLAHVREAIPFPRMYTRMRP

SEQ ID NO: 16845 - protein, 203 aa, Glycine max
  misc_feature (139)..(139): Xaa can be any naturally occurring amino acid
MAEHLASIFGTEKDRVNCPFYFKIGACRHGDRCSRLHTKPTISPTLVLSNMYQMFYMNMNIITNPDQPQPQSLDPDKVQDHFDDFYEDLFEELSKYGPIQSLNICDNLADHMVGNVYVQFREEDHAANALMNLTGRFYXRQYEENVCNRGGYCNFMHLKKISRDLRRKLFGRNRRWNGRSGSRKQSPRESYHGGAFTFWSWFW

SEQ ID NO: 16846 - protein, 531 aa, Zea mays
MEAVGVTPAPVAAPEKKKLLDLKDPFPAAANGGAKASPAGKWAMKKKLVGGDAGYVLEDVPHLTDYMPQLPTYPNPLQDNPAYSVVKQYFVNPDDTVTQKIVVHKTSARGTHFRRAGPRQRVYFQSDEVNAAIVTCGGLCPGLNTVIRELVCGLYDMYGVSSVVGIEGGYKGFYSKNTVALTPKSVNDIHKRGGTVLGTSRGGHDTAKIVDCLQDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFVERRLKDNGHMVIVVAEGAGQDLIARSMNFVDTQDASGNKLLLDVGLWLSQKIKDHFKKKPSFPITLKYIDPTYMIRAVRSNASDNVYCTLLAHSALHGAMAGYTGFTVAPVNGRHAYIPFYRITEKQNKVVITDRMWARVLCSTNQPCFLSHEDVENMKHDDDEHHHMHNTQLLEGGSSPVSKCNGSAAAV

SEQ ID NO: 16847 - protein, 214 aa, Glycine max
MSSSSTTLSLDHLPPSEQLCYVHCNICDTVLAVSVPCTSLFKTVTVRCGHCTNLLPVNMRGLLMPSPTQFHLGHSFFSPSHNLLEEIPNPSPNFLMNQTNLSASNEFSMPARIAADELPRPIMNRPPEKRQRVPSAYNRFIKDEIQRIKSVNPDITHREAFSAAAKNWAHFPHIHFGLMPDQTVKKTNVCQQEGEEVLMKDGFYASANVGVSPY

SEQ ID NO: 16848 - protein, 435 aa, Leuconostoc mesenteroides
MTEEIPKIKIIDAKNFVGKTVTIGAWLRQKRGSGKIAFLQLRDGTAFFQGVVAKADVSEEVFETAKSLKQETSIYVTGEIHEDARSSFGYEMAVSDIKVIGESHDYPITPKEHGTEFLFDERHLYLRHLKPFATLKIRNTLVAATYEFFNKEGFTKLDAPVLTGSAPEGTTELFETDYFGEPAFLSQTGQLYAEAGAMAFGKVFTFGPTFRAEKSKTRRHLTEFWMIEPEMAFMDQEESLKLQERYIAFLISKVLENNDQELDILKRDKGLLRSYTQLPYPRVSYDDAVKLLQDNDFDVEWGVDFGSPEETFLANHFAKPVFIVNFPKAIKPFYMKRHKTRDDIVVSADLLAPEGYGEIIGGSERDTDYDYLKNEIEKLGLNMDEYAWYLDLRKYGSVPHSGFGLGLERMVTFVTGEEHIREAIPFPRMTNRLRP

SEQ ID NO: 16849 - protein, 228 aa, Pinus taeda
MGRRPARCYRQIKNKPYPKSRYCRGVPDPKIRIFDVGAKKRLVDEFPFCVHLVSWEKENVSSEALEAGRIACNKYMVKFAGKDGFHLRVRVHPFHVLRSNKMLSCAGADRLQTGMRGAFGKPQGTCARVAIGQVLLSVRSRDNHSNHAQEALRRAKFKFPGREKIIVNRKWGFTKYTRADYLKWKTENRIVPDGVNPKLLGCRGPLSNRKPGQAFLKPAVVLSSDLVA

SEQ ID NO: 16850 - protein, 625 aa, Cryptomeria japonica
MSCSARLVVDSYTHSRVPLGESSQWRHQSLSRTSNFHRLHRHVDIRARVVTPTTPIEQKPIIQTSTPTSNSTSTSLTWRSDPDRRFEIPNRVFPGMGKKKSKSESCGWNPVQRLAAAALDAVEKSFIMALEKKFPLPKTADPEIQIAGNFSPVPESPVQHELEVVGQIPQCLEGVYVRNGANPLFEPLAGHHFFDGDGMVHAVRLKQGIASYCSRFTRTYRLVEEEKLGRAFYPKAIGELHGHSGIARLMLYYARSMFGLVDRSKGMGVANAGLIYFNGRLLAMSEDDLPYAVRVTEDGDLATLGRFDFDGQLQSAMIAHPKIDPETKELFALSYNVIKKPYLKYFMFSPDGRKGPDVTISVKEPTMMHDFAITDKYVVVPDQQLVFKLQEMVAGGSPVIYDKEKVPRFGILPKYDSDESRMKWIEVPDCFCFHLWNAWEENEDEVVVIGSCMTPPDSIFNESDAALRSVLSEIRLNLKTGKSSRRQLAPMNLEAGQVNRNKLGRKARYVYLAIAEPWPKVSGIAKVDLEAESPERVVGKIEYKKGCYGGEPFFVPRTSNPEAPEDDGYVLTFMHNEETWQSELLILDAKSPTLEPVASVKLPSRVPYGFHGTFITSQELDQQVL

SEQ ID NO: 16851 - protein, 284 aa, Unknown
  Burkholderia sp. 383
MPVRFDRPPPPRRQRAIDRRMQAALEHDMTTGKVTLLGAGPGEPDLLTLKAVKALAAADVLLLDDLVAPGIVELAPQARVIRVGKRGGCRSTPQAFIEKLMRRYALRGAHVVRVKGGDALLFGRAGEELATLRAAAIPVEIVNGISSGFAAAASLGISLTHREHCQGVTFVTAHRQDHGEPDWARLAATGTTLAIYMGMSRVDSIAAGLLAVLSPSTPAAAVQWAGTPDERRWTGTLGGLARGIDEARLGSPAVILVGGAIGEAAVQHVPDAGAAIETALSRAA

SEQ ID NO: 16852 - protein, 625 aa, Cryptomeria japonica
MSCSARLVVDSYTHSRVPLGESSQWRHQSLSRTSNFHRLHRHVDIRARVVTPTTPIEQKPIIQTSTPTSNSTSTSLTWRSDPDRRFEIPNRVFPGMGKKKSKSESCGWNPVQRLAAAALDAVEKSFIMALEKKFPLPKTADPEIQIAGNFSPVPESPVQHELEVVGQIPQCLEGVYVRNGANPLFEPLAGHHFFDGDGMVHTVRLKQGIASYCSRFTRTYRLVEEEKLGRAFYPKAIGELHGHSGIARLMLYYARSMFGLVDRSKGMGVANAGLIYFNGRLLAMSEDDLPYAVRVTEDGDLATLGRFDFDGQLQSAMIAHPKIDPETKELFALSYNVIKKPYLKYFMFSPDGRKGPDVTISVKEPTMMHDFAITDKYVVVPDQQLVFKLQEMVAGGSPVIYDKEKVPRFGILPKYDSDESRMKWIEVPDCFCFHLWNAWEENEDEVVVIGSCMTPPDSIFNESDAALRSVLSEIRLNLKTGKSSRRQLAPMNLEAGQVNRNKLGRKARYVYLAIAEPWPKVSGIAKVDLEAESPERVVGKIEYKKGCYGGEPFFVPRTSNPEAPEDDGYVLTFMHNEETWQSELLILDAKSPTLEPVASVKLPSRVPYGFHGTFITSQELDQQVL

SEQ ID NO: 16853 - protein, 409 aa, Arabidopsis thaliana
MGSLRRSTSNRSRKKGTAVKMNRMPSSLSPPTPPCSAIVGGTGKSKKRRGGVCLWTRFDRTGFMEVAGCDKSTIIERSSVSAKDLRTAFSHSSKILAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLDG

SEQ ID NO: 16854 - protein, 215 aa, Unknown
  marine gamma proteobacterium HTCC2143
MSLFSGFGKEHKLQMPEQSSALPGRDEAMIVLDKHYVNGNPLKGPFPEGLQQAFFGFGCFWGAERKFWQQQGVYTTAVGYAAGITPNPGYEEVCSGLTGHNEVVLVVFDPSIVSYQQLLNLFWESHNPTQGMRQGNDVGTQYRSGIYCTDDNQRATAEQSLQSYQGRLSAAGYPAVTTEILPVPTFYYAEDYHQQYLAKNPNGYCGIGGTGVSCS

SEQ ID NO: 16855 - protein, 119 aa, Lewia infectoria
STGGKAPRKQLASKAARKSAPSTGGVKKPHRYKPGTVALREIRRYQKSTELLIRKLPFQRLVREIAQDFKSDLRFQSSAIGALQESVEAYLVSLFEDTNLCAIHAKPVTIQSKDIQLPR

SEQ ID NO: 16856 - protein, 329 aa, Zea mays
MEAGGAGSGLNGAVQAKGTGADDGSAKRLPPCCVKARAAAPESEARCHATVVSGWFTEPRSHCGKASKVQYYNNPMWPGEANSLKVEKILYQGKSLYQEVLVFESSTYGKVLVLDGIVQLTDKDECAYQEMITHLPLCSIPSPKKKSIGRLSAALSQHMGYFFLPEFEWKLWWLMSLGNTSQVLVIGGGDGGVLREVCKDFFPHLSVGFQDPRVQLHVGDAVEFLRNAPEGTYDAIIVDSSDPIGPAQELVEKPFFETIARALRPGGVLCNQAESMWLHTHLIQDMLSICRETFKGSVRYAWASVPTYPRLVLHFSIVKSPYIYPFLLS

SEQ ID NO: 16857 - protein, 441 aa, Unknown
  Burkholderia sp. 383
MTDKATRIDLFSFRTAPMRAFHLTWMAFFVCFFAWFACAPLMPLIAREFHLTAAQVANINIAAVAATIAVRLLVGPLCDRFGPRRVYVGLLLLGAIPVFAVSFTHDYLSFLICRLGIGAIGAGFVITQYHTSVMFAPNVVGTANATTAGWGNAGAGATQALMPLLVAAGLMLGFGEDSSWRIALVVPGVAMLVMAWAYWRFTQDCPQGDIVALRKAGVTVDSGKKGGWASFFAACGNYRVWMLFVTYGACFGVEVFIHNIAALYYVDHFSLSLKDAGFAVGLFGLLALFARALGGWLSDKIAARRSLDVRATLLCALIVGEGLGLIWFSHAQSIGVALVAMLTFGLFTHMACGATYALVPFIDRKALGGVAGIVGAGGNVGAVAASFLLKGVGDVQHTLSLLGLAVTATALCAMAVRFSEEHKAREAELRDRALAASSVAN

SEQ ID NO: 16858 - protein, 865 aa, Unknown
  Burkholderia sp. 383
MKLIVIGHGMVGHKLLECVAAEAGAAGALQVTVLGEEPRPAYDRVHLSEFFAGKSADDLSLVEPGFFERHPQFDLRLNAQVASIDRAAHTVTLASGETLAYDKLVLATGSRPFVPPMPGHDRDGCFVYRTIEDLEAMQACGTHAKRGVVIGGGLLGLECAKALRDMGLDTHVVEFAPRLMAVQVDDGGGRMLRAKIEALGVTVHTGKNTLEIVDGEEGTHRMAFADGSHLDADMIVFSAGIRARDELARACGLDLGPRGGVAIDDACRTSDADIYAIGECAAWNGMVYGLVAPGYDMARVVAKQLGGDAGSAAEAAFAGADMSTKLKLMGVDVASIGDAHGTTAGSRTYQYADERRQVYKKLVVSDCGKFLHGAVMVGDAAEYGTLLQMMLNRIELPESPEFLILPSSDGVAKPAIGVEALPAAAQICSCNNVSKSQICTAVADGATSLGALKTCTGAGTSCGGCVPLVTQIMKAEMKKQGLAVNNHLCEHFPHSRQELFHLIRVERITTFDELLAKHGHGLGCDVCKPAVAGILASCFNEFVLKKEHAGLQDSNDYYLANIQRDGTYSVVPRMPGGEVTPEGLIAVGQVAQKYGLYTKITGGQRVDLFGARVEQLPSIWEELIAAGFESGHAYGKALRTVKSCVGSTWCRYGVDDSVGLAIDLENRYKGLRAPHKIKFGVSGCTRECAEAQGKDVGIIATEKGWNLYVCGNGGMKPRHAELLASDLDRPTLIRYIDRLLMFYVRTADRLQRTSVWRDNLEGGLDYLIDVVVHDKLAIGAELEADMQHVVDTYECEWKKAVTDPETRKRFRHFVNSDAPDTTIEFVETRGQIRPATPGERAGGKPVSIPVVAEGVTQAATEPATV

SEQ ID NO: 16859 - protein, 625 aa, Cryptomeria japonica
MSCSARLVVDSYTHSRVPLGESSQWRHQSLSRTSNSHRLHRHVDIRARVVTPTTPIEQKPIIQTSTPTSNSTSTSLTWRSDPDRRFEIPNRVFPGMWEKKSKSESCGWNPVQRLAAAALDAVEKSFITALEKKFPLPKTADPEIQIAGNFSPVPESPVQHELEVVGQIPQCLEGVYVRNGANPLFEPLAGHHFFDGDGMVHAVRLKQGIASYCSRFTRTYRLVEEEKLGRAFYPKAIGELHGHSGIARLMLYYARSMFGLVDRSKGMGVANAGLIYFNGRLLAMSEDDLPYAVRVTEDGDLATVGRFDFDGQLQSAMIAHPKIDPETKELFALSYNVIKKPYLKYFMFSPDGRKGPDVTISVKEPTMMHDFAITDKYVVVPDQQLVFKLQEMVAGGSPVIYDKEKVPRFGILPKYDSDESRMKWIEVPDCFCFHLWNAWEENEDEVVVIGSCMTPPDSIFNESDAALRSVLSEIRLNLKTGKSSRRQLAPMNLEAGQVNRNKLGRKARYVYLAIAEPWPKVSGIAKVDLEAESPERVVGKIEYKKGCYGGEPFFVPRTSNPEAPEDDGYVLTFMHNEETWQSELLILDAKSPTLEPVASVKLPSRVPYGFHGTFITSQELDQQVL

SEQ ID NO: 16860 - protein, 372 aa, Solanum lycopersicum
MAIDCMVMPMIQDEKKSLIFDSSVLKNESNIPRQFIWPDHEKPSGFVGELDVPLIDLGAFLSGDPIAAKRESSLVDEACKKHGFFLVANHGVDTNLISLAHRYMDMFFELPLSDKQKIQRKRGDHCGYASSFTERFSSKLPWKETLSFPYSTLQGSSHMLDQYFLKTMGEDFSHIGKFYQEYCNAMSTLSSGIMELLGESLGVSKNHFKQFFEENESIMRLNYYPTCLKPDLALGTGPHCDPTSLTILHQDNVSGLQVFMDNQWRSISPNNSAFVVNIGDTFMALSNGRYKSCLHRAVVNNKTPRKSLAFFLCPKKDKVVRPPAELVDSNNPRIYPDFTWPTLFEFTQKHYRADTNTLRFFSTWLQQKTTEI

SEQ ID NO: 16861 - protein, 83 aa, Brassica napus
  misc_feature (47)..(47): Xaa can be any naturally occurring amino acid
LDMNTVEDAMVGLTRGVVPGLIGTGLEVVEIDGAPRMGPTLGVLMIXGQKADHLVLKVWGQPNVMDGSFVGNLTPELVLPVVD

SEQ ID NO: 16862 - protein, 554 aa, Oryza sativa
MASAPPVQEEPLQPGTNHFRSLLAAAVRSISWSYAIFWSISNSCPGVLTWNDGFYNGVVKTRKISNSADLTAGQLVVQRSEQLRELYYSLLSGECDHRARRPIAALSPEDLADTEWYYVVCMTYSFQPGQGLPGKSYASNASVWLRNAQSADSKTFLRSLLAKTIICIPFTSGVLELGTTDPVLEDPNLVNRIVAYFQELQFPICLEVLMSTSPSPNETEDADIVSEGLITHNAIEEGQMVVSDECVSNANRDPITMEIDELYSIYEDLDLDMDLDLDTVRFLEDNGWPVNPSSFQLVSASSTEAVAAAAAANDVDGVANSQVSCFMAWKSAKSNEMAVPVVTGIESQKLLKKVVDCGARMSTGRGSRAALTQESGIKNHVISERRRREKLNEMFLILKSIVPSIHKVDKASILEETIAYLKVLEKRVKELESSSEPSHQRTTETGQQRRCEITGKELVSEIGVSGGGDAGREHHHVNVTVTDKVVLLEVQCRWKELVMTRVFDAIKSLCLDVLSVQASAPDGLLGLKIQAKFACSGSVAPGMISEALQKAIGG

SEQ ID NO: 16863 - protein, 1395 aa, Unknown
  Burkholderia sp. 383
MTATPVKSVCPYCGVGCGMVLHVEEGEVVKVSGDSDHPTNFGRLCTKGSSAHVALRRSGRLDRAFVRRAREDDLVPLSGRDAIAETARRLRTVLDTYGPDALSFYVSGQMSIEAQYLVNKLAKGFVGTNNIESNSRLCMASAGTGYKQSLGADGPPGSYQDFDRANLFFVIGANMADCHPILFLRMMDRVKAGAKLIVVDPRRTGTADKADLFLQIRPGTDLALTNGLLHLLHANGRTDAAFIDAYTEGWDAMPAFLADYTPERVAEITGLAEADLRTAAQWIGDAQEWMSCWTMGLNQSTHGVWNTNAICNLHLATGRICRPGSGPFSLTGQPNAMGGREMGYMGPGLPGQRSVASDDDRRFVENLWRVPAGTLRKETGQGTVDMFSRMAAGDIKACWIICTNPVATVPNRQNVIAGLQAAELVIAQDAFLDTETNRYADILLPGALWAEGDGVMINSERNLTLMRAAVAPPGDALPDWRIVAEVARAMGFGDAFDYASAADVFDEIVRFSNPATGYDLRGASHAALRDGPVQWPVAPGTARERHPIRYLNDGVSQTLRPAADGNDAPRLAFPTPSGKARFFARPHVDPAELPDDTFPIVLNTGRLQHQWHTMTKTGKVAMLNKLNPRPFVELHPDDASALGIAAKDSVEIRSARGRAVLPAVVTERVQRGNCFAPMHWNDVYGDDLCINAVTNDAIDPESQQPELKYCAVALRRVETDAFASADDETAQPDARADDVRPAPVMTQATASQESDMADIDTFAAALGVADLAPPPLTDTERLYVAGLVSGLKASAGKREGSVPVLPAAAPLTPPVRFWLDGMLAGLFSRSLPASVPGAAAPALPADAGASGGVRIVRTRPKVVLLWASQTGNIESLTEDYATQLMNAGFEIRTACMSDYPVASLAGAQYVLLMTSTFGDGDAPDNGSEFWEALQAGSAARLDGVHFAVLAFGDRNYDQFCGHGRRLDARLAELGAARLCARVDCDVEFQRDADQWLERVVARIKEADAALHAVPTGGMSPSGLLPTKAHPAPSKLVANLRLNRPGAAKDTRCVSLSTEGANLEYETGDALGVWPTNCPELVDELLSVTALKADSPVSVAGVGDVRLGDALARHFDITRPHPDTLAFIASRSANGALKSLLGDERKGDLKQWLWGQQLADVLHEFPVELSGTELVGMLKRMQPRLYSIASSPSAHQGEIHLTVSAVRYHNGRRARKGVASTFLADRADDGRVPVFVQKSAHFRPPVNGDVPIVMVGPGTGVAPFRGFLHERQARGARGRNWLFFGEQHAQTDFYYGDELGAMHDSGFLTRLDLAFSRDQADKIYVQDRMREQGAELFAWLEEGAHFYVCGDAARMAKDVDTALKAVVAEHGGMSDEAANDYVARLSKARRYMRDVY

SEQ ID NO: 16864 - protein, 378 aa, Solanum lycopersicum
MAIDCMITNGKSPMLDEKKQFIFDASHMKRESNIPTQFIWPDHEKPCALVQQLHVPLIDLRGFLSGDPDAAQQASELVGEACRGHGFFLVVNHGVDANLISNAHRYMDTFFELPLLEKQKAQRKIGEHCGYASSFTGRFSSKLPWKETLSFRYSAKKESSHIVEEYFQSTLGESFNHLGNVYQEYCNSMNTLSLGIMELLGMSLGVEKSHFKEFFEENDSIMRLNYYPPCQKPELALGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLHDQHNTTTQA

SEQ ID NO: 16865 - protein, 195 aa, Burkholderia pseudomallei
MRVAQVVRNTSETQISVKIDLDGTGRQKLATGVPFLDHMLDQIARHGLVDLDIEAHGDTHIDDHHTVEDVGITLGQAVAKAVGDRKGIRRYGHSYVPLDEALSRVVIDFSGRPGLEFHVPFTRARIGTFDVDLSIEFFRGFVNHAGVTLHIDNLRGVNAHHQLETVFKAFGRALRMAVELDERAAGQIPSTKGSL

SEQ ID NO: 16866 - protein, 344 aa, Oryza sativa
MVGAVQEGIVREMNGGFEVMSGYDRSSMAPKQQQREEESKWYEEEIDDDLKLCYALNSVLHRGASKYQEIALIDTKHFGKALIIDGKMQSTEVDEFIYHESLIHPPLLFHPNPKTVFIMGGGEGSAAREVLRHNTVHRVVMCDIDQEVVDFCRTYLTVNWDAFASDKLCLIINDARAELEKSREKFDVIVGDLADPVEGGPCYQLYTKSFYQHFVKPKLNDRGVFVTQAGPAGVLTHKEVFSSIYNTLRHVFKYVKAYTAHVPSFADTWGWVMASDYPFSMNAQQINERIKERIDGELVYLSGESLISSTILNKSVYQSLLNETHVYTEDDARFIYGHGRARCA

SEQ ID NO: 16867 - protein, 353 aa, Solanum nemorense
DAWDTSVTVEVKVGDTIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFSLLNLPDEFRGSFDFIDGHEKPVKGRKINWMKAGILESHRVVTVSPYYAQELVSAVDKGVELDNVLRKTCITGIVNGMDTQEWNPATDKYTDVKYDITTVMDAKPLLKETLQAAVGLPVDRKIPLIGFIGRLEEQKGSDILVTAIHKFIGLDVQIVVLGTGKKKFEQEIEQLEVLYPNKAKGVAKFNVPLAHMITAGADFMLVPSR

SEQ ID NO: 16868 - protein, 340 aa, Bartonella quintana
MNAVSMTVIGAGSYGTALAIAFARNGHHVLLWGYNPQHVRELQIHRCNQAFLPDVQFPDNLSPEASLETAITASRNILIAVPSHVFHQVLYNIQPYLNQHSRIIWATKGLEHGTGRLLQEVAREILGDKIPLAIFSGPTFAKELAIGLPTAITVAASNAEFSEELQQLFHCDKSFRVYKNPDMIGVQLGGVIKNVIAIGAGISDGMGFGANARIALITRGLAEISRLGIAMGAELSTFMGMTGLGDLVLTCTDNQSRNRRFGILLGQGMDIEEAEKQIGQIVEGYLNTKEVRMLARRIGVEMPITEQIYHVLYSGKSVVEAANTLLSRTLKDEIHDKVCF

SEQ ID NO: 16869 - protein, 379 aa, Solanum lycopersicum
MAIDYMITRNNNMISKEDQVSNKSLSFNASLMKNESNIPSQFIWPDHEKPNYASVTRELQVPLIDLSGVLSNDPIEIKKATRLVNEACTKHGFFLVVNHGVDTNLIKNAHVYIDKFFQLPLCEKQKAQRKVGEHCGYASSFVGRFSSKLPWKETLSFQYSDQKGSSHIVEDYFQRTLGEKFSYIGKVYQEYCNAVSTLSLGIMELLGLSLGVSKNHFKEFFQGNESIMRLNYYPTCQKPELTLGTGPHCDPTSLTILHQDSVGGLQVFVDNEWHTITPNFNAFVVNIGDTFMALSNGRYKSCLHRAVVNNKIPRKSLAFFLCPKKDKVITPPNELVDSNNPRIYPDFTWPTLLEFTQKQYRADMNTLQTFSNWLKKTQS

SEQ ID NO: 16870 - protein, 466 aa, Brassica napus
MRNLYFLVLFPLSILILVDASLHVKYLPGLEGPLPFELETGYVSVGESGDVELFYYFVKSERNPDKDPLMIWLTGGPGCSSICGLLFANGPLAFKGDEYNGTLPPLELTSFSWTKVANILYLESPAGSGYSYAKTRRAAETSDTKQIHQIDQFLRSWFVDHPEFISNSFYVGGDSYSGKIVPGVVQQISLGNEKGLTPLINIKGYVLGNPAVRTNLEPNHRVSFAHRMGLISDELHESLERNCGGKFFNVDPSNAKCSNGLLAYHQCISEIYIEQILLPNCKVDYVLADISQTLPNIRTSRRRELKEFSRNDSSSLPPPSCFTYRYFLSAFWANDENVRRALGVKKGFGKWSRCNTQNIPYTYDIHNAIPYHVNNSRKGFRALIYSGDHDMMIPFSSTEAWIKSLNYSIVDDWRPWMMNSNQVAGYTRTYANKMTFATIKGGGHTAEYNPDQCSLMFKRWIDGESL

SEQ ID NO: 16871 - protein, 353 aa, Solanum palitans
DAWDTSVAVEVKVGDTIEIVRFFHCYKRGVDRVFVDHPMFLEKVWGKTASKIYGPKAGQDYLDNELRFSLLCQAALEAPRVLNLNCSAYFSGPYGEDVLFIANDWHTALIPCYLKSMYQSRGIYLNAKVAFCIHNIAYQGRFTFSDFPLLNLPDEFRGSFDFIDGYEKPVKGRKINWMKAGILESHRVVTVSPYYAQELVSAVDRGVELDNVLRKTSITGIVNGMDTQEWNPATDKYTDVKYDITTVMDAKPLLKEALQAAVGLPVDRKIPLIGFIGRLEEQKGSDILVAAIHEFIGLDVQIVVLGTGKKKFEQEIEQLEELYPNKAKGVAKFNVPLAHMITAGADFMLVPSR

SEQ ID NO: 16872 - protein, 179 aa, Bacillus licheniformis
MKQDIENILISEEEIQKKVKELGATLTEEYSGKFPLAIGVLKGAMPFMADLLKHIDTYLEMDFMDVSSYGSSTVSSGEVKIIKDLDTSVEGRDILIIEDIIDSGLTLSYLVELFRYRKAKSIKIVTLLDKPSGRKADIKADYVGFEVPDAFVVGYGLDYAERYRNLPYIGVLKPAVYES

SEQ ID NO: 16873 - protein, 410 aa, Streptomyces coelicolor
MAEHPAYPVGLRLAGRRVVVLGGGQVAQRRLPALVAAGADIRLVSPEATPSVEAMADAGEITWEQRPYAEGDLADAWYALIATSDTAANDAASAEGERHRVWCVRSDDADRATAWTPATGHSEGVTVAVLTTEARHRDPRHTAAIRDAVVEGLRDGTLVAPHRRTRTPGVALVGGGPGDPDLITVRGRRLLAEADVVIADRLGPRDLLAELPPHVEVIDAAKIPYGRFMAQEAINNALIEHARQGKAVVRLKGGDPFVFGRGMEEAQALAEAGIACTVVPGISSTISVPGAAGIPVTHRGVAHEFTVVSGHVAPDDERSLVDWPSLAKLTGTLVILMGVDKIGKIAGTLIAHGKSPDTPVALVQEGTTAAQRRVDATLATVAEVAVAEEVRPPAVIVVGEVVAVGPHGTA

SEQ ID NO: 16874 - protein, 588 aa, Candida albicans
MIEEDENTSLLSRRPSHSFLDTPIGSFKGPNSLHNFASSFTRAQSFAANKIDNSIHKKRSFFVSGDGGTVEDDETFDPELLVPSYRGERLSTVMHDIQSRNQLFMNPPNQLDQSVSPNNDVFFHDDVMNALNESRSRQNSTFGNSQFKHRIYSAPSFSSFRSSISAATTPSIFQVRKIEDEDGNVVTVLAGQSTAPQTIFNSVNVLIGVGLLALPVGLMKAGWVYGIPILLVCGLTTYWTACLLSKAMDTDDTIMTYADLGYAAYGSMAKLVISVLFSIDLLGAGVSLIVLFSDSLYALLGDDQVWTRTRFKILSFIVLTPFTFVPLPILSIISLFGILSTISITILVMVCGLLKPTAPGSLLETMPTNLYPKSLPDLLLAIGILMAPFGGHAIFPNLKSDMRHPYKFTQTLRSTYSITLLTDCSMAVLGFLMFGQNCSNEVTNTLLTTAGYPKWCYPLISGLICLVPLAKTPLNAKPIISTLDVLFGVANISTNKIRETVNSLGRFVIRIGVNAVFVVLAILFPEFDKIIGMLGASICFIICIILPCLFYVRLCGSKIRGFERFMVYSAIFISCVLASAATWAVLNY

SEQ ID NO: 16875 - protein, 517 aa, Deinococcus radiodurans
MKNWVLIRRPPHKEKSPMSEVSLPAALPAPFVSLVGAGPGDPGLLTLRAREVLAQADVVLTDALVSPALLAHCPQARVVEVGKRGFLPSAKQEDINDLIVREALAGGGQRVVRLKGGDPFVFGRGGEEALACRAAGVPCEIVPGVSSAVAAAAYAGIPVTHRGLSRSFAVLTGTDRHGPAAYAEIAGVDTLVFLMGVRHLPQITADLIAAGRDPQTPAAAVQWASTPQQRTVRATLGTLAQRAAEAGLGAPAVTVVGAVAALHDDLDWFCPAPLPLQGAQVAVTRTREQTGSELAALLSGRGAQVSEIPLLRFVPASSPRTLVGALNGFDGWVLLTSEQAVRALARTLLAAGRDLRVLARARIAAVGSGTAWTLREYGLAPDFVPTRSGSRHLGAELPAAPGEVALHVGSQDTDAVLEMALSARGIEYVAAEAYRSELSELTPAQREQLQEAQVVTLASAVGARALAQVAGTSFTAAVIGPQTELAAREAGFTRLILAEQPTLASLSDAVQRACRAG

SEQ ID NO: 16876 - protein, 306 aa, Bacillus licheniformis
MVRVANSVYDLIGNTPVVKLNRLVDEDSAEVYVKLEYMNPGSSVKDRIALAMIEDAEEKGLLKEGDTLIEPTSGNTGIGLAMVAAAKGIKAILVMPDTMSSERRNLLRAYGAELVLTPGAEGMKGAIKKAEELAEEHGYFMPQQFNNPANAEVHRRTTGKEIAEQFGDGLDAFIAGIGTGGTITGAGEVLKEKNPSIKIFAVEPTDSPVLSGGKPGPHKIQGIGAGFVPKILNTEIYDEIITVKNEEAFEFARKRRERKEFSEDFFRRSHLCCSSVAKKLGKGKKVLAVLPSNGERYLSTPLYQFE

SEQ ID NO: 16877 - protein, 358 aa, Candida glabrata
MIPSKRILTDKDVKIWEESETREDILSFIESLAKAVEGFENDQVSEPVSDSVQSTIAVLTEIDKLIKLHPVIQDKNTSRFGKVEFRDFYDDVCEKADDLLSSHFPALTSEQIEQLSIYLQESWGNKRRIDYGSGHELNFICFLYGLTHYKIFDLQRDARNLVLVLFIEYLKIMREIETLYWLEPAGSHGVWGLDDYHFLPFLFGAFQLAPHKHLKPKSIHNEELVEMFADKYLYFGCIAFINSVKTSTSLRWHSPMLDDISGVKKWSKVAEGMIKMYKAEVLGKLPIMQHFYFSEFLVCPEGISEPRTHIHNGDEDDDQCCQDGAAHNTWGDCCGIKIPSLYAANAMEKQSHKPIPFD

SEQ ID NO: 16878 - protein, 187 aa, Leuconostoc mesenteroides
MKPLITHPAIKGVLATETDIQAQVQRVANELTTKFEGNKERPIFIAVLKGGVIFATDLLRKMPLDVDFDFVDVKSYSGAASTGQVKVVHDVSMDLTGRDVVIVDEIIDSGRTMQWLHNYFELKGASSVTTVALADKKEARVVDFEVDYFGLEVPDEFLVGYGMDYNNFFRNLPVIAIVDFDKVDLIK

SEQ ID NO: 16879 - protein, 492 aa, Arabidopsis thaliana
MSDLQANKDAAAVNRQSSSSAADLNGPSPMRKMISVAPIAAGIQFGWALQLSLLTPYVQLLGVPHKWSSFIWLCGPVSGLLVQPSVGYFSDRCKSRFGRRRPFIATGALLVAVAVVLIGYAADFGHSMGDKVDEPVKMRAVVIFALGFWILDVANNTLQGPCRAFLGDLAAGDATKTRTANAFFSFFMGVGNVLGHAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGGLGLMLNSIVLGCMSLGIEGISRKMGGAKRLWGAVNIILAVCLAMTVLVTKKAGEHRKIAGPMALPTDGIRAGALTLFAFLGIPLVITFSIPFVLAFINSSSSGAGQGLSLGVLNMAIVIPQMVVSFGVGPIDALFGGGNLPGFVVGAITAAISSVVAFSVLP

SEQ ID NO: 16880 - protein, 297 aa, Salinibacter ruber
MSGTVCVVTGANSGIGKATAAELARLGARVVMVCRDEGRGREAQAELRAEARTAHPSRADTIDLRIADLSVQEEVYHLGETLRADYDRLDVLVNNAGVFLESREETVDGVEATFAVNHLAPFLLTHLVLPRLRETAGRAGEARIVTLSSEAHRGVSMDFDDLNAETGYNPLQAYAQSKLANILFTHELSRRLQDEGVVANVVHPGIVNTNIWRGSGWISRIARLFSWLYKRPEEGARNVVYLAASPDVEGVTGQYFKETEVVNPSPEAYDEKAEARLWRISREMTGLAEVDEDGAPG

SEQ ID NO: 16881 - protein, 355 aa, Unknown
  uncultured archaeon
MECFYGGKKDKVLVSALRKENPKVVAVNGMEDCFLSELYNIAQIVKGYDENIHVVTGGVSATTRDLEILRKSVVDFVIRGEGETPLLTLSNALIQNEDFEKIRGISFMKDDRIVQTDNQSFIDLETLPFPDRDSYPLSKLYALNGGIDLVYASRGCPFNCSFCNAPAFWKRQWRARELKDIVEELSILGDLGAKIVHIYDLNFGFNKKWVKNICKGIRREKIDIIWDCELALIDFNMSFLKTIYDGNCRGAFCGIEAVSQSVLDSVNKSYKSQDLVKYLNNAKDAGIHVDGGYVFGLPEDNLSGMRTMTRLACRLLEEDLVETPAPFLFVPFKGTEIGENLNRLSHKPIIEFYYT

SEQ ID NO: 16882 - protein, 483 aa, Oryza sativa
MSAAAEGRPPAAAAAGEMVREATAWCALHGLVVGDRADPRSGTVPGVGLVHAPFSLLPTHLPESHWRQACELAPIFNELVDRVSLDGDFLQDSLSKTKQVDDFTSRLLEIHRKMMEINKEENIRLGLHRSDYMLDSETNSLLQIELNTISASFPGLGSLVSELHRTLIDQYGHLFCLDSKRVPGNEASSQFAKALARAWDEFNVDSAVIMMIVQPEERNMYDQYWLAKHLKESYPFMLFLSSTWKTLSEVEAEGHVLPDGTLVIDGKTVSVVYFRAGYTPNDYPSEAEWAARLLLEQSSAVKCPSISYHLVGTKKIQQELARPNVLERFLENKEEITKIRKCFAGLWSLDDEEIVKSAIQKPELFVLKPQREGGGNNIYGIDVRETLIRLQKEGGDALAAYILMQRIFPKASLSNLVRGGVCHEALTISELGIYGAYLRNNDKVVMNEQSGYLMRTKVSSSDEGGVAAGFAVLDSLYLTDKAM

SEQ ID NO: 16883 - protein, 231 aa, Oryza sativa
MQEAGRRPAPQFAGVDLRRPKGYPAAAQLTPAAEEAAAGVGDPCPRCESRDTKFCYYNNYNTSQPRHFCKSCRRYWTKGGSLRNVPVGGGSRKSSTSSSSSSSAAAASSSSSPSSPAKSPKRSKNSKRRRVSPPPPQPAPAPPPPTTADAADVAAPTAPEDTTKKAPEDLTAAAATQPAVALGLGVADGGGGGKEHLDTSPFEWPSGCDLGPYWPTGVFADTDPSLFLNLP

SEQ ID NO: 16884 - protein, 102 aa, Cynodon dactylon
ADAIKSLVIPTPEGDWFSSGVYTNGNPYGIAEDIVFSMPCRSKGDGDYELATDVIMDDFLWERIKKSEAELLAEKKCVAHLTGEGVAFCDLVREDTWIPGEM

SEQ ID NO: 16885 - protein, 285 aa, Legionella pneumophila
MGTLMKENKLTVALVQEQWYENPKEHQDKLASGIFSATQQGAKLVCLQELTLSPYFCTRSDVDPAPYMEDIATGPTAQFVSQMAKSNQIHITASLFEKAGYNTAVAFNPQGELIAVTRKQHIPSGEKYHENFYFKPGNSNYPVHTIAGHYLGLPTCYDQWFPELSRIYGLKGAEILVYPTAIGGEPTAPGFDSQPMWQKVMVAQGIMSNTFIIAVNRIGCEDGLSFYGSSFISTPMGEILVQAPRNEPAVLVAELDFSQRELWGRLFPFPQQREPETYHELVKSR

SEQ ID NO: 16886 - protein, 171 aa, Unknown
  Mycobacterium sp. JLS
MSDHKKAILAGGCFWGMQDLIRKQPGVVSTRVGYTGGQNDHPTYRNHPGHAESIEITYDPAQTDYRALLEFFFQIHDPTTKNRQGNDVGTSYRSAIFYVDDDQKRVALDTIADVDASGLWPGKVVTEVTPAGEFWEAEPEHQDYLERMPWGYTCHFPRPDWKLPKRADAKA

SEQ ID NO: 16887 - protein, 338 aa, Streptomyces coelicolor
MGESVLLTSTPPEHKESVIVSSAPQSRPWDVHRLPSAEGRNFLVTGGNAGIGYFTAEQLAATGALVVIGSRNPAKADAALASIRSRVPGARVRHLHLDLADLSTLKSAVDGLALDLGRLDAVVHNAGGALDDPPRRETEDGHELMFGTNHLGHYALTRWLAPLLSAAPAGRVVTVGSFAARSERLDLDDLQSTRDYRPKRTYGRSKLAQMCFGFELDRRLRAAGSTVLSAVAHPGGALDSLTPPRPPVGAPTPGERLRGLPAALMVQGKDAGAWPVVRAVLDSDVQGGQLWGPRVFGLRGQPRREPVPAHMADPAVAARLWAASAELTGTTDPHLGFR

SEQ ID NO: 16888 - protein, 449 aa, Unknown
  Mycobacterium sp. JLS
MSEATVAEVPTPNPRAVNLPPALRAPMPLQGIAYAFARRQLVSWMARRHGPVFRIHIPMFGRTVMVADPQLAKQLFMAPTDEVGNIQPNLSRILGPGSVFALDGAEHKRRRRLLTPPLHGKSVKNYEKLFEEETLRESANWPEGRPFETLEPMMRITLNVILRAVFGADGEKLDELRRIIPPWVTLGSRLAVIPSPPTTFGRWTPWGRLADYRRRYDEVIDRLIDEVRADPRFGERDDVLALLLRSTYEDGTEMSRSEIADELLTLLAAGHETTASTLGWAFERISRHPEVLAKLVAEAATDDNEYRQATIYEVQRNRTVIDFAGRHVYAPTFELSEWVIPRGYSIVVALAEIHEQAEDYVDPERFSPERFVGSRPSPLVHVPFGGGTRRCIGAVFANVEMDIVLRTVLRHFAIEPTTAPGEKVHSRGVAYTPKAGGQVTLRRRPQPLA

SEQ ID NO: 16889 - protein, 632 aa, Coxiella burnetii
MCGIAGIFNLNGKPVAFDQIKAMTDSIAHRGPDGEGQFTDKYIGLGHRRLAIIDLSPAGHQPMQTKDGRYLITYNGEVYNFKILRKELETLGYSFFSNTDTEVVLNAYVQWGEKCLEKFNGMFAFAVWDRKEKTLFLARDRYGIKPLYYYQTNDCFVFASEIKAIIASGLYGAEINKEALVEYLTFQNFFTDRTLFKDVRIMPAGHFMMVKRENSSLHQYWDFNFTNDSALSEKMLLEKINDLFQQAVNRQLVSDVPVNSYLSGGVDSGSITMIAAKQLPHIRTFTVGFDLSSASGLELAFDERQAAEHLSYLAGTEHYEMVLKAGDMERCMQDLVWHLEEPRIGQSYPNFYAAKLASKFGKVVLAGTGGDELYAGYPWRYLCGQSSENFEDYIDKYYQYWQRLMSNKNLFKVLAPIAEEVKSIWTRDIFANVFRIKDTPIKTEDYINYSLYFEAKTFLHGLLVVEDKLSMAHGLETRVPCLDNDFVDFALQVPVKYKLSDFAFERVNENDTFSKREKRMNGKKILRKMMSRYVPDNVAHAPKQGFSAPDASWFKGESIEFVRSLLGDRNAKIFELLDYSVVNHLVNDHIQNHHNHRLLIWSLIYLEIFMQVHLSKGHKSNYHLFTPETVEL

SEQ ID NO: 16890 - protein, 288 aa, Prochlorococcus marinus
MNYKLKTRSEWLDEYHQGVRYGLQGKLILEESSPFQKITIYESKRYGKALLLDDCWMTAEKSEKCYHECLIHPALCCSTQIENILIIGGGDGGSARECLKYKEVKSIDLVEIDLRVIELSQKYLPTIGGDAWSDSRLNLQIKNGIDWVKHTQENSYDVIIIDGADPIGPSKELFSNSFLKDCKRILKQGGVLATQSESPESFQKIHINIVKVLREIFDYADPMYGSVSIYPSGLWSWTFASMKQQRYMHPKKSRVKEISENCQIWSTRWQQGAFNSIPAFIERELAKK

SEQ ID NO: 16891 - protein, 353 aa, Solanum pectinatum
DAWDTSVAIEVQVGDSIEIVRFFHCYKRGVDRVFVDHPMFLEKVWGKTGSKIYGPKAGQDYLDNELRFSLLCQAALEAPRVLNLNCSKFFSGPYGEDVLFIANDWHTALIPCYLKSMYQSREIYLNAKVAFCIHNIAYQGRFAFSDFPLLNLPDEFRGSFDFIDGHEAPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEALYPNKAKGVAKFNVPLAHMITAGADFMLVPSR

SEQ ID NO: 16892 - protein, 301 aa, Alkaliphilus metalliredigenes
MKKIKIIYNPKAGRQMVQKNIPRLVEVLVKQYHEEVDSVATQGPGHAEELAYQSCQEGWDLIVAVGGDGTVNEVVNGMMSCEKQCPLAIYPAGTVNDFGSHLQISKKPEDFARMIVAGHRLNVDVGKAGERYFINVIAGGLLPNVAHNVSTEAKTVFGKLAYYMEGIKEFPKQLFETLDIQFQIGEEIYEKEVLFFFMTNSPNVGGFKHVAHNARLNDGKFDLLIVERGQVLDVTKLFFNAITGRPKEQPILKYIQVEKIRIHSKEPLHIDIDGEEGELLPMTFKVNKEALTILVPEGVHY

SEQ ID NO: 16893 - protein, 351 aa, Solanum petrophilum
WDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCLHNIAYQGRFTFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 16894 - protein, 173 aa, Triticum aestivum
MAMRALALSPSQSSSFGLHQSMPSFKPSSASPARSVRAYAKADEQEEEKKKVPKQSLFGNITEALDFSQVRSEKDAELLYEARDSIKDEGRMTREQYAALRRKIGGTYKDFFKSYVEVDGEYVEEGWVDKTCKVCKKDTRGEPRQVDNLGRYMHVACAENSKPTNFFSKLFGR

SEQ ID NO: 16895 - protein, 273 aa, Oryza sativa
MANASLQSFLLHHHHSFLSNGIHEGSSPSIILKLTTNSNSSISFKLFSNTTSSSSSSVTTTASTPNSPVTPAPVTASSPPLPSLELLGAQLAERDYRQADETTRALLIELAGEPARRRGYVFFSEVQFISADDFRAIDALWQEHSGGRFGYSVQRRLWEKSRRDFTRFFIRVGWMKKLDTEVEQFNYRAFPDEFIWELNDDTPEGHLPLTNALRGTQLLGNIFTHPAFEEEQEDELAAEENDTPDNTGQSKDGSKGKERPKFMRDFFKPDYSF

SEQ ID NO: 16896 - protein, 432 aa, Unknown
  Synechocystis sp. PCC 6803
MGQPSDLTESTLRFSSLDPLHPPVISQLTAIAKRIRRNSLHLPTIWQEAVDSIGSTLGVSRCLLLTKDFQSRHLQIEAEFCQPTVTAFAALIVPEESEIWRQLFEQHQPITLYNVQFQGEDLGGLWIFPTLYQDQANGYLCLQQVGPAPGPWHPETEALLQELAEQTGTAIAHATLYQELTQATKAAEEASRLKSEFLASTTHELRTPLNGIIGFLRLILDDMADSEAEKHEFVEEAYQSALLLLNLINDILDLAKIEAGRVGIELEVVDFSEVLQATENFALPQAQNKGLSFNLTAPNQGPLLVYGNQRWLLQVMLNIVGNAIKFTHEGGITVAVEVMPRTVLWEGVQKPGLLKVSVGDTGIGVSLEQQSKLFKKFVQIDGSHSKAYGGTGLGLVISQKLVETMGGKVAFFSMGEGLGSTVTFTVLLEELP

SEQ ID NO: 16897 - protein, 420 aa, Thermus thermophilus
MGPLLVWHRGDLRLHDHPALLEALARGPVVGLVVLDPNNLKTTPRRRAWFLENVRALREAYRARGGALWVLEGLPWEKVPEAARRLKAKAVYALTSHTPYGRYRDGRVREALPVPLHLLPAPHLLPPDLPRAYRVYTPFSRLYRGAAPPLPPPEALPKGPEEGEIPREDPGLPLPEPGEEAALAGLRAFLEAKLPRYAEERDRLDGEGGSRLSPYFALGVLSPRLAAWEAERRGGEGARKWVAELLWRDFSYHLLYHFPWMAERPLDPRFQAFPWQEDEALFQAWYEGKTGVPLVDAAMRELHATGFLSNRARMNAAQFAVKHLLLPWKRCEEAFRHLLLDGDRAVNLQGWQWAGGLGVDAAPYFRVFNPVLQGERHDPEGRWLKRWAPEYPSYAPKDPVVDLEEARRRYLRLARDLARG

SEQ ID NO: 16898 - protein, 398 aa, Mesorhizobium loti
MQDLKQRPVSVFREFLDSEAAGGIILMVAAALALIVANSPLAETYFSVLHAYLGPLSVSHWVNDGLMAVFFLLVGLEIKREMLDGQLSTWPRRVLPGIAAAGGMLVPALVYVFINRNNSAALSGWAIPTATDIAFALGVLSLLGSRVPASLKVFLTALAIIDDLGAVIIIAIFYTSGLSLAYLGAAFAVIAALVVLNRMRVMTLLPYLVLGAILWVLVLKSGVHATLAGVALALTIPLERSAGVGHDLDHSPLHRLEHGLHKIVPFFVIPIFGFANAGVSLAGLSLGALIEPLTLGVAAGLVVGKLVGVFGSSALAIRLGLADLPAHTGWSHMIGISLLCGIGFTMSLFIGLLAFASDVALQDAVKVGILAGSFVAAILGAAVLLMAPAAGVAEEETE

SEQ ID NO: 16899 - protein, 119 aa, Lewia infectoria
STGGKAPRKQLASKAARKSAPSTGGVKKPHRYKPGTVALREIRRYQKSTELLIRKLPFQRLVREIAQDFKSDLRFQSSAIGALQESVEAYLVSLFEDTKLCAIHAKRVTIQSKDIQLAR

SEQ ID NO: 16900 - protein, 255 aa, Coprinopsis cinerea
MAIPDAQIHPVATGAAAALVEAHQAPQELVFYAGWFCPFVQRTWIALEEKKVPYQYKEVNPYKKEPEFLAINPKGLVPALAYKGRALYESLILCEFLEDAFPNHTKLLPDDPVEKAHARIWIDHLSKTYVPASHRLLQAQTPEKVKEGRDEVVDSLRKFSEQIRGPFFLGETFSLVDVAVAPWIARDYILREHRGFDRKDVGPKWEEYAKLIESRPSVVQTSSDREHLDVIYGRYLRDEAQSEAAKAIRAGRVIP

SEQ ID NO: 16901 - protein, 380 aa, Arabidopsis thaliana
MEYGEEPSIKRFLMLPDDLVFNCLARVSRLHYPTLSLVSKKFRFLLASKELYQTRILLGGTESCLYVCVRLHTDSEQLHWFIIYQGPNSSKKVLVPISSPNFTSAALPGFVVVGHEIYAIGGGSENKNASINATGSKTYNALSSVMVMDSRSHTWREAPSMRVARVFPSACTLDGRIYVTGGCENLNSMNWMEIFDTKTQTWEFLQIPSEEVCKGSEYLSISYQRTVYVGSREKDVTYKMHKGKWRGADICLNHGWSLDPSSCCVIENVFYRCSLGDVRWYDLKKREWAALKGLEGLPTFTNYYRNFKSADHCGKLAISWEEYVLVDDETKIWCAEIAIQKRQNGEIWGTLEWFDNVFISSGPNRHVDLLVNALTATVWG

SEQ ID NO: 16902 - protein, 298 aa, Zea mays
MSAELKRDYEIGEEIGRGRFGVVHRCTSRATGEAYAVKSVDRSRLGDDLDRELAQLEPKLAQLAGAGNPGVVQVHAAYEDEAWTHVVMDLCPGPDLLEWVGRRRGAPVPEPVAAAIVAQVAQALALCHRRGVAHRDVKPENILIDAAAGSDDDEEDEAEAAPRARLADFGSAAWVGAGGLGRAEGLVGTPHYVAPEVVAGGEYGAKADVWSAGVVMYALLSGGALPFGGDSAAEVLAAVLRGSARFPPRLFGGVSPAAKDLMRRMICRDEWRRFTAEQVLAHPWIVSGGGARAMERPT

SEQ ID NO: 16903 - protein, 486 aa, Chlorobium tepidum
MKEQLIFDLSRSGRKGYSLSPLDIPERPADELLPSKFLRKEPAELPEMAESEVVRHFIRLSNLNYHVDKNMYPLGSCTMKYNPKINDYTCDLPGFASMHPLQPESTSQGALQLMYELAEMLKEIAGMKAVTLQPAAGAHGELTGILLIKKYHEKLGNKRHKLLVVDSAHGTNPASAALGGYECVSVKCDESGCTDMGDLRAKLDGEVAALMLTNPNTVGIFEKQIPEIEKLVHGNGSLLYMDGANMNALLGITRPGDMGFDVMHYNLHKTFSAPHGGGGPGSGPVGVSERLVEFLPVPVIEKFEKDGQTRYRLNSSKPNTIGRMMNFYGNFSVLVRAYTYIRMLGADGLRRVSENAIINANYLLQRLVEHYALPYPRPVMHEFCLSGDRQKKEHGVRTLDIAKRLLDYGYHAPTVYFPLIVSEALMIEPTETEAKETLNAFADAMIAIAEEAKSNPDLIKSAPTTTPVKRLDEAQASRQLNICCQH

SEQ ID NO: 16904 - protein, 462 aa, Erwinia carotovora
MAEDVKQEKLHRGLEARHIELIALGGTIGVGLFMGAASALKWAGPSVLLAYIVAGIFVFFIMRSMGEMLYLEPVAGSFAVYAHKYMHPFFGYLTAWGYWFMWMAVGISEITAIGVYVQYWFPELPQWIPAIVAVALVAGANLAAVRLYGEIEFWFAMIKITTIVVMILVGVGIIFFGFGNHGQATGFSNLTEHGGFLAGGWKGLLFALCLVVASYQGVELVGITAGEAKNPQVTLKRAINNILWRILIFYVGAIFVIVTIFPWNEIGTSGSPFVLTFAKIGIVAAAGIINFVVLTAALSGCNSGMYSCGRMLYSLANNRQLPAWLGKVTASGVPAAGVMISILCLVAGSLLNYVIPNPEKVFVYVYSASVLPGMVPWFVVLISQLRFREQHRVALASHPFKSILFPWVNYLTMAFLLCVLVGMYINIDTRMSLLVGVAFLAVVSLCYFALGLGKKTSLAGGK

SEQ ID NO: 16905 - protein, 404 aa, Glycine max
FGSRATSISSTDNNFGNPLAMTAVVVVPLGLLFFASGLIVNLIQAICYVVVRPVSKNLYRRMNRVVAELLWLELVWIIDWWAGVKVQVFTDPETFHSMGKEHALVISNHRSDIDWLVGWVLAQRSGCLGSTLAVMKKSSKFLPVIGWSMWFSEYLFLERSWAKDERTLKSGLQQLRDFPLPFWLALFVEGTRFTQAKLLAAQEYAASAGLPVPRNVLIPRTKGFVSAVNHMRSFVPAIYDVTVAIPKSSPAPTMLRLFRGKSSLVHVHIKRHAMKDLPEEDEAVAQWCRDVFVAKDALLDKHIAEDTFSDQELQDTGRPVKSLVVVILWACVVVTGVVKFLQWSSLLSSWKGVAFSAFGLGVVTLLMHILIMFSQSERSTPSKVAPTKKSKNSEQLEARDNKQD

SEQ ID NO: 16906 - protein, 503 aa, Streptomyces coelicolor
MGSHSRRRILRGAAVAAAGSVVGSGLGPGFFSAAAQATPAAPKGGSAPATPFLEGAFAPVTEELTAFDLDVVGRIPADLDGRYLRNGPNALGIEDVRAHHWMIGDGMVHGVRLRGGRAEWYRNRWVRSSQVTAKLGETYPGQAPPDDFPCNTHVIPYHGRILALQEGGPLPYELDGELNTLRPYDFRATQKGAFAAHTKYDAVADELHAIAYYPTWDHVRHIVVDRTGRARPATRIPVADAPMMHDFALTEKYVVIVDVPITFDGAAAEAGAIVPYVWNDRHPMRLGLLPRTGGTTRWFEIDPVYYSHTLNAYDQGDTVVLEYIGFPAPFYAAGRGVGGPSATGSPTLDRWTVDLGAARVRSTRLDDRPQEFPRINESLVSRRHRYAYTACAAEMWRAYETVDGVCPDEKFTNYLVKHDMLRGSRQLHRFPRGAAVGEPVFVPRRGARDEDDGYVLSYVNDPDRGATDLVILSAQNFGGRPRARVRLPGRVPLGFHGSWVPDA

SEQ ID NO: 16907 - protein, 457 aa, Mycoplasma gallisepticum
MMQLIEIKELLLSHSKREGEQVVLVGSFKSIRSSGAIGFIAFSDSTALEPVQIVFKKENTPNFDEISKLPISSMILVKGVVRNTPEKKQPFEIQASKIVVLKEADPSYPLQKKAHGSEFLRENAHLRVRTNKFYVIMKIRSELANAFFEFFKNNDFLYVHAPLITSNDSEGAGESFEVISPNDPNYFGKKASLTVSGQFAAEAYAQGFKRVFTFGPTFRAEKSHTSKHLSEFWMIEPEVSLMDLDKLTILIEQCVKHAIYYLFDYAKPELEWCNENLEPGLIDKLNNVINNDFPRVEYREVIEILKKAVAEGVEFEVKDIHFGMDLKSEHERYICEKVFKRPVFVINYPKDVKAFYMKLNDDNQTVAATDLLAPGIGEICGGSQREDSYNKLLTRCLELDIDPEFNNLQWYLDLRKYGYYRSAGFGLGFERLLMYVTGCDNIRDAIPFPRFHGQLDF

SEQ ID NO: 16908 - protein, 261 aa, Prochlorococcus marinus
MNTNQFGTVHLVGAGPGDPDLLTVKAQKLISKCDALVYDSLVPVELLALVSSNCQLHSVGKRRGHHSVPQRTTNDILFDLSKSYSCIVRLKGGDPFLFGRGAEEASYLHKKGVPVQVVPGVTSGIAAPAYVGIPITHRLAGSSVTFVTGHEGIDKKRPAVNWRSLAKSSDGIVIYMGVHNLKFISAELIAGGMNPETSAAVIEQGTVIGQRYIKSPLVKLFDRVQEENLRSPAIVVIGSVVDFQVEACSPKPAEVTFPIPI

SEQ ID NO: 16909 - protein, 413 aa, Fagus sylvatica
MAGICCGVVGEGETTAPIELSSRPSRRRRIDLVPLKLMADVAAPQPLETDKKRQKLCLNTTSSLPSQVVENCKCVEEENEEKKKTNKNEALHTNQAANSCESSKPVEGRNNEEAVQECPKFGVTSVCGRRREMEDAVSVHPSVSNNFHFFGVFDGHGCSHVAMRCRDRLHDIVKEEVESVTEGMEWKDTMEKSFDRMDKEVQEWRVPIKTTNCRCDVQTPQCDAVGSTAVVAIVTPEKIIVSNCGDSRAVLCRNGVAFPLSSDHKPDRPDELVRIQDAGGRVIYWDGARVLGVLAMSRAIGDNYLKPYVISEPEVTITDRTAEDECLILASDGLWDVVSNETACGVARMCLRAQKPSSPPRSPGNDMAVGAASESSDKACSDASILLTKLALARHSTDNVSVVVVDLRRNHQQ

SEQ ID NO: 16910 - protein, 154 aa, Arabidopsis thaliana
MGNRCARTSCCRKLWSCICCCSNNNNNSYGQTRSQHGSKGKVHPVSRIEKWEEKITEANNHGKILVVNFSAPWCVPCKKIEPVFRDLASRYPSMIFVTVDVEELAEFSNEWNVEATPTVVFLKDGRQMDKLVGAETSELQKKTAAAADLFLRKP

SEQ ID NO: 16911 - protein, 395 aa, Unknown
  Candidatus Kuenenia stuttgartiensis
MQTLQLTNSVYWTGVLHATLRTFDVVFETRFGSTYNSYLIMADKPTIIDGVHEKFTPEYLNKLQSLIPLKDICYIVVNHTEMDHTGSLGQLLKLAKNAQVLSTKTASMFLKNILNSEFNGKTVEDGECISLGNRQLQFIHAPFWHWPDTMFTYLHDDAILFPCDGFATHFCDERLFDDRVDEFFEDFRYYFEHIMGPFRKKILEALDKTNQLDIKMIAPSHGPILRTDPQKYIKAYKEWSTPLPPRSKKLIVILYVSVYGNTKKMAEAIAKGACTISSEAKLLDVAAISPEHARFEIESADGLLFGSPTMNGDAVKHMWDMMNILFSLNIKGRKCATFGTYGWSGEAVKLMEDRLRGLKLNVVQPSLKANFIPTEEILKKCSIFGYDFAKSLTSP

SEQ ID NO: 16912 - protein, 1320 aa, Emericella nidulans
MGKTSAKDVAELKDYQLGDCLGRGAFGSVYRALNWNTGETVAVKQIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQVGPTLRTPEGSDHAADVHQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHRVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 16913 - protein, 725 aa, Clostridium cellulolyticum
MLKTKRKLTKAIGVALSISILSSLVSFIPQTNTYAAGTYNYGEALQKSIMFYEFQRSGDLPADKRDNWRDDSGMKDGSDVGVDLTGGWYDAGDHVKFNLPMSYTSAMLAWSLYEDKDAYDKSGQTKYIMDGIKWANDYFIKCNPTPGVYYYQVGDGGKDHSWWGPAEVMQMERPSFKVDASKPGSAVCASTAASLASAAVVFKSSDPTYAEKCISHAKNLFDMADKAKSDAGYTAASGYYSSSSFYDDLSWAAVWLYLATNDSTYLDKAESYVPNWGKEQQTDIIAYKWGQCWDDVHYGAELLLAKLTNKQLYKDSIEMNLDFWTTGVNGTRVSYTPKGLAWLFQWGSLRHATTQAFLAGVYAEWEGCTPSKVSVYKDFLKSQIDYALGSTGRSFVVGYGVNPPQHPHHRTAHGSWTDQMTSPTYHRHTIYGALVGGPDNADGYTDEINNYVNNEIACDYNAGFTGALAKMYKHSGGDPIPNFKAIEKITNDEVIIKAGLNSTGPNYTEIKAVVYNQTGWPARVTDKISFKYFMDLSEIVAAGIDPLSLVTSSNYSEGKNTKVSGVLPWDVSNNVYYVNVDLTGENIYPGGQSACRREVQFRIAAPQGRRYWNPKNDFSYDGLPTTSTVNTVTNIPVYDNGVKVFGNEPAGGSENPDPEILYGDVNSDKNVDALDFAALKKYLLGGTSSIDVKAADTYKDGNIDAIDMATLKKYLLGTITQLPQG

SEQ ID NO: 16914 - protein, 375 aa, Unknown
  Marinobacter sp. ELB17
MAKRDYYETLGVSRDADDKEVKRAYRKLAMKYHPDRNPDDKDADNKFKEASEAYEILADANKRAAYDQFGHAGVDGQGGGGFGGGNGNFSDIFGDVFGDIFGGGGGRGRNTRGSDLRYTLDLDLEEAVKGRTVKITIPGHRECETCDGSGAEKGSRPEACGTCKGMGQVRMQQGFFTVQQACPTCRGAGKVIKNPCSKCHGQGRVKEEKTLSVKVPPGVDTGDRIRLSGEGEMGIEGGPPGDLYVQMAVREHSIFTRDGRNLYCEVPISIVDAALGGELEVPTLDGRVKLKIPAETQTGKLFRLRNKGVAPVRGGGAGDLLCRVTIETPVRLTKRQKELLNEFQDTLDSGDGDQHGPKKTSWFRGVKSFFDETKF

SEQ ID NO: 16915 - protein, 306 aa, Oryza sativa
MATTASSLLKTSFAGARLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKEGRVGGVVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMVRTKKTSNSSP

SEQ ID NO: 16916 - protein, 96 aa, Unknown
  Bradyrhizobium sp. BTAi1
MAKEELIQFEGLVTEILPDARYRVQLDAGHEIVAYTAGKMKKNRIKTLAGDRVTVEMSPYDLEKGRLIFRHKDERPSSPGGPPRGAPQRGGQFRRR

SEQ ID NO: 16917 - protein, 625 aa, Gibberella zeae
MLSHPENTDLIVPYLYQLDMVAGLLAVGNQIMALLAWQHQWDHQNGVSNTLRRLSHTPFAMSPFTVGDYLAERIAQIDIRHHFIVPGDYNLILLDKLGGHPSLTEIGCTNELNCSLAAEGYARGHGVSVCIVTYSVGAFSAFNGIGSAYAENLPVILISGSPNTNDVSQHILHHTLGIYDTTYQLEMAKKITCCAVRIRQAAHAPELIDRAIRAALTQRKPVYIEVPTNLAGETCPRPGPISSVISAVPSDRHSLDVAVTKTAEYIGSKQKCVVLVGPKVRRAMAQDALRQFVEAIGSAVVLQPAAKGTFPEDHAQFCGIFWGQVSTLAADTIVNWADLIICIGAIFTDYSTVGWTALPSVPQLFVDLESVTVASKIYCSRVQMSEFLSRLAETVCWNDNTMVEYNRLRPDPTLGEPSCGPERLTRKEITRQTQALISLNPQTVIFADTGDSWFNGLKLNLPFGADFEIEMQWGHIGWSIPASFGYALAKPHKRIVVMVGDGAFQMTAQEVSQMVRFRVPIIILLMNNKGYTIEVEIHDGSYNCVQNWDYARLVQAFSTENGNGHALGLEARTAEELSNSLERAIVHTNGPTLIDCSLHRDDCSRELITWGHFVAAANARMPKKE

SEQ ID NO: 16918 - protein, 456 aa, Escherichia coli
MEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGAWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 16919 - protein, 467 aa, Candida glabrata
MIRYIAKRHVSIKTLYDSVPKDGQKLDMVNGWVRSVRLMKKVAFVDLYDGSSNKDVKIVIKNPQESSLVRHLKTGQCISVDSPLLKITQGSRIQPFELLVEDSVKDLKLLGDVETNYPLQKKSHSLEFLRTLPTLKHRSLFYGSILRFRSHMEEYAINFFNKQENFLKVSPPIFTTNDCEGAGEQFEVKSSVLENKKAFLTVSTQLHLEILSMAIANCWTLSPCFRAEKSATPRHLMEFWMLEAEMSFIDNLDQLLDFTRNFLQSMVTQCYENREDLLPDNISTLINKEKILERWQMLRNSENWKRITYTDAIQILKEKHSQEPFPRYKPKWGEALQTEHEKWLAEKYFQSPVFVTDYPMDCKAFYMKSNEDGKTVACFDLLVPEMGEIIGGSMREDNYESLQYQIKKRGMNNTGELDWYVNLRKQGVAPHGGFGLGFERFISYLLGIQNIKDTIPFPRSASSSIDL

SEQ ID NO: 16920 - protein, 642 aa, Zea mays
  misc_feature (435)..(435): Xaa can be any naturally occurring amino acid
  misc_feature (621)..(621): Xaa can be any naturally occurring amino acid
HSQHHPPRRRDSRQEEGINSLPASEGGEVYCSVHQCAHRPAGLLISSTTSGLIGVGALATSHLVATRAGLGVPDTLSMRTSARAAPRLQHQQQQQARRGARFPSLVVCASAGMNVVFVGAEMAPWSKTGGLGDVLGGLPPAMAANGHRVMVVSPRYDQYKDAWDTSVVSEIKMGDGYETVRFFHCYKRGVDRVFVDHPLFLERVWGKTEEKIYGPVAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVGXFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVPXAQPGVEGEEIAPLAKENVAAP

SEQ ID NO: 16921 - protein, 236 aa, Arabidopsis thaliana
MTKRYWNIDLEEMMRAGVHFGHGTRKWNPRMAPYISAKRKGIHIINLTRTARFLSEACDLVFDAASRGKQFLIVGTKNKAADLVSRAAIRARCHYVNKKWLGGMLTNWSTTEKRLHKFRDLRTEQKTEGFNRLPKRDAAVLKRQLSRLETYLGGIKYMTGLPDIVIILDQQEEYTALRECITLGIPTISLIDTNCNPDLADISIPANDDAIASIRFILNKLVFAICEGRSSYIQNS

SEQ ID NO: 16922 - protein, 604 aa, Desulfotalea psychrophila
MLLLAGAFRAWAMMLVSIGIIIKILLEKRMGERIVIIGGVAAGPKAACRIKRLSPRAEVVVIDQDALISYGGCGIPYYVSGDVADEKELRSTSFHMLRDEFFFDKAKRVTAMTSTRAISIDRAEKTVLLQDVKTGAEETVSYDKLLLATGSQPFILPIPGVDLDGVFTVTDMHKAIEIKARIAKGQVGKAVVIGGGAIGIEMAEALKDLWGVETSLVEFQKQLLPNILDWPMAAMLAQHMDDKDVHLYLGESAAEIVAGDADHVAGVRLSSGKTLDCDMVIMATGVRPRSELAKEAGLHVSSKGGIVVNERMQTSDPTIYAAGDCVEIPHLVSGRSFYAPLGSLANKEGRVAADNIVGIPTIFKGAIGSFILKAFDFSAASTGLSLESALAEGFDADVSLTSSSDRAHFFPTQQVLCLQLVFDRRTRRVLGLQGIGGASDALLARIDAAAVAITAGATVDDFGNIEMAYAPPFSTAIDAINAAGYVAENLIDGRMRQMRLELFYAWMENVTSQPDWLVLDVRHPKQAKPFMEKYGDLWLNLPYEQVRDRYAELPTDKTLVIFCNAGSRSFEIQRLLDSVGLENNIVLAGGYNFIKRMGADWLPV

SEQ ID NO: 16923 - protein, 387 aa, Zea mays
MIPSVRLSPGPAAFSGSSLRSKLPSIPSISSLKPSKYVVSSLKPLYLAPLDGPRTAELKSRRQPLEFRCSASAADDKESKTQVVPVQSEGAQRLKISIYFATWWALNVIFNIYNKKVLNAFPYPWLTSTLSLACGSAMMLFSWATGLVEAPKTDLDFWKVLFPVAVAHTIGHVAATVSMSKVAVSFTHIIKSAEPAFSVLVSRFFLGETFPIPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWIAAQSVFYHLYNQVSYMSLDQISPLTFSIGNTMKRISVIVSSIIIFHTPVRAVNALGAAIAILGTFLYSQAKV

SEQ ID NO: 16924 - protein, 375 aa, Xanthomonas campestris
MSKRDYYEVLGVARGASDEELKKAYRRCAMKHHPDRNPGDAAAEAAFKECKEAYEVLSDGNKRRAYDAHGHAAFEHGMGGGGGPGGPDMGDIFGDIFGNIFGGGAAGPRAARRGADVGYVLELDLEEAVAGIERRIEIPTLVECAPCHGSGSEDGKVETCGTCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 16925 - protein, 530 aa, Desulfitobacterium hafniense
MSAERLQSFGEISLSKQVLQALSEMGFEEPSPIQKAAIPVAMDGVDLIGQAQTGTGKTAAFGIPICEKVNPKFQAVQALILTPTRELAVQVSEEISKIGKYRHIKPLPIYGGQSIDRQIRALRFGSQVVVGTPGRILDHLNRGTLKLQYVKMVVLDEADEMLDMGFVEDIETILKQVPKEERQVMLFSATMPPEIKKLAQNYMHQPKSVAVSRDELTVPLIEQVFYEARDKIKVDALCRIIDMEDIGQAIIFCRTKRGVDELVAALEARGYFADALHGDLSQQQRDRVMKKFRDGKVELLVATDVAARGLDIDNVTHVINFDIPQDPESYVHRIGRTGRAGRKGQAITLVSSREYRQLRLIERLIKTRIIRKELPTLADVSERQAENLKNQLVKILQRSHLGTYRSIVGSLLEEYDSMDVAAAALKFAVEGVEERSEEEDDIAFGNTGAAPGMVRLFMNIGRLQQVRPQDIVRWIADESGIPGNIIGMINIYDKFTFVEIPEQHASRVLSCMHQNMIKGRKVNVEPAKAR

SEQ ID NO: 16926 - protein, 939 aa, Mycobacterium smegmatis
MTLLSEPDFGTPAKPGPATVTVEVDGIPVSVPEGTSVMRAAAEAGIDVPKLCATDRLDAFGSCRLCLVEIDGRRGTPASCTTPVAEGMVVHTQTPKVAKLRESVMELYISDHPLDCLTCPANGDCELQDMAGVVGLRQVRYGYEGANHFDAEPDHSNPYFDFDPSKCIACSRCVRACGEIQGTFALTIEGRGFESKVSPGAGELFMDSECVSCGACVQACPTATLQERSVVELGIPTRSVTTTCAYCGVGCSFKAELRGDELVRMVPQKAGGANEGHSCVKGRFAFGYATHPDRVLRPMVRDKITDPWREVEWDEAINTVARRMQEIAQRHGAGAIGAITSSRCTNEEVYVVQKMVRAAFGNNNVDTCARVCHSPTGYGLKQTFGESAGTQDFRSVAEADVIVVIGANPTDGHPVFASRMKQRIREGARLVVVDPRRIDLVRSPHIEADHHLQLRPGTNVAVVNAMAHVVVTEGLTDASFVAERCEGFEEWAEFIAREENSPEAVEPITGVPAEELRAAARLYALAPNAAIYYGLGVTEHSQGSTMVMGMANLAMACGNIGRDGVGVNPLRGQNNVQGSCDMGSFPHELPGYRHVSDDAVRQVFENLWGTELLAEPGLRIPNMFDAAIEGSFRGLFVHGEDIAQSDPNVKHVLAALESMELVVVQDLFLNETSKYAHVFLPGASFLEKDGTFTNAERRINRVRAVMKPKSGMHEWDIVCRIATAMGYPMHYDHPSQIMDEIATLTPTFTGVSFDKLDQLGSIQWPCDEEAPEGTPIMHVDAFTRGLGRFVPTPFVPTDERSTRRFPLILTTGRILSQYNVGAQTRRTANIAWHAEDVLEIHPHDAEVRGIADGDLVTLASRVGETTLHAQTSDRMPTGVVYTTFHYPVTGANVVTTDSSDWATNCPEYKVTAVQVALAPPSARQAEARVDELPETELVR

SEQ ID NO: 16927 - protein, 222 aa, Coprinopsis cinerea
MLSPAKENWRAAINRVTNQPASGKPRTTRCAHQIRERLYLSDYWTAKDAEEIGKLGITHIVSVIDRPPTQLPESIPQSNRLQVSIKDYSDADILVHLEETTNFIARVLAENDTNKVLVHCLQGISRSATVVCAYLIATEGMQSHEAIEHVQSIRNVVCPNLGFRLQLLQYADRFPKKEEQRMSPVVTEFVQRIRKALAMPSKRSSKEVQTPSLPVVPAAGAS

SEQ ID NO: 16928 - protein, 104 aa, Streptococcus thermophilus
MTKVVTDTTFEQETAEGLVLIDFWATWCGPCLMQAPILEQLSEEISEDELKIVKIDVDENPETAQKFGIMSIPTLLFKKDGEVVKQVAGVHTKEQIKAIVSELS

SEQ ID NO: 16929 - protein, 499 aa, Dechloromonas aromatica
MRHALLFSVFVIASCGLAYELIAGALSSYLLGDSVTQFSTVIGTYLFAMGAGSWLSKYITRDLIGRFIQIELMVGLLGGFSAVGLFLVFTWLSAPFKLVLYLAVFGVGVLVGLEIPLVMRILKRELAFKDLVSQVLTFDYLGALAVSILFPLVLAPQLGMVRTGLLFGVLNVAVALWALHLFREQLPSRRWLAMQSWGVFGLLAIGFAGAGQLTTFAEAHLYADEIVHAETTPYQRIVVTRWRDDLRLFLNNNLQFSSHDEYRYHEALVHPGLASLPGAKRVLVLGGGDGLAVREILKYPNVESVTLVDLDPAMTDLFATAPALVALNQGALKSERVTVVNADALQWLEDSKEYFDFIVIDFPDPANFALGKLYTSAFYRLIEKRLSARGLLVVQSTSPLYARQSFWCVVATLESAGFKTAPYHALVPSFGEWGYIIAGRQAFSMPAFASDKTRFLTSETLAGMFNFPADMARVPAEVNQLNNQVLVRYFETEWRKVIR

SEQ ID NO: 16930 - protein, 580 aa, Oryza sativa
MDDDGETPMPSLELHKLPTLAGAAIPNPIARHPLYHPSPSFFISPTDVVLRDILFDASPASAAGERRRRHVAAYHRAGPRREVAFDPATVRAAIFTCGGLCPGTNTVVRELVVGLSELYGVRGGVFGVRNGYRGFYSDEVVPLDPAAVEHWHKAGGAALGTSRGGFDLARIVDAIERHGFNQVYAVGGDGTMRGAARIHREVRRRGRLAVAVAGIPKTVDNDVGVVDRSFGFHTAVEAAQQAIAAGHVEAESAANGVGLVKLMGRSAGHIALHATLSSRDVDCCLIPEEDFYLRGAGGLFDFLYRRIKDNGHAVVVVAEGAGQRLIPRTTTTSASGACAGADESGNETFLDVGAWLKAEMRAWWEEEHAGEVFTVKYIDPTYMIRAVPANAGDNLYCTLLAHAAIHGAMAGYTGFVSGTINGNYAYIPMDEVAEAKNPVDTKDHKWAWSFVVYLGGHSHGRGGAALASSQERAKNSHHEFLGSFLGSKEKARDAIFYSYTKYINGFAATLEEEEAMEISKHPSVISVFPNRGHRLHTTRSWEFLGMEKDGRIRANSIWAKARFGEGVIIGNLDTGNLTSA

SEQ ID NO: 16931 - protein, 223 aa, Nostoc punctiforme
MSGLPEPIRGAYEGVSSDSYIKDIPIAKALDNDVLLAYKLNGEFLSAERGFPLRLVVPGYYGTNFVKWLSHIYVTDRRSPGPFTTTFYNDRVGGDDATLKPVWEVAPESVIVHPSQNELLYLQPQTFSGWAWASKGIQSVDVSTDGGITWQAVEVEARLQYAWQRFTFQWTPPTPGQYSLMSRATDYDGAIQPIQQERNAVYIVAVTVKETTVKESKPFTVAE

SEQ ID NO: 16932 - protein, 117 aa, Glycine max
APTGGFLSLRKGLPPPARLFGFGGVLFALIEGAGIMLNKFLRAPHPMPIIFDKPFPPNGVPGQPVFLAPDLASQYLWLGGWFAHGKKKKAAAGAPGGKGTQVLKCFYAPPGPHFEAK

SEQ ID NO: 16933 - protein, 273 aa, Triticum aestivum
  misc_feature (138)..(138): Xaa can be any naturally occurring amino acid
MANASLQSFLPQHHHSFLNSNTHDGSPPALLKLTTNSTNASNSISFKLFASSSSSVTTTANSPAPTPVAAAAAATTSPPTPSLELLGQQLAAGDYRQADETTRALLIVLAGEAARRRGYVFFSEVQFISVEDLRAVEXLWLEHSGGRFGYSVQRRVWDKSLREFTRFFIKIGWMKKLDTEVEQFNYRAFPDEFIWELTDDTPEGHLPLTNALRGTRLLENIFTHPAFDCEEDEAAGADEEADKGSATGQNNKDDNKGRGRPKSLTDFKPDYSF

SEQ ID NO: 16934 - protein, 512 aa, Bacteroides fragilis
MDYPHKINKVQIRNLQIEDYAQLSQSFTRVYSDGSDVFWTHEQIEKLIKIFPEGQIVTVVDEKIVGCALSIIVEYDKVKNDHTYAQVTGKETFNTHSPQGNILYGIEVFIHPEYRGLRLARRMYEYRKELCETLNLKAIMFGGRIPNYHKYADKMRPKEYIDRVRQREIYDPVLTFQLSNDFHVRKVMTNYLPNDEESKHYACLLQWDNIYYQPPTQEYLAPKTTVRVGLVQWQMRSYKTLDDLFEQVEFFVDAVSDYKSDFVLFPEYFNAPLMSKYNDKGESQAIRGLAQYTEEIRDRFINLAISYNINIITGSMPLIKEDGLLYNAGFLCRRDGTYEMYEKLHVTPDEIKSWGLSGGKQLKTFDTDCAKIGILICYDVEFPELSRLMADQGMQILFVPFLTDTQNAYSRVRVCAQARAIENECFVVIAGSVGNLPRVHNMDIQYAQSGVFTPCDFAFPTDGKRAEATPNTEMILVSDVDLDLLNELHTYGSVRNLKDRRNDVYEVRFKKP

SEQ ID NO: 16935 - protein, 141 aa, Sorbus aucuparia
YNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAG

SEQ ID NO: 16936 - protein, 574 aa, Arabidopsis thaliana
  misc_feature (494)..(494): Xaa can be any naturally occurring amino acid
MGDEIVPPANQLAADNLENDGSTVQKAQFSDRVLIRSILGGGAKLAGQKVRIGGWVKTGRQQGKGTFAFLEVNDGSCPANLQVMVDSSLYDLSRLVATGTCVTVDGVLKIPPEGKGLKQSIELSVETVIAVGTVDPTTYPLPKTKLTPEFLRDVLHLRSRTNLISAVARIRNALAFATHSFFQEHSFLYIHTPIITTSDCEGAGEMFQVTTLINHTERVEQDLIDNPPPTEADVEAARLIVKERGEAVAQLKVAKASKEEITASVAQLSVAKASLAHVEERLRLKPGLPKNDGKIDYSNDFFGRQAFLTVSGQLQVETYACALSSVYTFGPTFRAENSHTSRHLAEFWMVEPEIAFADIHDDMNCAEAYVKYMCKWLMDKCGDDMELMDKNVDEGCTKRLNMVAKASFKRVTYTEAIERLEKAVAQGKVVFDNKVEWGIDLASEHERYLTEVEFDQKPIIVYNYPKGIKAFYMRLNDDEKTVAAMDVLVPKINXVGELIGGSQREERYDVIKQRIEEMGLPMEPYEWYLDLRRYGTVKHCGFGLGFERMIQFATGIDNIRDVIPFPRYPGKADL

SEQ ID NO: 16937 - protein, 321 aa, Ureaplasma parvum
MNQVNFLNLDKNILIITSGGDAPGMNASLISLIHRLMNNNFNVFIGIEGLLGLYNNLIEPIKDKRVFDVYFNEQGTVIKTSRFIKLDINDKKTQIIKDNLLSHNIQKIIILGGQGSMQAGLVLTKMGFEVFGILHTIDNDFSETQMCIGALSAASFNQKLLKCLNYTAKAHCAFNLVELMGRECSWLVNNSVGKLKPILMLTNQDNKYTVDEVIDLIKNKINSIKEYDPLIIVQELIYDQKWYELLVKTFEQKLHKSLRITILNYLQRGAPVSDFDLQLAKDSANVLVDFIVNQNDIKNTNNMYVVINKFDNKLEVIKFNK

SEQ ID NO: 16938 - protein, 137 aa, Chlorobium tepidum
MNQQTYAFTLEMEVRDYECDMQGIVNNSVYQNYLEHARHVYLKTVGIDFKEFTERGINLVVVRAELDYKLPLQSGDRFRVGLNMVRQSPLRFAFYQDILRLPDMKPAVKARIIGTALNGRGRPEIPAELEALMQPGE

SEQ ID NO: 16939 - protein, 714 aa, Unknown
  Mycobacterium sp. JLS
MAAAPRPNVTPEVWPGKAYPLGATYDGFGTNFALFSEAAERVELCLFDADGEQTACVTLPEVDGFVWHGFIPNIEPGQRYGYRVHGPYDPPNGQRCNPNKLLLDPYAKAIDGTFDWGQPLFSYNFGDPDSRNDDDSADCMPKSVVINPYFDWGTDRPPNHEYADTVIYEAHVKGLTQTHPDIPEQIRGTYSAVAHPVIIDHLKSLGVNAIELMPVHHFANDSTLLDKGLSNYWGYNTIGFLAPDPKYSSSLTPGGQVQEFKAMVRTLHEAGIEVILDVVYNHTAEGNHMGPTLSFRGIDNAAYYRLVDDDKRYYMDYTGTGNSLNAGHPHALQLIMDSLRYWVTEMHVDGFRFDLASTLAREFYDVDRLATFFELVQQDPTVSQVKLIAEPWDVGPGGYQVGNFPPQWTEWNGKYRDTVRDYWRGESATLDEFASRLTGSSDLYEHTSRRPVASINFVIAHDGFTLRDLVSYNEKHNEDNGEDNNDGESHNRSWNCGVEGPTDDPQVNALRSRQQRNFLTTLLLSQGVPMIAHGDELGRTQHGNNNVYCQDNELSWIDWSTVDTELMAFTQKVSELRAAHPVFRRRRFFSGRPVRQRGAPGLPDIAWFAPDGSEMTDEDWDSGFAKSIAVYLNGQGIPDLDVRGQRVTDDSFLLCFNAHHEPLEFAMPAAEFARAWLPVINTADDDDARESVTAGAKIEVAERSVLVLQAVNEP

SEQ ID NO: 16940 - protein, 105 aa, Corynebacterium nephridii
ATVKVDNSNFQSDVLQSSEPVVVDFWAEWCGPCKMIAPALDEIATEMAGQVKIAKVNIDENPELAAQFGVRSIPTLLMFKDGELAANMVGAAPKSRLADWIKASA

SEQ ID NO: 16941 - protein, 1400 aa, Oryza sativa
MAWFWRMSRGLSGPRVWPVVGSLPGLVQHAENMHEWIAANLRRAGGTYQTCIFAVPGVARRGGLVTVTCDPRNLEHVLKSRFDNYPKGPFWHAVFRDLLGDGIFNSDGETWVAQRKTAALEFTTRTLRTAMSRWVSRSIHHRLLPILDDAAAGKAHVDLQDLLLRLTFDNICGLAFGKDPETLAKGLPENAFASAFDRATEATLNRFIFPEYLWRCKKWLGLGMETTLASSVAHVDQYLAAVIKARKLELAGNGKCDTVAMHDDLLSRFMRKGSYSDESLQHRKVVHELCAVLAASRGAHDPALWLAAPFTFEELDSLVYLKAALSETLRLYPSVPEDSKHVVADDYLPDGTFVPAGSSVTYSIYSAGRMKTVWGEDCLEFRPERWLSADGSKFEPHDSYKFVAFNAGPRICLGKDLAYLQMKNIAGSVLLRHRLAVAQGHRVEQKMSLTLFMKNGLRMEMNPKGKRSSNCYFYLQLPETKDTCVISKFQCVISSVKSCPTCFIFNMPPWWGKSSSKEVKKTAKENLIDTFHRLLSPNEQKGRTKSRGNRRHSKDPTAEKGCWSTAQSRSASPSKEVSRCQSFAAARAHAQPLPLPRSRAMVARTASDITESKVVLEKRGKGQQLPLPTTNWVKERPETTEPVAELSTASISSHGSIDSDDPGDLRLQGPVANDTDNVAKVATTGNSSVVHKECSSAITRKGTKEVTMPTNAFLSNQILSTSPRGTVVADSYQSNLQNSRKVVLDSAPNSVMSSPSRSPRILCPDQIPSSAFWAVKPHTDVTFVGSAQCSSPGSGQTSGHNSVGGDMLAQLFWQPSRGSPECSPIPSPRMTSPGPSSRVHSGSVSPLHPRAGGMAPESPTRRLDEGKRKQTHRLPLPPLSICNNSTFLPNNSTPTSPISHSPGRVENPTSPGSRWKKGKLVGRGTFGHVYIGFNSDKGEMCAMKEVTLFSDDPKSKESAKQLCQEILLLNRLQHPNIVRYYGSEMVDDKLYIYLEYVSGGSIHKLLQEYGQFGEPAIRSYTKQILLGLAYLHAKNTVHRDIKGANILVDPNGRVKLADFGMAKHINGQQCAFSFKGSPYWMAPEVIKNSNGCNLAVDIWSLGCTVLEMATSKPPWSQYEGIAAVFKIGNSKELPPIPDHLSEEGRDFIRQCLQRDPSSRPTAVDLLQHSFIRNASPLEKSLSDPLLQLSTTSCKPDLKVVGHARNMSSLGLEGQSIYQRRAAKFSSVHSDIHVRSYISCPVSPCGSPHLRSRSPQHQNGIMSPSPISSPRTTSGASTPLTGGNGAIPFNHARHLAYNNEGFTITSRCLDEPLPNQPPDPVLGRFVRVKQPSLGFQERAVPEADILSPQFGRMGHVSVWNLHDKPLPSEHASQKGFEDRVKLKPPLDLRSGPPHLGCNHGH

SEQ ID NO: 16942 - protein, 369 aa, Arabidopsis thaliana
MALVQRIPISSSSIRNWQQARTNLTPICCLHYNTASSSSSPFTEKHSVERYQRDQWLYKAVEPTPPSTPSPSPFEDEVFVRENDIASQLPELKKLLAVLKEKRVKGCKGGDCGPGDVYLVGTGPGDPELLTLKAVRVIQSADLLLYDRLVSNDVLELVAPDARLLYVGKTAGYHSRTQEEIHELLLNFAEAGATVVRLKGGDPLVFGRGGEEMDFLQQQGIRVQVIPGITAASGIAAELGIPLTHRGVATSVRFLTGHSRKGGTDPLFVAENAADPDTTLVVYMGLGTLPSLAQKLMDHGLPSDTPAVAVERGTTPLQRTVFAELKDFATEIQSAGLVSPTLIIIGKVVELSPLWPHCTKESSCLVETR

SEQ ID NO: 16943 - protein, 117 aa, Glycine max
  misc_feature (47)..(47): Xaa can be any naturally occurring amino acid
  misc_feature (86)..(86): Xaa can be any naturally occurring amino acid
  misc_feature (97)..(97): Xaa can be any naturally occurring amino acid
MDAMGDRDTVRYRGSCLITVCTYQVITERPEEANCLNVDSIFIHREXDYSLGIGFQSSTYGILMMLCGVLQLTKLHACAYQKLSTXMPLCSIANPKXVLVIDIGDGGVIKKYTPIFN

SEQ ID NO: 16944 - protein, 247 aa, Hordeum vulgare
FGDGMGWDDEDELDQQSMDASSLGVSASLENAAVGAPGGGGGGGNGKGKKKGMPAKNLMAERRRRKKLNDRLYMLRSVVPKISKMDRASILGDAIDYLKELLQRISDLHSELESAPSSAALGGPSTANTFLPSTPTLQPFPGRIKEERCPPAPFPSPSGQQATVEVRMREGQAVNIHMFCARRPGILLSTMRALDSLGLDIEQAVISCFDGFAMDVFRAEQCREGPGLLPEEIKAVLLHCAGLQNAM

SEQ ID NO: 16945 - protein, 469 aa, Bacillus anthracis
  misc_feature (364)..(364): Xaa can be any naturally occurring amino acid
MENLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYNWNLDFGSISMLWRXGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 16946 - protein, 108 aa, Corynebacterium nephridii
MSATIVNTTDENFQADVLDAETPVLVDFWAGWCAPCKAIAPVLEELSNEYAGKVKIVKVDVTSCEDTAVKYNIRNIPALLMFKDGEVVAQQVGAAPRSKLAAFIDQNI

SEQ ID NO: 16947 - protein, 510 aa, Pasteurella multocida
MVVFLFILYRQSDLKFKSMNGVIIVNTLKKRLFVATTMIWGLSVTLPVLAEYKPIEQPVEPANPSLKIESRNDLFKEKYPKQYQTWADTSKSTDLDSVNYEDPRVIVLWAGYAFAKDYKKPRGHFYAVTDVREILRTAAPMTPDAGPMPMACWSCKSPDVPRLIAERGEAGYFGATWASGGSEVVNPIGCADCHDTTSKDFAEGKPALRIARPYVLRALEKIDHKFDTSDRTDQRAALCANCHVEYYFAGDLKQVTFPWDNGITVDAMEKYYDDIGFVDWTHAVSKAPMLKAQHPDYETWMLGVHGKNGVTCIDCHMPKVQGADGKVYTDHQIGNPFNAFEHTCANCHDQSKEKLQAMVKSRKTEIKDVMLRLEDQLVAAHFEAKAAWEAGATKEEMKEALQDIRHAQWRWDYAAAGHGGHIHAPDVLLKVIGTGLDKSSDARTKLVRVLAKHGITDPVQLPDISTAENAWKATGVDIEKERKAKAEFLKTVVPQWDKEAREKGLLPAEK

SEQ ID NO: 16948 - protein, 416 aa, Campylobacter lari
MQDYLEQNSQEDRRGFLKNLGITLLGASALANVSLDNYFLGSKVLAKELDTFKIEGKKDVIYHGERPMTAETQIYALDSDFTKPENFFVRNNGVPPEMSKIKERMKQGWTLEIGGESVKTAKTYTIDELKKKFKHYTYALTVECGGNGRGEVIPSTKGTQWGYGAVACGRWTGVRLKDILEDCGVKDDAVYIGYYGIDTKLNGEEASPISRGVPIKKAMQEETLVAWAYEGKDIPWINGYPLRLVCGGYPASTSGKWLSKIVVRNKVHDGEKMDTSYKVPVNPVKPGDFTSKGEMKIIESMPVKSIITNIKNNDKVKANKKFEVRGKAWAGELEVKEVYVSNDYGVTWTKAKVEKPLNRLAWQKWSTQISIPSKGYYEIWARAVDSEGNSQPMVLAQWNPNGYINNACHRVNVYGV

SEQ ID NO: 16949 - protein, 452 aa, Oryza sativa
MKDLAVLGHLFVAAFMFHFASYMVIPAITDVTMDAVCPGRDECSVAIYLSGFQSAITGMGALVVTPIVGNLSDKYGRKALMTLPVTVAILPLFILACNRSKVYFYVYYVVKVLAGIFCEGSMHCLLLAYVADQVGARRRAAAFGLLSGVSAAGFVSGTLTARFLQTSTTFQVAAAVAAATAIYLRAVVPDSGGANSFVDEACDPFLQGSSCSAATSSSSSSDEEISPRLPPHKGGVPSLSDMVSLLTGSLTLSGAAIVTFFYSLGEHGLQTALLYYLKAQFGYSKDEFANLLLIAGAAGMLSQLTVMPVLARFVGEDILLIIGLLGGCTHVFLYGIAWSYWVPYLSAVFIILSAFVHPSIRTNVSKSVGSNEQGIAQGCISGISSFASILAPLIFTPLTAWVLSETAPFKFKGFSIMCAGFCTLIAFIISMRMRAGQSGASEKLAIVQHEQA

SEQ ID NO: 16950 - protein, 634 aa, Unknown
  Gladiolus hybrid cultivar 'Traveler'
MEGCDCIEPQWPADELLVKYQYISDFFIALAYFSIPLELIYFVKKSSFFPYRWVLIQFGAFIVLCGATHLINLWTFTMHSKTLALVMTVAKVSTAVVSCATALMLVHIIPDLLSVKTRELFLKNKAEELDREMGLIRTQEETGRHVRMLTHEIRSTLDRHTILKTTFVELGRTLDLAECALWMPSRTGLNLQLSHTLHNQIPVGSTVSINLPTVNQVFNSNRAVRIPHTSPLARIRPLAGRYVPPEVVAVRVPLLHLSNFQINDWPELSARSYAVMVLILPSDSARKWHVHELELVEVVADQVAVALSHAAILEESMRARDLLMEQNVALDLARREAEMAIRARNDFLAVMNHEMRTPMHAIIALSSLLLETELTPEQRIMVETMLKSSNLLATLINDVLDLSRLEDGSFELEKSSFNLHTVFREVINLIKPIAAVKRLSVSVSLAPDLPLCAMGDEKRLMQTILNVAGNAVKFTKEGHISITASVSRPDSFRDPQVHEFYPVFTDGHFYLCVQIKDTGCGISPQDIPFLFTKFAHTQNGGNKGYSGSGLGLAICKRFISLMEGHIWLESEGLGKGCTATFIVKLGICESQNGHQQQMIPTNRLLLGGADFPGPGALLKEDNKAIPSKLRYLSV

SEQ ID NO: 16951 - protein, 501 aa, Zea mays
MPPRTAPAATSTPPRKVPLRKLLRAASVACGVQFGWALQLSLLTPYVQELGIPHAFASLVWLCGPLSGLLVQPLVGHLSDRIGPAASPLGRRRPFIAAGAACIAAAVLTVGFSADLGRLFGDDVTPGSTRLGAICVYLVGFWLLDVGNNGTQGPCRAFLADLTENDPRRTRIANAYFSLFMALGNILGYATGAYSGWYSIFPFTVTESCGISCANLKSAFLLDIIVLVITTYTTVTSVQEPQTFGSDEAQNSGAEQEAFLWELFGSLRYFTLPIWMVLIVTALTWMAWFPFTLFDTDWMGREIYRGSPDNPGETQRYHDGVRMGSFGLMLNSVVLGFTSVVLEKLCRKWGAGLVWGVSNILMTLCFLAMLVITYVAKNMDYPSSGAPPTGIVVASLVVFTILGAPLAITYSIPYAMAASRVENLGLGQGLAMGILNLAIVIPQVIVSLGSGPWDQLFGGGNAPAFAVAAGASFIGGLVAILGLPRARIASSSSRRRGGTHR

SEQ ID NO: 16952 - protein, 498 aa, Mycobacterium avium
MARDHAHAALIIGAGFTGLGAAIRLAEAGVDDIVILERADRVGGTWRDTTYPGASCDVPSLLYSYSFVKNPTWSRTYSPAPEIYRHLEDMADRFDIRRRIRFGHEVSGLAFDEDAGVWTATTKNRKKFRARTVVLASGPLSDVSFPDIRGLDSYRGHKIHSARWDHDYDFAGKRVAVIGTGASAIQIIPELVKQAGFVKVFQRTPCWVLPRLDVATPPAVQALFAKVPAAQELARQALYWGHEASATALVWDTPLTSLVARLGKAHLRAQVKDPWLRRQLTPDFRPGCKRMLVSSDYYPALQRDNCKLIDWPIATLSPAGIRTSDGIEHHLDCIVFATGYDVHLTGPPFPVTGLGGRSLAAEWAGGAQAYKSINVHGYPNLFVMTGPNSGPGHNSLLVYIEGQLDYAVRGITTILNDDLRYLDVREEVQRRHNEAIQRRLTKTTWMSGCRSWYLTKDGFNGSMYPGFATQYLRQMSDFRYQDYQAVARRARTPAASSA

SEQ ID NO: 16953 - protein, 257 aa, Glycine max
MASSSSTVALRTISSFSLKPATTTRSLLNTSTSSTITLLPFTSANSFLSKTLKLNTSSPHSHLSLPLNKSFTCRSQAEPSSDSAKVQELSVYEINERDRGSPAYLRLSQKTVNSLGDLVPFSNKLYSGCLQKRVGITAGICVLIQNKSEKKGDMYEAIYSFYFGDYGHISVQGSYLTYEDTYLAVTGGSGIFEGAYGQVKLHQIVFPFKLFYTFYLKGIKDLPQELLSKPVEPSPSVEPSPSAKACEPHAVIAGFTD

SEQ ID NO: 16954 - protein, 294 aa, Brassica napus
AFFTYVKSTVNGNSSVHPGMAEKLQVVASEVNNNGKQTRGGRETEKKKAQGENSVNGTLERSRTLPNSIERSRTLPPPMELQGNRSCYQEGTMDDARVAAAKDSSQFAAQNAYPYYMHGVMNQVMMQSAAMMPQYGHHQHPHCPPNHLNGMTGFPYYHHHPMNTSLQNGHVPLQNGQMQTMVHHHHSWPQVGNHPSPNEVRVTKLDRREEALLKFRRKRNQRCFDKKIRYVNRKRLAERRPRVKGQFVRKMNGVNVDLNGQPEPDSADYDDEEEEDEEEEENRDSSPQDDALGT

SEQ ID NO: 16955 - protein, 1767 aa, Unknown
  Shewanella sp. MR-7
MDKSKLRTFRSKILSHIALPLILIMAAVYGINAWFNYLSAESKLYDSLAQASNHSAYRLQLLLEHAQINTQGMADFIGFITNKEDIRNSEKIKRILTNRLERNPDFYGSAVAFKPYTFANKKLFSPYVFRDGDDFHYLDIGAEGYDYTDGSWDWWSKAINQAGGYWSKVYFDEGAGNTLMVTYSVPFGPENAYFGVATVDLALNQLPEQLGVSPSQLVVLDDQGRLIFHSDKEKVLAMTSAEWLDRNTRQNKDFWALLDKGVNGQARFVDDKNVVYLASVASVAKHKWRVIVMVPEQQLLSTLLDDMASVVLNLSLLTLLLILTCYIAAKRLTRPLEMLESGILAFGQGKTQQLAIPNGAVSEIVTLSSTFNQMAELLAEREQAILDSRGNRFARLIDGMSDKSFYCSLDASGQLAQVSEGVTKVLGMSPELLKRKYQRLFTANPLNEKNWEYTDLALKGQNVPSHQVELLDAGGHPRRLDLFMQPLVSDTGELMSVEMLFTDVTEQFSAAAWSNAVLEAAPEAMLIVDQMGLIVFSNTRCQILFGYEASAMLGLQVESLLPEALRSNHARDRLQFLREGRDRPMANAKHVRALKADGGEFVAEIALSILPADNEGRRQVAASIRDMTQKLAVEQKIRDSELRFRGLVTNIPGAVYRTRIGDVWVMEYVSENIADITGYAASQFIENRQRTFESLILEEDRALCHQHIDRALAQQETFEVEYRIRHRDGSVRWVHEKGKASYTDEGFPLWFDGSIDDITESKLALVELESSRQQLTNITESIPCTVYQLRWISPVDRTFTFLSGAAYHMLGLHRDDLLKDFNIIAERIFDEERSEVVRALAGKSEDKLQWVREFRYRHPNGSTRWMEAGASGHICDDGAIIWNGYVMDITERKAMEEELAVSEAHFKALFDGSTIGIVNIDAKGVILDCNDQYCEDMGQSRESLCGMSIFEVLSLQDKETAKAQFKELAEGRVDHYRGERSFIRPNGEPLWMTVNVSALFDSQKRFESAVVSMVDMTELKLLSDELLVAKEEADAASKAKGDFLANMSHEIRTPMNAIIGMSQLCLQTELDKKQKNYVEKIERASKSLLSIINDILDFSKIEAGKLDIESVPFQLDTMLEDLSDMFSEKAAHKQLELLFAVAPNVPRHLFGDSLRLGQVLINLMNNAIKFTERGEVLLSLNLVEQQNDDVVLRFSVRDSGIGLTAEQQAKLFKSFSQADTSTTRKYGGTGLGLAICKQLVELMGGTIGVESQFGHGSTFYFTVKLQISSGQKLTVAQELEGMSILVADDNATARDIMRTTLESMGFRVDTVRSGEEAVTRCSQQEYAVALIDWKMPNLDGIETAKQIKQLAKNAPRILMVSAHATQEFLSQIEALGLAGYISKPISASRLLDGIMNSLGRAGVLPVRRNSESIDPKLLLPLKGKRILLVEDNEMNLEVATEFLEQVGIILSIATNGQIALDKLAQQSFDLVLMDCQMPVMDGYQATQAIRKRPELAELPVIAMTANAMAGDKEMCLKAGMNDHIAKPIEVNLLYQTLLKYLGGGVLPTEDVSLNQLVEIPVKPINLDSKSVVKWPEHPELDIDRGLQLVQNSTRLYQRIFDRFVTSQRNVVELINKALANDKRDDAVRMAHTLKGLAGNLSSSKLVELARQLELHLSEKTEYQTELDQIQVLVASICEAIERVKPQFEEPTQSATEHLSQEALVSALNQLRQSLEDADSDAVTQIDALKPQVSSKLWQQLSPALTMINQYQFDEAVDLIDEVLAELA

SEQ ID NO: 16956 - protein, 696 aa, Coxiella burnetii
MNKIRKTFQYGKHEVTFETGEMARQATGAVVVRMGDTVLLVSVVAKKEAEEGRDFFPLTVNYQEKTYAAGKIPGGYFKREGRPTEKETLTSRLIDRPLRPLFPKGFTNEVQVIATVLSVDSKVPTDIPAILGASAAIGLSGIPFNGSLGAARVGYRGGEYLLNPSLDELKDSALDLVVAGTRDAVLMVESEAQELPESVMLGAVLHGHQAMQVAIQAIAEFIQEAGGAKWEWEPPTVNTALEKWVVEKSEAPLKKAYQIQEKTARQAQIQAIRDQLLADRAAEREGEENAVNEHELAVIFHELERRIVREQILTGQPRIDGRDTKTVRPITVKVGVLPRSHGSALFTRGETQALVVTTLGTERDAQSIDDLDGDRQEEFIFHYNFPPFCVGEVGFMSGPKRREIGHGRLAKRAVVPVVPTLDKFPYVIRVVSEILESNGSSSMASVCGSSLALMDAGVPTKAPVAGIAMGLIKENDKYAVLSDILGDEDHLGDMDFKVAGTSNGVTALQMDIKIEGITKEIMEQALDQAKEGRLHILSIMNKVLDKPRSQVSDLAPQYVTMKINPEKIRDVIGKGGVVIREITEATNCAIDISDDGTIKIAAHTTEEGEAAKRRIEELTAEVELGKVYEGTVVKITDFGAFVQILPNTQGLVHISQIAQERVENVRDYLEEGQVIRVKVIEIDRQGRVRLSMKQID

SEQ ID NO: 16957 - protein, 197 aa, Oryza sativa
MDPTKSSTPPPVMGAPVGFPPGAYPPPPPAGAAAAAYAQQLYAPPAAAAAQQAAAAQQQLQMFWAEQYREIEATTDFKNQKLPLARIKKIMKADEDVRMIAAEAPVVFARACEMFILELTHRGWAHAEENKRRTLQKSDIAAAIARTEVFDFLVDIVPRDDAKDADAAAAAAAAGIPRPAAGVPATDPLAYYYVPQQ

SEQ ID NO: 16958 - protein, 143 aa, Coxiella burnetii
MTVKKIALVAHDRMKKELIEWIKKHQNLLKHHELYATGSTGQAIEKTLNVTVTKMESGPLGGDLQLGAKIVNKEIDILIFFWDPLEAQPHDPDVRALLRIAVVWNLPVACNASTADYLLTSPLFDSDYHPETPDYEAYRNRII

SEQ ID NO: 16959 - protein, 97 aa, Brassica napus
MASSMLSSAAVVTSPAQATMVAPFTGLKSSSAFPVTRKANNDITSIASNGGRVSCMKVWPPVGKKKFETLSYLPDLTEVELGKEVDYLLRNKWIPCG

SEQ ID NO: 16960 - protein, 194 aa, Bacillus cereus
MRESSQIRETTETKIKLSLQLDDGKNVSVRTGVGFFDHMLTLFARHGRFGLQVEAEGDVFVDAHHTVEDVGIVLGNCLKEALHSKEGINRYGSAYVPMDESLGFVAIDISGRSYIVFQGELTNPKLGDFDTELTEEFFRAVAHAANITLHARILYGSNTHHKIEALFKAFGRALSEAVERNANITGVNSTKGML

SEQ ID NO: 16961 - protein, 463 aa, Unknown
  Burkholderia sp. 383
MQQHTMRRELGARQISFMALGMAIGVGLFLGSASAIKAAGPGALVAYLIGGAMIFLIMRALGEMAVHRPVSGSFGAYAFEYVGPFAGYVVGWSYWLLMVGVGVAETTAIGIYMGFWFPDVPQWLWVVSAIAAISAFNLLNVKVYGELEFWFAIVKVVTIVLMIAGGALIVFTGIGHGGVPVGLSNLWRHGGVFPHGVLGVVSALPIVAYSFAGVEMIGLTAGEAREPQKMIPRAINSVLWRILIFYVGALFIIMALYPWHELGEHGSPFVTTFESLGLRQAAGIVNFVVVTAALSSFNCIVFSGARMLSSMAGNGLAPASFAALSASGSPSRAVRATVLFMSVGVVLNYVIPARVFGWLMSFLSFDVAVIWAMIVLTHMRFRRALAARGETVAFRMPYASVTSWICLVFVAFVFVMLGVDPTTRGSLYAGAAVMALMAIIYRRSRHLQAAARSTRVGLGVERV

SEQ ID NO: 16962 - protein, 321 aa, Ureaplasma parvum
MNQVNFLNSDKNILIITSGGDAPGMNASLISLIHRLMNNNFNVFIGIEGLLGLYNNLIEPIKDKRVFDVYFNEQGTVIKTSRFIKLDINDKKTQIIKDNLLSHNIQKIIILGGQGSMQAGLVLTKMGFEVFGILHTIDNDFSETQMCIGALSAASFNQKLLKCLNYTAKAHCAFNLVELMGRECSWLVNNSVGKLKPILMLTNQDNKYTVDEVIDLIKDKINSIKEYDPLIIVQELIYDQKWYELLVKTFEQKLHKSLRITILNYLQRGAPVSDFDLQLAKDSANVLVDFIVNQNDIKNTNNMYVVINKFDNKLEVIKFNK

SEQ ID NO: 16963 - protein, 542 aa, Coxiella burnetii
MKKLVIVGAQLNFLVGDIEGNTQLIIDAANQAYQESKADLILFPELSITSYPPEDLLFRPALYRRVHQALQTIADKVKNTTVVVGYPDFIDNKCYNKAAVITDGKIVATYAKHELPNYRVFDEKRYFAAGDQPCVIEIKGVKIGILICEDLWLENPIKQSVAAGAQLIACINASPFAQDKSHHRRDLLTKRTKRYHIPIVYLNLVGGQDELVFDGGSLVFNQHGELIQQGSYLKEELITVEFDIDDNLTILTKTPLPPEPLDEEKIYNVLVLGVRDYINKNNFPGAVIGLSGGVDSALTLAIAVDAIGSERVSGVLMPSPFTSTMSIEDAEGEAKALNVRTSTINIQPIFEAFIRSLESEFTGLGKDVTEENLQARIRGTLLMAISNKKDAIVLTTGNKSEMAVGYATLYGDMAGGFGVLKDVYKTMVYRLCRYRNTISRVIPERVLERPPSAELAPDQKDQDVLPPYHILDEILERYIAKDEDPTAIAAGGFDVEMVKKVVRMINRNEYKRRQAPIGIRITERAFGKDRRYPITSGFAKDV

SEQ ID NO: 16964 - protein, 307 aa, Fusobacterium nucleatum
MEKIYDVVIVGAGPAGLTAGIYAGRGNLSTLILEKEGIGSMIMSHQIDNYPGFHIGASGKEIYDTMKKQALDFGCEIKPATVLGFDPYDEIKIVKTDAGNFKTKYIIIATGLGKIGAKKVKGESKFLGAGVSYCATCDGAFTKGRVVSLVGKGDEIIEEALFLTRYAKEVNIFLTSDDLDCNEELKEAVLSKENVKITKKVKLLEIKGEEFVTELDLEIDGNKETVSTNFVFLYLGTKNNIELYGEFVNLSEAGYIITDETMKTRTDKMYAIGDIREKEVRQVATATNDGVIATTFILKEILKSKKK

SEQ ID NO: 16965 - protein, 188 aa, Parvularcula bermudensis
MMITVRGKTIEPLFSADQIAERNIALAEQIAEGPTTDLLVIAVLKGSFIFAADLLRALHAVGLAPEVEFITLSSYGKGTVSQGVRIIKDIDSEVAGRDILLIDDILESGRTLRFARDLMFERGANHVSIAVLLDKTSKRTEGTVEADYVGFECPDHFVVGYGMDVAYAFRELPFVGIVTGDSEGAAPR

SEQ ID NO: 16966 - protein, 1486 aa, Cryptococcus neoformans
MSNPTSPTDPPDAGPPAPAIASSSKTGRRSVRLFAPDEEDSSDEDGLIGVPAETTFNDDEVPPSNTRSASYPGPPAHTSPTSKISSIVSSASAAQPKLARSITYVAPSAISSRPAYPLHPAGPETLHASYETWRKTRYTLESFSRAKADGKNAAQRGRSYTDPDVGYFSPDAGDDGWGSDDEDELRSPGWGISHHNMDSGGKTDGSPQLPIKPADVTEDEGQERLDWQGMLESVLNSDVLKVEEQRIYNSMPTDSFREEIGKTLWWQIRAKLRGRTEAEEKKRVQERRARVVDPVLEEINEFKYDPKNNPEGEEDSDADPQDATSTAAPQSKALNQVNTILAKLHAVKGLYPNLAAMRADKSLYTDENFRKRADALTSWSIIVSSLQTQLKLLQKWTGSDELDITKPNTTHEKALVGKYKYHHSIDSKGTPGRDAADDSSFLDRVIKEDNLQRTFERRAFVDMINLVRNAKETVINYLPQFQEQNLPDFQYEIVRLIGFPGRLIIEAVKVRLDAASRLLDPNPMVVEDFIENLRLSISLAVLIRKQYDEIMAPDAEGRWKIPHCLPTEYNDVLLDALRTFFKLLHWRLRGVGKASYYKETEVLEEEAPFLYEAAEAIVGGDMVVAEQYCALSNKLLIRSANYLDQQLRVPIHSHSRDKERGGDKERDGSSSSQRDRNRDGSLAGPPKHMKVEELFSWYSKLLDSARMRHRKTQRFCRKLTQRFDNSAEYSIEETDVDMLVETLQDTGHFLVYTGKFEANGTYIVADGSLWGQPDDVRHLLKRVFSVTIPGSRVRPRQTTSQVSGGGGVLANGQVAAAQPDPADPYPEADDFDDEALAAYILLISPRQNFVWSGAVMTLDVDYIDYELADNRVRLIADGPTKRLALCKHYFTQALIHPDTGETIDLPCVVEAQAHLPTIQKQLVKIAKSSYRLSECIVQSAPLVRNAFRGKPGSQELVENWYSFATEHGTRVLVHIEPSAWDRFNRLLMRLAISWISFISQECNPTDRKTFRWTVAALTYAFNMTRGSNILALDRSEFSLLRRYVGVCVSLLVSHFDILGARSSMEAKKEADRIEAMRRLQRLQENLDDEFLPRTPTESGGQPRIDRSIRLTVEERLRLIAELEARRSELAPAPVGQVLDEEVSEDRALVFLAASKSNISMRWQQGAYIGGGASGSVYLGYSLQDNTVFAVKILPTVDLQSSPALYESIKRESDVMSLLSHPNVVGFLGLEVHRNRVCLFQEYCEGGSLAGMLEYGKIDDEEVVGAFTIQLLRGLEYLHTNRIEHRDLKPENILIGANSVLKLADFGTAKIIKSNKTLARTRGGAHAKMEGLEGTPMYMAPEMIKNQRTGKLGACDIWGLGCIVLQMITGRKPWSFLDFDNEWAIMFHLGATKEPPPLPDPNEMSDQGIEFIDQCLSLDPEARPVASELLQDEWLVPMLEQMAELEQEYPDVLAMGQSDSLVPPPENASLTSNAPTLQDDITPPPLE

SEQ ID NO: 16967 - protein, 378 aa, Streptococcus pyogenes
MNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYSLDISFTQAALGDTVEIPTVHGDVEMAIPAGTQTGKTFRLKGKGAPKLRGGGQGDQHVTVNIVTPTKLNDAQREALQAFAEASGDKMLHPKKKGFFDKVKDALEDI

SEQ ID NO: 16968 - protein, 596 aa, Unknown
  Mycobacterium sp. JLS
MDHSSGSPAHPDHDPAEGSHIEDGVVEHPTAGDFGHARMVPEDRTWFKRAVFYEVLVRAFHDSDADGSGDLRGLTERLDYLQWLGVDCLWLPPFYDSPLRDGGYDIRDFYKVLPEFGTVEDFVTLLDAAHRRGIRVITDLVMNHTSDSHPWFQESRRDPDGPYGDFYVWSDTSDRYADARIIFVDTEESNWTFDPVRRQFYWHRFFSHQPDLNYDNPAVQEAMLDVLRFWLDLGIDGFRLDAVPYLFEREGTNCENLPETHAFLRHCRKVIDDEYPGRVLLAEANQWPADVVAYFGDPDTGGDECHMAFHFPLMPRIFMAVRRESRFPISEILAQTPEIPDMAQWGIFLRNHDELTLEMVTDEERDYMYSEYAKDPRMKANVGIRRRLAPLLENDRNQIELFTALLLSLPGSPVLYYGDEIGMGDIIWLGDRDGVRTPMQWTPDRNAGFSKATPGRLYLPPNQDAIYGYQAVNVEAQRDSSNSLLNWTKTMLGVRRRHDAFAIGMFRELGGSNPSVLAFVRETATDTVLCVNNLSRFPQPIELNLQQWNGFTPVEMTGYVDFPSIGALPYLLTLPGHGFYWFQLRAPDPEPEGVQP

SEQ ID NO: 16969 - protein, 213 aa, Oryza sativa
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPCFWQIRTLKVLW

SEQ ID NO: 16970 - protein, 699 aa, Fusobacterium nucleatum
MFDEKIMKLELAGRTLKVSTGKISRQSSGAIVIQYGDTVLLSTANRSKEARKGADFFPLTVDYIEKFYSSGKFPGGFNKREGRPSTNATLVARLIDRPIRPMFPDGFNYDVHIVNTVLSYDEINIPDYLGVIGSSLALMISDIPFLGPVASVIVGYKNGEFILNPSPKELEESELDLIVAGTKEAVNMVEAGAKELDEETMLKAIMFAHENIKKICEFQEEFSKLYGKENIEFEKPEVLTLVKNFIDTNGYERLQQAVLTTGKKNREDAVDSLEEELMEKFIQENYPDVPEEELPEDIILEFKTYYHDLMKKLVREAILYHKHRVDGRTTTEIRPLDAQINVLPIPHGSALFTRGETQSLAITTLGTKEDEQLIDDLEKEYYKKFYLHYNFPPYSVGEVGRMGSPGRRELGHGSLAERALSYVIPSEEEFPYTIRVVSEITESNGSSSQASICGGSLSLMSAGVPIKEHVAGIAMGLIKEGEEFTVLTDIMGLEDHLGDMDFKVAGTKSGITALQMDIKITGITEEIMRIALNQAHEARIQILELMNNTISKPAELKSNVPRIQQITIPKDKIAVLIGPGGKNIKGIIDQTGSTVDITDDGLVSVFAKDAETLEKTLKLIDGFVREVEYGEVYEGRVVSIMKFGAFMEILPGKEGLLHISEISPERVDKVEDVLSVGDVFKVRVISMEGGKISLSKKKV

SEQ ID NO: 16971 - protein, 269 aa, Oryza sativa
MAEAVASGAAGRWTLRGKTALVTGGTRGIGHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 16972 - protein, 368 aa, Mycoplasma gallisepticum
MKIIIFCFNKLKIVKLHDRINQLFDLKKEVYMYEDFRKNFIKTIKNERYSNLLKLFSVINKLTYIWMENNNVEIVNLPITTQSVTSPMGLGSDSKPYKVISKSNLNYEFYLADSMQFHLELMLRAKDISSVGYITNTFRGEQVDNRHLHQFNHFEIEMLGNLNNCKEKIIDYIKFIVNELIKKHKNLIDFFNTNNSNRLKKWLSNEVIDLKHDHVISLLKLEYPVGIEKIYLNKNDFIESVNSKGEQYLINKFKNNIIWLSNFPWQLVPFYQKIEGDYAINSDLLIGIGETVGSGQRCITYKETYDSILKHKNNPKHYDWYLKMKLESELETSGFGLGLERLVLFIIDEKDIRNVQLLPRETDRELLP

SEQ ID NO: 16973 - protein, 161 aa, Bacillus cereus
MTVYDFSAKTITGEEKSLKDYEGKALLIVNVASKCGFTPQYKGLQEVYDKYKEQGLEILGFPCNQFGGQEPGTEADITSFCELNYGVNFPMFAKIDVKGDKAHPLYTYMTEQAPGLLGMKAVKWNFTKFLIGKDGKVVGRFAPQTKPVDLEVEIEKVLGNN

SEQ ID NO: 16974 - protein, 129 aa, Oryza sativa
MAKFNVVQKNRREWKQDRKRQAHGDPKTGKLKQRTAPVSVSGKRQRKLLRRLSREQKEAVMAKALENNMGDVEMVSAEGSSEAAKDKSQLKFNVKKNSRVQIKRLKGKGRKKAKNAKPPTKDKVDAMVE

SEQ ID NO: 16975 - protein, 699 aa, Oryza sativa
MVVSVSLPCWTEITHYYSPSPWERTWIELLFAHAGNTPMDRRLILSVAVAVALLAPRAAGEPWPVCGQDFGTFTPKSRFFANLQLIAATLPGNASSSPDLYATAVDVGAVPEQVTAAALCRGDVSASSCLGCLTQAFADLPNACGNSREAATYYDRCMVSYSAINFLSGGAGGEDPARIDAYTVNNENKVTSEQGRYNRLVAALVNATADYAAYNSTRRYAAGEADFDAALPKVYSLAQCTPDLSPARCRSCLAKIVAQELWSYKDDIGGRTLSVRCSFRIETKPFLNGTTMVRLPATSAPSPAPPVNATPSAATPGRETKYKVPRLVLIILLPIIAAVNLVVCFCVWRRKRPVITKAKQTNANYYAEADDVDSVDSMLMDISTLRAATGDFAESNKLGEGGFGAVYKGVLPDGNEIAVKRLSKSSTQGVQELKNELALVAKLRHKNLVSFVGVCLDQHERLLVYEFVPNRSLDLILFDTEKREKLDWEKRYRIINGVARGLQYLHEDSQLKVVHRDLKASNILLDANMNPKISNFGLARIFGQDQTQAVTNRVVDTYGYMAPEYMMRGNYSVKSDAFSFGVMVLEIVTGRKNNDFYNNSHQSEDLLNTIWERWMAGTVDEMVDPAMSRYVSASDVRKCVHVALLCVQENPADRPVMSSVVMMLDSETVSLQVPSKPAFFARNGGAKPGVASDESTASV

SEQ ID NO: 16976 - protein, 659 aa, Arabidopsis thaliana
MDLQQKQACWKLELEVIDNDSSWVSKFDPSKKKKKKKQKPLIREDDIFFQNGGHFTEDNLPDCQSSRKFEPDYGYKELLSMVFDRLREEDVEVSTERPRTVMMPPQLLAEGTITVCLNFADLCRTMHRKPDHVMKFLLAQMETKVSLNKQQRLEIKGLVSSKDFQAVFRKYIDAFVICVCCKSPDTALAEEGNGLFNLRCETHQSIYQIYCEETHEDMEIQEQRAGQGSIMGWSEACARKIEYDMVNSESVGEEQWEMVQRKGMQFTLNGQPFYVNGFNTYWMMTLAADNSTRGKVTEVFQQASAVGMTVGRTWAFNDGQWRALQKSPSVYDEEVFKALDFVLSEARKYKIRLILSLVNNWDAYGGKAQYVKWGNASGLNLTSDDDFFTNPTLRNFYQSHVRTVLNRVNTFTNITYKNDPTIFAWELMNEPRCPSDPSGDKLQSWIQEMAVFVKSLDAKHLVEIGLEGFYGPSAPARTRFNPNPYAAQVGTDFIRNNQVLGIDFASVHVYPDSWISPAVSNSFLEFTSSWMQAHVEDAEMYLGMPVLFTEFGVSAHDPGFNTSFRDMMLNTVYKMTLNSTRKGGAGAGSLVWQVFPQGAEFMDDGYAVYLTRAHTASKIISLQSKRLAIFNSLCSWRCRWGCKKKNQTALDALLSHDEL

SEQ ID NO: 16977 - protein, 668 aa, Methanosarcina acetivorans
MVYETSKQLEIDSEPLLEKVYGEDKVVEMFANTLEIVERAGPECTTSLKQLEIDIKPALEKVYGEDRVDEMFANILEIIERARSERAASLKMDDLTRDCSWYKDEIMYTFYADQFGVKNKNTTNTFKDLIEMLPYLKGLGVTTLYILPFMDSPMGDAGFDVRDPQKVREDLGGIAEFDQFMAEAKKYGFKIQADLVLNHFSDQHEWFQDALNGDVSKLDYFIFRKEPPKYERSQKGTIIKYFEEDGVPPSERRIVFADASEETHYRKVDIGGKDYYLYHTFYPFQLDINWENPEVLYYVLEKIIAFWSNKGIDIFRLDAIPFLIKEKGTNAENQPGTHCIIKILSSFNQAIGPRSIFHAEACEPPKEVLKYFSKERVFNIYGGENLTRTDGVQVAYNFPYMPAIWASLITGSNEYFWNVHEETPSIPESAAWAQFLRVHDELTVEMADTGTRKIIYDALLSKGKDFKGLGISGRMANFLDKNPAKIGLAFAILLSLPGIPVIYYGDEIGAENNTNYGEEAGNKRKEVLNKINTNFCSFDSRDINRGPILKSDFYSSEKDNVIHKTVKNLIEVRKGMSVLGRGKLSRLESDNKEIFSYLIDSDDQYVIVVNNLSGEKLETSLTLSNDLVEKIDKTTGMVNLIDRGKINVCLKCKKLIVSLEPYQTLWLN

SEQ ID NO: 16978 - protein, 706 aa, Unknown
  Marinobacter sp. ELB17
MEPKPVTKTFELGGKTVTLETGRIARQATGAVLVTIDDISVLGTVVGAKEAKPGQGFFPLTVNYTEKTYSVGKIPGGFFKREARPTEKETLTSRLIDRPIRPLFPNGFMNEVQVVLTVMSANKTQDPDIAAMLAASAALAISGIPFEGPIGASRVGFTNERGYFLNPTHEERSTSLLDMIVAGTEDAVLMVESQAQSLTEDQMLGAVLFAHQEMQTAVSGIKEFAAEIGKPRWEWQAEAVNAELMGAIKADFADAIAEAYSIRDKMDRYARLGEIKAAAVAKLAGDEEGKHSAEDVKKCFGKTEKHVVRQQVIDGKPRIDGRDTKTVRPIKIEVGILPGAHGSALFTRGETQAIVTTTLGTSRDMQIIDALEGESKDPFLFHYNFPPYSVGEAGRMMGPGRREIGHGRLAKRGLLAVMPTVEEFPYTIRAVSEITESNGSSSMASVCGSSLALMDAGVPIKSAVAGIAMGLVKEGDKFAILTDILGDEDHLGDMDFKVAGTKEGITALQMDIKINGITDEIMELALEQAYGARQHILGEMNKVIAASRTELSSRAPSITTIKINPEKIRDVIGKGGSTIRSICEETGASIDLDDDGNVKIYADNMEAAQAAVKRVMEITAEIEVGAIYQGRVERIVDFGAFVNILPGKDGLVHISQISDRRIENVTDELKEGQEVLVKVLDVDNRGRVKLSMKEVKEGEKPTDLSA

SEQ ID NO: 16979 - protein, 546 aa, Unknown
  Azoarcus sp. BH72
MQSIEVVLAMLLAVVASGYLVRVVPVSLPLPLVQIALGAGIAAISGHGVRLDPEIFFLLFLPPLLFLDGWRIPKVGLFRDKGTILELAFGLVVFTVLGAGLLIHWMIPAMPLAVAFALAAIVSPTDPVAVSSIAARVPIPKRLMHILEGESLLNDASGLVCFRFAVAAVMTGGFSLAAASLTFLWVAFAGLAVGVIVTWVISLAQRWLSRHLGEEAGSPILVNLLIPFGAYLVAEHLDASGILAAVAAGVTMSYVELSGRALATTRVQRAAVWDTVQFSLNGIMFVLLGEQLPGIVQRAAAAVEDSGHVSRWWLLVYALAISAILAALRFAWVWVSLRVTLFKAREAGEPLQRPDWRIVAAVSLAGVRGAITLAGVLTLPLLLPDGRDFPARDLVIFLAAAVILVSLLLASLGLPRLLRGLALPDEPAERREEDRARREAAAAAIAAIEKARHALSEPGAADADLYTNAAVRVMANYQRRLADSAMPGSVAADRLRAADRAEMALWLAALQAEREAIFRLARDYELSDETSRKLVRQIDLMEARYR

SEQ ID NO: 16980 - protein, 191 aa, Escherichia coli
MRSDLFLNHMVIDMKHTVEVMIPEAEIKARIAELGRQITERYKDSGSDMVLVGLLRGSFMFMADLCREVQVSHEVDFMTASSYGSGMSTTRDVKILKDLDEDIRGKDVLIVEDIIDSGNTLSKVREILSLREPKSLAICTLLDKPSRREVNVPVEFIGFSIPDEFVVGYGIDYAQRYRHLPYIGKVILLDE

SEQ ID NO: 16981 - protein, 335 aa, Saccharomyces cerevisiae
MHSHHSHSGDYSAHGTDPLDSVVDQVVNLHFHTYCLTEHIPRIEAKFIYPEEQSLGKNPEEVITKLETSFKNFMSHAQEIKTRYADRPDVRTKFIIGMEIESCDMAHIEYAKRLMKENNDILKFCVGSVHHVNGIPIDFDQQQWYNSLHSFNDNLKHFLLSYFQSQYEMLINIKPLVVGHFDLYKLFLPNHMLVHQKSGNCNEETGVPVASLDVISEWPEIYDAVVRNLQFIDSYGGAIEINTSALRKRLEEPYPSKTLCNLVKKHCGSRFVLSDDAHGVAQVGVCYDKVKKYIVDVLQLEYICYLEESQSPENLLTVKRLPISQFVNDPFWANI

SEQ ID NO: 16982 - protein, 399 aa, Candida albicans
MDDFDRDLDNELEFSHKSTKGIKVHRTFESMNLKPDLLKGIYAYGFEAPSAIQSRAIMQIISGRDTIAQAQSGTGKTATFSIGMLEVIDTKSKECQALILSPTRELAIQIQNVVMHLGDYMNIHTHACIGGKNVGEDVKKLQQGQQIVSGTPGRVIDVIKRRNLQTRNIKVLILDEADELFTKGFKEQIYEIYKHLPPSVQVVVVSATLPREVLEMTSKFTTDPVKILVKRDEISLSGIKQYYVQCEREDWKFDTLCDLYDNLTITQAVIFCNTKLKVNWLADQMKKQNFTVVAMHGDMKQDERDSIMNDFRRGNSRVLISTDVWARGIDVQQVSLVINYDLPTDKENYIHRIGRSGRFGRKGTAINLITKDDVVTLKELEKYYSTKIKEMPMNINDIM

SEQ ID NO: 16983 - protein, 109 aa, Zea mays
MERIDIHPTHTANGYKLRCGQPFPFGATIVPGGVNFSIYSSHSTACTLVLFEKRAPQPFVEIPFPESFRIGNVYCMVVFDLDFENLEYGYRMEGPNNFQQGHWFDPSKV

SEQ ID NO: 16984 - protein, 185 aa, Xanthomonas axonopodis
MLLNRLLALVLTGFFATPAFAAGTPVLDVEYRPLAGKTPINLNRTYGGKVVMVVNTASKCGFTPQYEGLEALNHRFGSRGFTVLGFPSNDFQGQEPGSEKQIQEFCTLTYGVKFPMFEKVHVLGAEATPLYQRLTQATGVAPGWNFHKYLIGRDGRVVAQFPSKIKPDDPSVLAAIERELKAPAR

SEQ ID NO: 16985 - protein, 161 aa, Lactobacillus plantarum
MAESVYDFTETEMSGAPLDLSQYRGQVLLIVNTASNCGLAPQFKGLEELYQKYQQEGLVVLGLPSNQFHQEKADDDETHDYCQRHYGVTFPMTKRVMVNGDDADPLFTYLKQAAGHGRIKWNFTKFLIGRDGRVLERYAPTTRPATFEAAIRDALADRSED

SEQ ID NO: 16986 - protein, 440 aa, Unknown
  uncultured archaeon
MLLPHISHCIGIAYHPIVHKGLCIVRIFSLMMDLEMDVDADMDSTEFSKYVVDRMQQLELKNDLLEKQYQKVETEKQLAEDQRLKYERELRKLRSELDKLKTTPQLVGTLVSILEEGKSIVRSSTGPEFIVGSSQFIKDGDLKPGVQVALNKEHLSIVAVIPRSEDPLVQAMEVIESPDIDYDQIGGLDKQIEVLRGAVEFALTKPEIFERIGIDPPKGVLLFGPPGTGKTLLAKAVATRTEATFIRVVGSELVQKYIGEGARMVRDVFEMARKKAPAIIFIDELDSIGAVRLDDASSGGREVQRTLMQLLSEMDGFNSRGDVCILAATNRWDILDPALIRAGRFDRLVYVPIPDREARAKILLIHTEKMRLADDIDFDRIVALTEDANGATLRAIAMEAGMCAVREEADAVHQKDFEDAIKHIMNPEGMVDRYSEGMFA

SEQ ID NO: 16987 - protein, 639 aa, Magnaporthe grisea
MPICLWHGYAPSSAQRLLNSSIYLPKCSLGQFNTMAPRNQKRKAASPAGSHGSDSKKIKTESVEPISTSDPLRRPHTFYKESEENGIVLREFYPHEMSNERARAYNNDEIPRPIEDLYQAMSQTHPIRQKVKVKGAVVHWFKMDLRVADNTALRLASEKAKSAGVPLIALYTVSPKDWEAHLRAPVRVDFTLRSLEVLRQDLAKLDIPLHVETVDDRRAMKQRVLSLMEEWDASHLYANMEYEVDELRREANLVRLLAENGKSMEVVHDTCVVPPGKLQTGTGRQYAVYSPWYRAWLKHLSGDPELLEPMEPPHKNPASAREKFSHLFDGKIPAAPKSKQMNEEEQQRLAAMWPAGEHEARKRLDAFIKRRIDGYAAKRNFPADDGTSSISVHLAAGTLSARTAVHLAHKASGTRKLDGGSQGIQTWISEVAWRDFYKHVLVNWPYVCLTSAGSCPHSMNKPFKPEYSNIAWSYDMEHFAAWCEGRTGFPIVDAAMRQLRGTGWMHNRCRMIVASFLAKDFLIDWRMGERYFMENLVDGDFASNNGGWGFAASVGVDPQPYFRVFNPLLQSEKFDPNGEYIRKWIPELKGIKGKAIHDPYGRGCGVEAKKKGYPKPLVDHKGCRERALKAYKEGISKEI

SEQ ID NO: 16988 - protein, 174 aa, Glycine max
MEKLKLSTEEEDNMATSASALLTPTTFSSTISQKHPNSISFHGLRPLRLGGSSSALPKLSTTSGRRSSSSAVVRAELSPSVVISLSTGLSLFLGRFVFFNFQRENVAKQVPEQNGKTHFEAGDDRAKEYVSLLKSNDPVGFNIVDVLAWGSIGHIVAYYVLATSSNGYNPSFFG

SEQ ID NO: 16989 - protein, 238 aa, Unknown
  Bradyrhizobium sp. BTAi1
MRLTRSLFIKTALLGAIAAAGLLAWQPLHAAEEAVVIPPPAQDQPAGDGLETAVVAGGCFWGVQGVYQHTAGVVSAVSGYAGGTKATADYRTVSSGTTGHAESVQIKFDPKTISYGKILQIFFSVVHDPTQLNRQGPDTGPQYRSAIFTTSDAQKKVAEAYIAQLEKAKVFGKPIVTKVGKLEAFYPAEAYHQDYLTLHPSQPYIAYNDLPKIENLKKIFAENYIEKPTLVSDAKATN

SEQ ID NO: 16990 - protein, 221 aa, Arabidopsis thaliana [sequence omitted]

SEQ ID NO: 16991 - protein, 185 aa, Xanthomonas campestris
MLLNRLLALVLTGFFATSAFAAGTPVLDVEYRPLAGKTPINLNRTYGGKVVMVVNTASKCGFTPQYEGLEALNQRFGSRGFTVLGFPSNDFQGQEPGSEKQIQEFCTLTYGVKFPMFEKVHVLGAQATPLYQRLTQATGVAPGWNFHKYLISRDGRVVAQFPSKIKPDDPSVLAAIERELKAPAH

SEQ ID NO: 16992 - protein, 124 aa, Zea mays
  misc_feature (22)..(22): Xaa can be any naturally occurring amino acid
  misc_feature (56)..(56): Xaa can be any naturally occurring amino acid
FGVLQTCGAPYLTGDTTRGGLXLHIYYPTNSQHQPMVILHMCLTLLDTKKAIVFFXTNADGNTSSPKEMTMLFCISEIIPEIENCDFDFQPCHYFMNAIHGSPFSTIHVTPDDSVRYTSDQDMV

SEQ ID NO: 16993 - protein, 354 aa, Fusobacterium nucleatum
MIEEVMKKIAGLSDIQVNDVLASEDIYNYRNKIIEPFSVYANKIITGFFKRKSHEVFEVDENILNSKLGNKIIKELKEILNKNKISVYDENTHKGILRNIMIRPNSNNEAMVVLIINSNKITENIKKILFKLRENIKEIKSIYISLNSKKTNTVIGEKNILIYGEKSIKENINGIEFHISPTSFFQINVKQAKRLYDIAISFFDNIDNKYIVDAYSGTGTIGMIIAKKAKKVYAIEIVKSASEDGEKTAKENGIENIEFINGAVEKEIIKLINNNKRIDTIIFDPPRKGLEASIIVTVAKLNLKEVVYISCNPSTFARDVKLFAEKGYTLKKLQAVDMFPQTSHIECVGLIVKE

SEQ ID NO: 16994 - protein, 180 aa, Rhizobium gallicum
DFDAFPALEQLPLWGFDGSSTMQAEGRSSDCVLKPVAVYPDPARTNGALVMCEVMMPDGVTPHPSNSRATILDDEDAWFGFEQEYFFYENGRPLGFPEQGYPAPQGPYYTGVGYKNVGSVAREIVEEHLDLCLAAGINHEGINAEVAKGQWEFQIFGKGFKRAADQIWMARYLLLRLCEK

SEQ ID NO: 16995 - protein, 235 aa, Geobacillus stearothermophilus
MSVISMKQLLEAGVHFGWQTRRWNPKMKKYIFTERNGIYLIDIQKTVKKVEEAYNFVRELAANGGKILFVGTKRQAQESVKEEAERCGMFYVNQRRIGGTLTNFATLQKRIKRLREIEKMEEDGVFDVLPKKEVIGLKKEKERLEKFIGGIKDMKELPDALFVIDPRKERIAVAEARKLNIPIIGIVDTNNDPCEGGYVIPANDDAIRAVKLLTSKIADAVLEAKQGEEAAVAAE

SEQ ID NO: 16996 - protein, 627 aa, Yarrowia lipolytica
MNLWKLVLTAGLVMCESQAGQPTPSHPAPTLRSFEEWRIHNLLQSGQNLGSTPGSGPGHSNGGGGGSEPEMDPFTGEIDFLFAASDDPGKTYKDRFNYASFDCGATVVKSNKDVKGAGAILVENKDSYLLNKCVAGSKHVIIELCQDILVDQVVVGNYEFFSSMFKDIRISVADRYPVASGEWRVLGDFTADNIRDLQTFDITVPQIWARYVKIEFLSHWGHEYYCPISVVRVHGTTMMEEWKRSGGDGDIVAGEKLDESLQEETAQFEKAEETLHEEKMIQENVVEKSNPSLNHTVIEKGECTPKLSLDKVKLGLNEYCRLDEFYRKIERNNSNNNTDTTTNNQSNNSTTTPPTQESIYKTIMKRLSLLESNATLSLQYVEEQSKVLRDLLYKIEKKQNSKIDDFLFHFNATVLQQLVMFSQQREQKLNRAILELDLQKSQTDKNMAAISQRFAMLADDLVFQKRMSMFQGLILLVVLIFVALTRGTGPELSRRSRLMFNTDDSEDNSDFGSFRRHLRRNFKRNISSLSPRWSLNLTPQSPVSDDGVDEGLGLDSDSEDEHIESPPPPRTLGSPLATPGPKKKKSRSLYDEPVQWAGDTPEPVDYMSPAEDDDDKKDHRRDRNKEE

SEQ ID NO: 16997 - protein, 258 aa, Avena sativa
MDTGPEYNLTPTSSSSSQELGMALSSPTSPTPKRPAGRTKFKETRHPVYRGVRRRGSNGRWVCEVRVPSKSGERLWLGTHVTAEAAARAHDAAMLAMHGHTSAACLNFPDSAWLLNVPSNLSDLADVRRAAIEAVVEFLRLEAIKDGAAAVAVPIDGVVASAALAPSSHADNASPAATSQPSAASEVPEALGGDMFELHTSGEMGLGTYYADLAEGLLLEPPPAAASSEHGGDCGDAPDMMRRYGNGATEIRLSLAAE

SEQ ID NO: 16998 - protein, 553 aa, Aspergillus oryzae
MTTAIVTGTGRRSSIRQSDLQPPATDFISQSMTTSPIDKFPQFKDDLYEIAAGPRESHSNFATKYTPNDRWEPRKENNFASEYTNGTIRHSKHKPRKSISEAISTIRTRNASVSANAQELAQALRAPVSYKLISLCLIWYMTSALTNTSSKSILNALPKPITLTIVQFAFVSIWCLLLSYLSKILPWLRNSIPALKNGIRYPSRDVIMTALPLAVFQLAGHILSSMATSQIPVSLVHTIKGLSPLFTVLAYRVFFRIRYASATYLSLVPLTLGVMLACSTGFSTNFFGIICALVAALVFVSQNIFSKKLFNETARGESETQVSAQRKLDKLNLLCYCSGLAFILTLPIWVLCEGYPLLSNVLRDGSISLSGKENSLDHGALLLEFVFNGVSHFAQNILAFVLLSMISPVSYSVASLVKRVFVIVVAIVWFGNSTTGMQAIGIALTFIGLYLYDRNSHDDLADQRANADHFHTKENVLPLNIRSTTKTWDSNGYVFPPGKTSERQFLDETHSFPNDLKKDDDRPGRVRPRGSSNTRAWLPPGTKQETTWQPSDS

SEQ ID NO: 16999 - protein, 112 aa, Silicibacter pomeroyi
MKKIEAIIKPFKLDEVKEALQDIGVQGLSVVEVKGFGRQKGHTELYRGAEYVVDFLPKVKLEVVLDDDQVDAAIEAIVSAAKTDKIGDGKIFVSTVEQAIRIRTGETGSDAL

SEQ ID NO: 17000 - protein, 605 aa, Schizosaccharomyces pombe
MTKDAESTMTVGTYLAQRLVEIGIKNHFVVPGDYNLRLLDFLEYYPGLSEIGCCNELNCAFAAEGYARSNGIACAVVTYSVGALTAFDGIGGAYAENLPVILVSGSPNTNDLSSGHLLHHTLGTHDFEYQMEIAKKLTCAAVAIKRAEDAPVMIDHAIRQAILQHKPVYIEIPTNMANQPCAVPGPISAVISPEISDKESLEKATDIAAELISKKEKPILLAGPKLRAAGAESAFVKLAEALNCAAFIMPAAKGFYSEEHKNYAGVYWGEVSSSETTKAVYESSDLVIGAGVLFNDYSTVGWRAAPNPNILLNSDYTSVSIPGYVFSRVYMAEFLELLAKKVSKKPTTLEAYNKGRPQTVVSKAAEPKAALNRVEVMRQIQGLVDSNTTLYAETGDSWFNGLQMKLPAGAKFEVEMQWGHIGWSVPSAMGYAVAAPERRTIVMVGDGSFQLTGQEISQMIRHKLPVLIFLLNNRGYTIEIQIHDGPYNRIQNWDFAAFCESLNGETGKTKGLHAKTGEELTSAIKVALQNKEGSTLIECPIDEAACIQEWIAGYRTFTPRKIQLTFLDTQACMAAGLLSASEGTPYSESYFLSASEGICPYSESY

SEQ ID NO: 17001 - protein, 650 aa, Listeria monocytogenes
MEIFELILLMLSAVFLSNVLSRFLPSIAVPLIQVVLGIILAIPLGDHTMDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAILSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYIIGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKVTADHTTDIVLLRDIVQQLQAYKTDENAVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVIQKLQELDSNEYNPEIISLYLMNFERALGRGKNKKESNDEALQTTIDLASQIERETIQRYFEKGTITRKEMKVYRDNLLAIEANMQLEF

SEQ ID NO: 17002 - protein, 205 aa, Brassica napus
ADNNFTQETAMTIIRLGMKNAPIVLLPTPFPESYWNQACEVAPVFNELVDRISLDGKFIQDSLSRTKKADVFTSRLLEIHSKMLERNKREDIRLGLHRSDYMLDEETKSLLQIEMNTISCSFPGFGRLVTELHQSLLISHGDHLGLDSERVPRNGSTFQFADAMAKAWVEYNNPRAVVMVVVQPDERNMYDQHWLSSVLREKHNI

SEQ ID NO: 17003 - protein, 452 aa, Unknown
  Magnetococcus sp. MC-1
MLVGALMIWVMPLPEGLTEQGRIVLTMTVVATTLFVTEPVPLPTVALLIVVGQVLLLKHNSSDVARTLMSDSVLFIMGSLMLAVAVVKQKLDKRIALFIIRFTGTKTSRIAFGISVMSGLLASFVGEHTVAAMMLPVGIALITLTSDDPAKVRNLAAVLLFSIAYGCSVAGVGTPSGGARNAIMIGYWSDFYGIVIDYVKWMLYAYPMFLLQLPFVTMILLFTFRPEFDDLTPAVEKLKAQVEAEGPLKQRHFVSIALFFLILYGWVGLSEGVGMGTIAVLGASAFLVGGLVKWEDLNNGVNWGVVLLYAAAISLGVQMKDSGAAEWVATSFLEMLTPFGADKGMGLWLAVSALTTGVTNTMSNGAAVAVLGPIVLNMAAAAQESPVVIGFITAISSAFAYLTVVGTPACTIVYASGYLKTSDFLNVGWRMAVMSTLLMLLFASLYWPLIGV

SEQ ID NO: 17004 - protein, 112 aa, Caulobacter crescentus
MKKIEAVIKPFKLDEVKEALQDMGVQGMTVLEAKGYGRQKGHTELYRGAEYVVDFLPKIKVEVVVEDSQLEPALEAITRAARTGRIGDGKIFVSEIAEVIRIRTGENGPAAV

SEQ ID NO: 17005 - protein, 255 aa, Triticum aestivum
SARVMYEELHVMSPVVPTREFCFLRYCRQIEQGLWAIADVSVDLQRDARYGAPPARSRRLPSGCLIADMSNGYSKVTWVEHMETEDKTPINQLYRDLVLIGAAFGAHRWLAALQRACERHACLVTPPHRDIAGVTLEGKRSMMRLSQRMVGSFCASLSASQQHRWTTLSGPGAGVDDAAGVRVMVHRSTDPRQPSGVVLSAATSIGLPVSCDRVFAFVRDENTRSQWDVLSHGNPVQEVSRIPNGSHPGNSISLL

SEQ ID NO: 17006 - protein, 174 aa, Dehalococcoides ethenogenes
MLYTAQDISERVSSLARQISDDYRDSRPILIGVQRGFICFMADLIRQIAVPLDIDFMTISYYSGSNASMVRITKDMDLEVAGRDVLLVEDIVDTGITLNYLLNHLRSKNPASLKVCTLLDRKVRRLIDIKIDYVGFELPDEFVVGYGLDYHEEYRNLPFIGIPGIKETPDNKPC

SEQ ID NO: 17007 - protein, 355 aa, Unknown
  Gerbera hybrid cultivar
MVIQATTRVESLSTSGIRQIPKEYIRPQEELRSITNIFDEETNKQKPQVPTVDLTDIESDDPEKRHKCLEELKKAAMEWGVMHVVNHGISGDLIGRVKAAGEGFFGLPVEEKEKYGNDPDGGRIQGYGSKLANNASGQLEWEDYFFHLVFPEEKRDLTIWPTTPSDYTDATTEYAKQLRALATKILSALSLGLGLEEGRLEKEVGGIEELILQLKINYYPKCPQPELALGVEAHTDVSALTFILHNMVPGLQLFYDGQWVSAQCVPDSIILHIGDTLEILSNGKYKSILHRGLVNKEKVRISWAVFCEPPKEKIILKPLPETVSEAEPPLFPPRTFQQHMEHKLFRKNKDEVMQN

SEQ ID NO: 17008 - protein, 226 aa, Gossypium raimondii
MRKPCCDKQGTNKGAWSKQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVGPLNPTTTNSMDVACKLRVFSTENDDGVSDAASYLEDETPPTGISNLDLDLTIAFPSSPIKNIIEESQKKTASIVTNNKEEQYTVPTLLLFR

SEQ ID NO: 17009 - protein, 182 aa, Rhodobacter capsulatus
MSQSGYVIDQMISAKAIAARVEALGAEITEAFKDTDRLVVVGLLRGSFVFIADLIREIGVPCEVDFLEASSYGNETTSTREVRVLKDLRGIIGGRDVLVVEDIIDTGHTISKVMEMLRARAPRRIECCAMLDKPSRREVDVKARWTGFEIPDEFVVGYGLDYAQNHRNLPFIGTVRFTDPQK

SEQ ID NO: 17010 - protein, 872 aa, Oryza sativa
MARSSADDMELKRSCEAGILSKEKDRETVVMSMRVAKGRGVWGKAGKLASRHMAKPRVLAVTTKKKGQRTKAFVRVLKYSNGGVLEPAKVYKMKHLSKVEVVPNDPSGCTFLLGFDNLRSQSVSPPQWTMRNKDDRNRFLMCILNMCKEIYGAIPKVVGMDVVEMAMWAKDNTTVKVTQVSTKDGPIESLVGEADSQVAIQKDLVLQTEDEDTEALLDTYIMAIGEAEAFSERMKRELVALESANVYALMETETVVEEVLEGLEIASICVEDFDEWLGIFNVKLRHMREDIQSIEWRNNKLELQSDSNVALIDELDKMLVLLQIPPEYEASLTGGSFDEGNMVKNIEACEWLTSAIKNLEASNLDPIYVKLRAFENDTSFINGGYHEISKGYKRRVREKRAEFVLLKCTFVRRASEFLRNYFPSLIDFMLNDKGNFSQRGQLQRPDHADMRYKCRTYARLLQFIKNLDKSCLMPLRKSYCHSLNLLIRREAREFSSELRAGSKASKSSTPLFEGPASANQSISITDTTADAYCKMITVFIPLLVDESSFFAHFMCFDVAALAPSDESDNNNPVAVSEPPGSSAKPINSSAESGVLNQCLQELLDGIQEDFYAIVDWAFRLDPLSCIAMHGITDRYLSAQFVDDACYQIEKYERNVRQIGVVPYIPRFSQLAARMEQYINGSRDLVDQAYTKIVTIMFVTLEKIAQVEPKYVDIVLLENYAAFQHSLYDLANVVPTLAKYYHQASEAYEQACSRHINLVIYIHFEKLFQFARKIEELMYNMSPEEIPFQVGMSKVDFRKMLKSSLSGLDKTINAMYRKLQKNITAEELLPSLWDKCKKEFLDKYATFLKLISKIYPSETVISVNEMKDTLASL

SEQ ID NO: 17011 - protein, 209 aa, Gossypium herbaceum
KQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVGPLNPTTTNSMDVARKLRVCSTDNDDGVSDAASYLEDATPPTGISNLDLDLTIAFPSSPIKNIIEESQQKIASIVTNDEEEEYTVPTLLLFR

SEQ ID NO: 17012 - protein, 150 aa, Oryza sativa
MARSSADDMELKRSCEAGILSKEKDRETVVMSMRVAKGRGVWGKAGKLASRHMAKPRVLAVTTKKKGQRTKAFVRVLKYSNGGVLEPAKVYKMKHLSKVEVVPNDPSGCTFLLFENDTSFINGGYHEISKGYKRRVRCIKLLQLLIFIEE

SEQ ID NO: 17013 - protein, 107 aa, Allochromatium vinosum
  misc_feature (17)..(17): Xaa can be any naturally occurring amino acid
  misc_feature (38)..(38): Xaa can be any naturally occurring amino acid
  misc_feature (42)..(42): Xaa can be any naturally occurring amino acid
  misc_feature (55)..(55): Xaa can be any naturally occurring amino acid
  misc_feature (58)..(58): Xaa can be any naturally occurring amino acid
  misc_feature (60)..(60): Xaa can be any naturally occurring amino acid
  misc_feature (72)..(72): Xaa can be any naturally occurring amino acid
  misc_feature (107)..(107): Xaa can be any naturally occurring amino acid
SDSIVHVTDDSFEEEVXKSPDPVLVDYWADWCGPCKMXAPVXDEIADEYAGRVKXAKXNXDENPNTPPRYGXRGIPTLMLFRGGEVEATKVGAVSKSQLTAFLDSNX

SEQ ID NO: 17014 - protein, 622 aa, Candida glabrata
MSTPVDEERQPLNPRGSRSQVRYISIPLARNPDLEAVDGDTSGYAVQDSSFTNHEPQPMGRRQSILDQPIGSFRGVNSLSRFATSLRRANSFRNIEVKPEVERTYFNDDYDELFDPSTLAPAPHGRSLSIALQSANATLQVSGKPSIPNIDAQSTHSISQQELEDFRSIRTTSFSMDNNGILRPTLSMNEMLTGSTPFDTNDVDSMVIKQVEGKDGTVVTLLAGQSTAPQTIFNSINVLIGIGLLALPLGMKYAGWIPGLIMLSIFAFGTFCTAELLSRCLDTDPTLISYADLGYAAFGSRGRAFISALFTVDLLSCGVSLVILFGDSLNALFPQYSVTFFKIVCFFVVTPPVFIPLSILSNISLLGILSTTGTVLVIFICGLFKRDAPGSLIEPMPTHLWPTDFKSLCLSIGLLSASWGGHAVFPNLKSDMRHPQKFKKCLKTTYQITSVTDIGTAVIGFLMFGDLVKDEITKNVLLSDGYSNTVHVLISALMTVIPIAKTPLNARPIVSVLDIMFGIHEAEKEYTGKKLKFAQFGQFFNRIFVNFMFVLIAIIFPQFDRIIAFMGAGLCFAICFILPCLFYLRICGEANIVKPWERLACKATIVVSVVLSVLGVSAAMFS

SEQ ID NO: 17015 - protein, 834 aa, Unknown
  Bradyrhizobium sp. BTAi1
MTDMKIDRRQMLKLEAAAIAAAAAGMPSTSLAANLVTEREASELKWDKAACRFCGTGCSVMVATKDNRVVATHGDIKAEVNRGLNCVKGYFLSKIMYGHDRLTHPMLRKTNGKYDKNGEFTPVSWDEAFDIMALKFKDALKKRGPSGVGMFGSGQWTIWEGYAASKLFKAGFRTNNIDPNARHCMASAVAGMMRTFGIDEPAGCYDDIEAADAFVLWGSNMAEMHPILWTRVTDRRLSAPHVKVAVLSTFEHRSFDLADIGMVFKPQTDLYLLNAIANHIIKTGRVNKDFVQAHTVFKKGQTDIGYGLRPEHPLQKKATGAAKANDATDISFDEYAKFVSDYTLEKAAEMSGVPLNRLEALAELYADPKTKVVSFWTMGFNQHTRGVWCNNLVYNIHLLTGKIAEAGNSPFSLTGQPSACGTAREVGTFSHRLPADMVVTNKEHRTKAEHIWQLPEGTIPDKPGYHAVLQSRMLKDGLLNAYWVQVNNNLQAGPNANEETYPGFRNPDNFIVVSDAYPSVTALAADLILPTAMWVEKEGAYGNAERRTQFWHQLVSAPGEARSDLWQLMEFSKRFKIEEVWPEELIAKKPDVRGKTLFDVLYKNGQVDKFPLDQIEAGYANDESKAFGFYVHKGLFEEYAAFGRGHGHDLAPFEAYHKERGLRWPVVDGKETRWRFREGSDPYVKAGTGVQFYGFPDGKARIFALPYEPPAESPDKDYPFWLSTGRVVEHWHSGTMTRRVPELYKAFPEAVCFMHPDDAQEANLRRGDEVKVASRRGFIRARVETRGRDKPPRGLVFVPWFDESKLINKVTLDATDPISLQTDYKKCAVRIERV

SEQ ID NO: 17016 - protein, 218 aa, Gossypioides kirkii
QGTNKGAWSKQEDQKLIDYIRIHGEGCWRSLPKAAGLHRCGKSCRLRWINYLRPDIKRGNFAQDEEDLIIKLHALLGNRWSLIAGRLPGRTDNEVKNYWNSHIKRKLMKMGIDPNNHKLNQYPHHVVPLNPTTTNSMDVACKLRGCSTDNDDGVSDAASYLEDETPPTGISNLDLDLTIAFPSSPIKNIIKESQQKIASIVTNDEEEQYTAPTLLLFR

SEQ ID NO: 17017 - protein, 565 aa, Triticum aestivum
MAALVTSQLATSGTVLSVTDRFRRPGFQGLRPRNPADAALGIRTVGASAAPKQSRKPHRGNRRCLSMVANGHRVMVISPRYDQYKDAWDTSVISEIKVVDRYERVRYFHCYKRGVDRVFVDHPCFLEKVRGKTKEKIYGPDAGTDYEDNQQRFSLLCQAALEVPRILDLNNNPHFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPIKDKFLTVNYDVTTALEGKALNKEALQAEVGLPVDRKVPLVAFIGRLEEQKGPDVMIAAIPEIVKEEDVQIVLLGTGKKKFERLLKSVEEKFPTKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGIVGEEIAPLALENVAAP

SEQ ID NO: 17018 - protein, 90 aa, Arabidopsis thaliana
MAIFTGSSSTGSTARAALLLKPGGGISASVLGLPPIGKKKGGVRCSMETKQGNVLFIGAEVSLALTANFSSIVNRPKIVFKNGAGYPNKV

SEQ ID NO: 17019 - protein, 604 aa, Kluyveromyces lactis
TQTDRNVKRKKTSSMTITKFVSEHPQTDPKWWKEAIVYQVYPASFKDSNHDGWGDIKGIDSKLEYIKELGANAIWICPFYDSPQEDMGYDISDYEKVWPRYGTNEDIFNLIDRAHGLGIKIIVDLVINHCSSEHAWFKEARSSLDNPKRDWFIWKAPKGFDSNGKPIPPNNWRSFFGGSAWEYDEHTGQFYLRLFAKGQPDFNWENEVTRNAIYESAVGFWLDHGVDGFRIDTAGLYSKQPGFPDVPIINPGLDFQHPDPAILNGPRIHEFHKEMNKFMRERVKDGRELLTVGEIPCGTHDVCKAYTSAKEQEITQLFEFEHVSVGRKPGNVGVVNFKLSEFKDGIAAAFQFIDKTDSWSTVYIENHDQPRSVTRFGDDSPEYREISAKLLALLETSLTGTLYVYQGQELGMINFRDWPIEKYEDVEVKGMYKMMVDQFGADSDQVKDYVNGLQLISRDHARTPFPWTSEAPYAGFTDGKEPWFPLTETFQEGINAEDELKDPKSVFNFWKTAIEVRKTHKDVLNYGYDFTFVDHANEKLFAFTKKYGEKVLYVVLNFSKEEIEFSFLEGYNSYDYIFGNYPEAEIDTGSNKLQPWEGRFYYAN

SEQ ID NO: 17020 - protein, 193 aa, Unknown
  Bradyrhizobium sp. BTAi1
MNSIVRLMPDATALQPDFRSAMRQLVGGVSVITVGRGDEITGMTVSSLSSLSVDPPSVIVSLNRNASSWPILQRERVFGANLLAADQIDVAERFAGKGGLKGAERFAGAEWRRHVTGVPLLAGALAALDCEVEEIIERHSHGIVIGRVVHVEVAPQAAALAYWHGGYVPVDREDDLARLAALSVPDPRLPPKR

SEQ ID NO: 17021 - protein, 469 aa, Magnaporthe grisea
MSYIFSWARIASPWLKADFCHCLQAAKSARSRRPSRNATQWIVDHEELPKQVIVANYVLKMLVSPEIHRPRRSTLPTWLNRKVNWIVNLVPSKQAVIRGHARTFQTSRNYPTGSASSDVFLRFSGICQDFRYRRTNGPELHTKPGTYAVSWARLENHLYKARGPSGDILRGTFHVPKSQRYKRSSRLRSPFSGCIAFAAAMTPVVANMPPSEFNFPSVNNDTVLTVAYTFNGNTTVVDPGTMFGGNVARNQPQLAVDPTKFRSLADYTGQYVVIMIDPDAPSPDNPIRRSILHWLASGITQTLGGGSGRISGQRSLTNSTPATVPYAAPGPPPSSSAHRYFFYIWQQPPGFQVPSSFNPNNRANFDIENFVRETNLGAPAAANYIYVSRQDSVPMTFIASPGSEYPGGNGNAVFPRKGDGNGNGNGNGNDNGDPYNPNYPDEGAASGGIQMSNFAALISFVAMGLACLV

SEQ ID NO: 17022 - protein, 382 aa, Unknown
  Burkholderia sp. 383
MNDAMNDMIEPRGCGHDCPSRDAAGAHEHAAPADGLHEQWFVACTERELPRDKPLGVRILDTGIVLFRQRDGRIAALIDHCVHRGTRLSAGKVDRDTLVCPYHGWRYDGEGQVVHVPSIDGTQPTGTPGRYPFRQRTLPVQLLDGLVWVYLGTGDPSARTIFRMPFCDVAPWQSYFMVNTFDGDIAMLAQNFMDVPHTVFVHDGIFRSSRGQAMEATVATTQDSVAVTYHDGDDKIGFCLDWLTNPDRVPLAHVDRFIAPNVTRCDYLWGERSGFLIVSQITPIDARRSRVYTYIAYRFRLPRWMLRALRPLLNLYTHLVIQQDVRIMRAHRQGLDNAPGFRPHNVRADIVHVAIDRLLDAVKRDEPLPAAQCGEKVMRFEL

SEQ ID NO: 17023 - protein, 230 aa, Coprinopsis cinerea
MMSYGSDAGLRGAVAAFATQSTGFAEAFPGIYPRLLTLATNFQMPFYRDILLALGICSVSRTSCSNILKSGPGSAITIVVGGAAESLSAHPGTADLTLRKRLGFIKVAIQHGADLVPVFSFGENDIYQQMPNEKGTTIYELQKKFQAIFGFTLPLFHGRGLLNYNVGLMPYRRRIVVVVGRPIHVNKCDKPSLEEVYRIQQQYIEELTRIWDTYKDQFAKSRVRELNIIE

SEQ ID NO: 17024 - protein, 508 aa, Unknown
  Frankia sp. CcI3
MTDGRSVGEVWLVGAGPGDPGLLTVRGREVLANADVVVTDRLAAAVLLGAAPAGAEIIHVGKSPAAPSWTQEEINAVLVDRARAGARVVRLKGGDPYMLGRGSEEAQACAAAGVACTVVPGVTSALAVPACAGIPVTHRGLAQEVAIVSGHLPPGHPESTVDWAALAASRATIVILMGVARLMDIADALLTGGRPEATPVAVIERGATPAQRVLRTTLDALAIDAIAAGVRSPAVIVVGEVAARRDALALEAGPLTGIRVLVARTRPRPGLLARRLRQLGADAVETVVARPAPVEDAGAALVAALPGAGGLLLADADEVAAVVTLLRRAGTDVRALAGLTLVAAREDAAEALDGLGLASVPVAELSTDPLSADPSSTGPAGPAGPTGSSRVLIAGAADPPDAVCSLRRVPLLTDVTAEPDPRIAEELRHGDFDVAVFASSTAARGTAEIYGPLPPDLLIAAMGRRSALACAAAGMRVDIVPTEPGVHPLAAAVADFVVTSRSTGSPGG

SEQ ID NO: 17025 - protein, 258 aa, Bacillus cereus
MGKVYIVGAGPGDPDLITVKGLKCIEKADVILYDRLVNKELLSYAKPEADLIYCGKLPNYHTMKQETINTFLIKYAKKGKVVTRLKGGDPFVFGRGGEEAEALAKQGVPFEIVPGISAGIAAPAYAGIPVTHRDASASFAIVTGHRKEDAEEEVKWENLAKGVETLAVYMGVSNLPYICEQLIKHGKDKSTPAAIIERGTTSMQRTVVGTLGTIVDVAKKEQIQNPSMIVIGEVVRFRGKIHWFEKQIESTYQVSGVL

SEQ ID NO: 17026 - protein, 406 aa, Oryza sativa
MLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 17027 - protein, 76 aa, Zea mays
  misc_feature (61)..(61): Xaa can be any naturally occurring amino acid
FFNFQRKNVQNKVPKQNGKPHLNPGKKRAKKLSGRQKSKNPVGFTLVEVLAWGSVGHIVAXNILAPSSKGNDPNFF

SEQ ID NO: 17028 - protein, 411 aa, Arabidopsis thaliana
MNALAATNRNFRHASRILGLDSKIERSLMIPFREIKVECTIPKDDGTLVSYIGFRVQHDNARGPMKGGIRYHPEVDPDEVNALAQLMTWKTAVADIPYGGAKGGIGCSPRDLSLSELERLTRVFTQKIHDLIGIHTDVPAPDMGTNAQTMAWILDEYSKFHGHSPAVVTGKPIDLGGSLGREAATGRGVVFATEALLAEYGKSIQGLTFVIQGFGNVGTWAAKLIHEKGGKVVAVSDITGAIRNPEGIDINALIKHKDATGSLNDFNGGDAMNSDELLIHECDVLIPCALGGVLNKENAGDVKAKFIVEAANHPTDPDADEILSKKGVIILPDIYANAGGVTVSYFEWVQNIQGFMWEEEKVNLELQKYMTRAFHNIKTMCHTHSCNLRMGAFTLGVNRVARATQLRGWEA

SEQ ID NO: 17029 - protein, 214 aa, Triticum aestivum
  misc_feature (14)..(14): Xaa can be any naturally occurring amino acid
DGLLADYASGIAAXPGSGWTILRGAGTEDDIRITYRKNNDDSNNAVVSVCASFHLPVPLKVTFDLLRNNLLRPKWDVLVNGNSVREEVAVCKGVGAGIDDVVSILHLKDPPTGENRDNIMILQNSGYDVSGAFMVYCPVNIQLMNEIMSPSDTAASNKVSLYPTGFHLLPVEDTALGLGEGGATLVTAGFQIMLKLAPWAPACILRSASNGRPV

SEQ ID NO: 17030 - protein, 550 aa, Schizosaccharomyces pombe
MSFCLASTLPAWEVVQTHYESVGKHLVLKELFAKDSSRFEKFSFTFNGLKEEDGPILFDFSKNLITEETVELLVKLAKEANVEGLRDALFAGEHINFTEDRAVFHPALRNVSEKPMKVNGQDVMPGVRKVLRHMKEFSDAVRSGAWKGYTGKPIKSIVNVGIGGSDLAPVMVTEALKPYGQENLELHFVSNIDGTHLSEALKKCDPETTLFLIASKTFTTAETCTNAKSAKDWFLASAKDPSHVAKHFVALSTNEKEVTAFGISAQNMFEFSDWVGGRYSVWSAIGLSVALYIGYENFEAFLSGAHAMDEYFCSTPLEKNIPALAALISIWYSDFFGAQTHLVAPYDQYLHRFPAYLQQLSMESNGKAITRSGDMVNYTTGKILWGEPGTNSQHSFFQLIHQGTKLIPADFLIPIESHNPIDNNKHHRMLFSNFAAQTEALMLGKTPAEVKAEGTPDEIVPHKTFVGNRPSNSIIAKKITPASLGALIAFYEWVTFTEGAVWNINSFDQFGVELGKKLVKNVLAQLETKGDVENHYSSTNGLINLFKNGF

SEQ ID NO: 17031 - protein, 251 aa, Pisum sativum
MEEYTNNPNQNQNQSSRPNFLYNQIPMKQHLSSSIKRIRKLFSFRNKLHHHQHQHHHHQQQSAVENWNLIVTSQLHTPIFHYPNLMRTNIIPQTIMNHHQQGGGGSPSSSNEAESIKAKIIAHPQYSSLLQAYMDCQKIGAPPEAVARMVEARQEFEARQRSSVNSRESSKDPELDQFMEAYYDMLVKYREELTRPIQEAMDFMRRIETQLNMLCNGPLRIFPDDKNEGVGSSEEEQENSGGETDQVQEID

SEQ ID NO: 17032 - protein, 72 aa, Chlorobium tepidum
MAKEESIEVEGEILEALPNAQFRVKLENGLEVLAHVSGKIRMHYIRILPGDKVKVQISPYDLSKGRITYRYK

SEQ ID NO: 17033 - protein, 195 aa, Mesorhizobium loti
MDEKAAPGSETAIFAGGCFWGVQGVFQHVKGVSKAVSGYTGGAKDDAVYETVGTGRTGHAESVEITYDPSKVTYGQLLQVYFSVAHNPTQLNFQGPDSGTQYRSTIFAENDTQKQIAQSYIDQLDKAKLYPAPIVTTIETGKTFYPAENYHQDFLTLNPTYPYIVYNDLPKVANLKQLFPALYSEKPVLVLSASN

SEQ ID NO: 17034 - protein, 457 aa, Staphylococcus epidermidis
MAIGVILNRVFRLNNNPLFDYIYSNKESINHCYFIIPTEEFEEEAKKKAQYYYGSIQKFMYELQRYDIEPFLMSYDKLIDFCKKQAIDKVVVAGDIMSYHHEEYDILHQRKRFKQANIQVISLRANHYFNPRKTHNKQGEPYKVFTSFYRKWRPYLMIRDEYDYHLEDISKVVVKSQHKIKEDYHSYGISERDVQNRWSEFLSQDIENYKENREYLPEVLTSQLSIYLAYGMIDIIQVFNDLLQNYDKNEQNYETFIRELIFREFYYVLMTNYPETAHVAFKEKYQQLKWSYNEENFKLWKDGNTGFPIIDAAMEELKTTGFMHNRMRMVVSQFLTKDLFIDWIWGESFFKQKLIDYDAASNVHGWQWSASTGTDAVPYFRMFNPIRQSERFDNNARYIKTYIPRLNQVDAKYLHDTHKFEQQIKGQGVEIGKDYPKQMIDHKESRQRVMSEFKALD

SEQ ID NO: 17035 - protein, 531 aa, Solanum lycopersicum
MGDIEGSPGSSMHGVTGREPVLAFSVASLIVPTDTSANFKVPVDSEHKAKVFKFYSFSKPHGLTFQLSWISFCTCFVSTFAAAPLVPIIRDNLNLTKMDVGNAGVASVSGSILSRLAMGAICDMLGPRYGCAFLIMLSAPTVLCMSFVSSAGGYVAVRFMIGFSLATFVSCQYWMSTMFNSQIIGLVNGTAAGWGNMGGGATQLIMPLLYDIIRRAGATPFTAWRIAFFIPGWLHVIMGILVLTLGQDLPDGNLASLQKKGDVSKDKFSKILWYAATNYRTWILVLLYGYSMGVELTTDNVIAEYFFDRFDLKLHTAGIIAATFGMANLLARPFGGWSSDVAAKHFGMRGRLWNSWILQTLGGVFCLLLGRATTLPLAITWMIIFSIGAQAACGVTFGIIPFISRRSLGIISGMTGAGGNFGSGLTQLLFFTSTKYSTGTGLTYMGMMIIACTLPVMLVRFPQWGSMFLPPSKDPIKGTEEHYFGSEYTEDEKQKGMHQNSIKFAENSRTERGKKRVGSAPTPPNVTPNRV

SEQ ID NO: 17036 - protein, 144 aa, Schizosaccharomyces pombe
MLIPKENRKAIHQALFSQGVLVAKKDFNLPKHPEVGVPNLQVIKACQSLDSRGYLKTRYNWGWFYYTLTNEGVEYLREYLHLPAEVVPATHKRQVRPTAPRAGRPEPRERASADAGYRRAEKKDEGAAPSGFAPSFRGGFGRPQ

SEQ ID NO: 17037 - protein, 482 aa, Acidobacteria bacterium
MSTTSAPAVGSAQFGVVGLGVMGQNLALNVSDHGQVVSVWNLEADWVTKFLTQHSDRKMTGSGDLKEFVQSLARPRRILMMIMAGNPVDQMLDKLAPLLEPGDIVIDGGNSFFKDTQRREAAYRTKNLNFFGMGVSGGEEGARFGPSLMPGGDEASYEHLKPTLEAIAAKTDYGACVTYVGPNGAGHFVKMVHNGIEYGDMQLIAEAYDLLRKALGLGAKEIAAIFEEWNKGKLESYLIEITSHVLQVDDPETGKPLVDMILDKAGQKGTGKWTQQIALDLAVPIPTIGAALDARVLSSMKDERVAASKKLGAPSRQYSGDKKEFINAVQDALYASKVCSYAQGMSLIRAGSKEWNWNVNLREMARIWTGGCIIRARLLADIMHAFDRDANVANLLVESEFTSRVLESEKNWRSVVQTAAGLGIPTPAFSSSLAYFDSYRSMQLPQNLTQAQRDFFGAHTYQRADRPDAGFVHTDWIKLVKK

SEQ ID NO: 17038 - protein, 334 aa, Mycoplasma gallisepticum
MQDSLMKTKIGVLGTGAWGTALANILLKNGHIVQMWGIDQDEINSLKTGYNNRYFGHIKLVKSPDLVSSDLAAVVDGCDYLLLAIPSKFFNDVLAKLTNVLKDRKVNLINVAKGMDGQTKQFWSEVIKQAFSKNLLSLTSLLGPSFATEVFDNHPTVINAVSNDMTSCKKVCELFNNNTFQLVPFDNELSAQLFAAIKNVCAIGTGIVFEQTTSANTRSALLTKLFNEMDRLYESLAKDKYRPKDCTQLSGIGDFILTCTNDQSRNFSFGKLVAKYGIKNALEKNIKTVEGYLAAKTMYEIIKNNNLELKLLITIYQILYEDLDESVLVKKLIN

SEQ ID NO: 17039 - protein, 417 aa, Buchnera aphidicola
MLNNKIDFSKYDPKLWFAIEQEKKRQENHIELIASENYTSNYVMDVQGSQLTNKYAEGYPGKRYYGGCEYVDIIEELAIERAKKLFNADYANVQPHSGSQANFSVYTALLNPGDTILGMKLSHGGHLTHGSSVNFSGKMYNVISYGVDENGEINYEELLRLTKKYKPKMIIGGFSAYSGICNWKKMRFIADNADAYFVVDMAHVAGLVAAGIYPNPINYAHVVTSTTHKTLAGPRGGLILAKNGDDILYKKLNLSVFPGAQGGPLMHVIAAKAIAFKEALEPKFKTYQKQIVKNSKVMVERFLEKGYKIISGHTFNHLFLIDLTNKKITGKDADIILSKANITVNKNTIPNDLKSPFITSGIRIGTAAVTRRGFKENEVSRISDWITSILNNVDDHNNVLQIKKKVLEMCLKYPVYI

SEQ ID NO: 17040 - protein, 647 aa, Oryza sativa
MAASVEYKLAPHPWASNAPSSNLDLFPSGGGKRRSGSETDSDDEDSIPPDWRSLYHPRLEVAEPAVKDPRDEATSDAWVRRHPALVRLTGKHPFNSEPPLPRLMSHGFITPAPLHYVRNHGAVPKADWSTWAVEVTGLVKRPARLTMEQLVTGFEAVELPVTLVCAGNRRKEQNMVRQTVGFNWGPGAISTSVWRGVRLRDVLRWCGVMGASAGAANVCFEGAEDLPGGGGCKYGTSLRREVAMDPARDVILAYMQNGEPLTPDHGFPVRVIVPGFIGGRMVKWLKRIIVASSESESYYHYRDNRVLPSHVDAELANAEAWWYKPEYMINELNINSVITTPGHDEVLPINALTTQRPYTMKGYAYSAAAAAAAPAVPVSTVALSNPREKVKCRLMDKKSLSYNVRLFRFALPSPDQKLGLPVGKHVYVCASIGGKLCMRAYTPTSSVDEVGYIELLIKIYFKGEDPKFPDGGLMSQYLDYLPLGATIDIKGPIGHIEYAGRGAFTVNGERRFARRLAMVAGGTGITPVYQVIQAVLRDQPDDGTEMHVVYANRTEDDMLLREEIDRWAAAHPARLKVWYVVSKVARPEDGWEYGVGRVDERTLREHLPPGDGETLALVCGPPAMVECTVRPGLEKMGYDLDKSCLVF

SEQ ID NO: 17041 - protein, 1015 aa, Streptomyces avermitilis
MSFRTTASPTSTEYVEDVSPGSGALPPRAWYASSDAVSLSLNGSWAFRLSPTADAQDDSFAAEGYAIEEEGEGYDAGDWTEIEVPGHWGLQGHGAPIYTNHLYPFPVDPPRVPTENPTGDHLRVFDLPADWPALSDGGCVLRFDGVESCARVWLNGTDIGEFKGSRLPHEFAVGHLLKPRGNVLAVRVHQWSAGSYLEDQDQWWLPGIFRDVTLLHRPAGSALDFFVHASYEHVEGLGTLRVDSDVDGRVTVPELDVDVETGESVTVAVEPWTAETPRLYDGVLATEGEQVPLRIGFRTVVRQDGLIKVNGTPVLFKGVNRHEWHPERGRALDLETMRQDVLLMKRHNINAVRTSHYPPHPAFLDLCDEYGLWVIDECDLETHGFTEQAWRDNPVDDDRWTPALLDRAARMVERDKNHPSVVIWSLGNEAGTGRGLTAMAEWIRGRDTSRLIHYEGDIDCRDTDVYSRMYAAHAEVERIGRGLDGGTHRRRDLPFVLCEYGHAMGNGPGGLADYQRLFETYGRLQGGFIWEWIDHGIKDERYGFAYGGDFGEELHDGNFVCDGLLFPDRTPSPGLVEYKKVIEPVRIEGWGSPLAGRSRAPGGGADGTDGTDGTDGTDGTDGTIRVTNAYDFADLSALAFEWSYQVDGETVEAGALSVPALAPGESADVKLPTPPVDGRGAETQWTVRAVLTAETAWGPKGHQVAWAQFPLGKGSSERVARPGGRVAPSCGPVPGERRITLGPAAFDARTGAPRTIGGVDVTGLRLDVWRAPTDNDNGAHWQPDERYGPLWRRLGLHRMQHRLEAVELDDDALTVRSRVAPAGWEVGLRTAYRWTSDGTRLRLTVSVAPEGDWTLPLPRLGVRFGLSSAADRVRWFGGGPGEAYPDTRSASMLGRWESAVDDLQTPYVRPQENGARADVRWAEIGGLRIEGEPEFWFTARRWTTEQLDAAEHLTDLTPGDTVWVNLDHGQQGIGSQSCGPGALPQYHLRPGPAEFSFVFSEASSRRSMSEPRSRR

SEQ ID NO: 17042 - protein, 236 aa, Oryza sativa
MTRRYWNINLKEMIEAGVHFGHGIKKWNPKMAPYISAKRKGTHITNLARTTRFLSEACDLVFDAASQGKSFLIVGTKKRAADLVASAAIRARCHYVNKKWFSGMLTNWSITKTRLSQFRDLRAEEKMEKFHHLPKRDVAILKRKLSTLQRYLGGIKYMTRLPDIVIVLDQQKEYIALRECAILGIPTISLADTNCDPDLANISIPANDDTMTSIRLILNKLVFAICEGRSLYIRNH

SEQ ID NO: 17043 - protein, 149 aa, Oryza sativa
MGRRPARCYRYWGGKPFPKSRYNRGVPDARIRIYDAGQKKADVELFPFCVHLVSLEKEQISSEAMEAARVAANKYLIKKCGKEGFHLRCRVHPWHVIRINKMLSCAGADRLQTGMRGAFGKPTGKVARVKINQILYSVRLAEKNVPHAV

SEQ ID NO: 17044 - protein, 354 aa, Pyrococcus furiosus
MDGSGGGFPPSGVPAAARNFIWVVTMHPKVQSLLSKFPRVELIPWETPIQYLPNISKLVGADIYVKRDDLTGLGIGGNKIRKLEYLLGDAIIRKADVIITVGAVHSNHAFVTGLAAKKLGFDVVLVLRGKEELRGNYLLDKIMGIETRVYEAKDSFELMKYAEEVAKELEEKGRKPYIIPVGGASPVGTLGYVRASGEIAEQGNRIGVNFDSIVVATGSGGTLAGLSVGLAILRKETRAIGMAVGKFGETMVNKVEELAKATGEFIGVKNLKLKIELYDYSFGEYGKITREVAETIRLVGTKEGVILDPVYTGKAFYGLLDLAKKGELGEKILFIHTGGISGTFHYGDKILSFL

SEQ ID NO: 17045 - protein, 279 aa, Saccharum officinarum
DACEKWGFFEILNHGISTELMDEVEKLTKDHYKRVREQRFLEFASKTLKDAQDVKAAENLDWESTFFVRHLPESNIAEIPDLDEDYRRAMRQFTGELEALAERLLDLLCENLGLDRGYLARAFAGPRTGAPTFGTKVSSYPPCPRPDLVSGLRAHTDAGGIILLFQDDALGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKQYVRHKFEAKEPRFE

SEQ ID NO: 17046 - protein, 419 aa, Crocosphaera watsonii
MTIKSSPNWLLTSVERSYNAYLALETSDSLDRSLGIKAMAKGLNRSFDAILEANTLDLEMSREMAIPDILIDWLKLTPERLKNTVEILESLAELPDPIQQVFNAPYRLNMAGTYSQLKPLGVVALVYETFPELGAIAAGFCLKTGNSLLLRGCNSSTHSNQVIADILQTALKDTELPTGCLEVISAEQGASIQDLVTQHQYLSLVLPYGRPSLVEQVTQWATAPVLKSAMGNCYLYWSPTVDLEMVRWVILDSHSSEPDPVNAIEKVLISPDQKPSILVRLFNILQEQGFELRGDERLLEEYKDHLKPVKASEWSTPYLDKIIAFKIVDNLSEGITWINQYSSGHADCLVTDSYTESRQFATEIDSALVYINNSPRFDRHPTYGESLFLGVSNQKGHYRGLISLETFTTLKQVVQGQGK

SEQ ID NO: 17047 - protein, 494 aa, Unknown
  Dehalococcoides sp. CBDB1
MKILLVNPGTEYKPRFRTYAVFPNGLLYIAAVLERAGHEVRIFDNVVSELTPPDYAKDFAPEVVGFSVLTGPCIGNALVQSKEFKALLPGVKVVWGNVHATCTTEQTLNEEAIDFVVRGDGEYTFLDLIEHLEKGEENYAEIQGLAWKDTEGRVIINQPRPFIHNLDELPNPAWHLIDVPKYWDITLNTSRGCPFKCSFCYNIPFHQGHRADLSVERIIAQIEHLQKNYKVKFIRFFEDNFTFNRKRMREFCQTVIDRRIKIKWDTESRADMSEEDVALMAKAGCTSVGIGVETGSKRMLEYLNKGVDLDEMGRTFWRFVKHGIMPRLYIMLAVPTETVEDFTETQDMLHRMEDPPFMYMRFVPYPGTPLYNQLVKDNRIKPPESLGEWAKFSVYFATKGNLSELSDEVINQAISHWAHSYASRRVMFTLRHNPRYLLSAVKNPAEFFKAVSSLIKNSLPVVFNKNTNIKPLVLEAVPNKMHGKQEPRLISNYE

SEQ ID NO: 17048 - protein, 397 aa, Oryza sativa
MEGGGARNGSTTGAARTGGSGGDAAAGGGGGSAGNGKPLPPCCVKARAAAPESEAKCHATVVSGWFTEPRSRGGKTSKVQYYNNPMWPGEAHSLKVEKILYQGKSPYQEVLVFESSTYGKVLVLDGIVQLTDKDECAYQEMITHLPLCSIPSPKKVLVIGGGDGGVLREICRHGSVESIDICEIDQLVIDVCKDFFPDLSVGFKDPRVRLHVGDAVEFLRNAPEGTYDAIIVDSSDPIGPAQELVEKPFFDTIARALRPGGVLCNQAESMWLHTHLIQDMLSICRETFKGSVHYAWTSVPTYPSGVIGFLLCAKEGPPVNFLTPANPIEKLEGAMEAGRDIRFYNSEMHRAAFVLPTFARRELEAYCTTVEREQQEETTAEPLKMNIMPNSEILTAS

SEQ ID NO: 17049 - protein, 321 aa, Methanothermobacter thermautotrophicus
MMVTVIGAGSFGTAIAQVLSWNAEMVRLMARRSEVVENINRTRENSAYHPGVKLRDNIEATLMDGSVLEESEYVFMAVPSGNLRSIVRSMNSSLEDKKIVSCIKGIEHPGLKTMSSVIREETGSRTVFSISGPNFADELIRGMTSGITVGASTRYAREIAGLLKSPRIILDHSENVEGVEFCGILKNVYAVAMGILDGQITGENHRHSLLTLCFREMNLILNEMGYGELHDRFCGFGDFLLTSTTDKSRNRTLGLMLGKKMRLSEDSTITIESLRSIRAIRELTEGLELPVLEMVYQTMQEPENVNLYIREFQERISRPEF

SEQ ID NO: 17050 - protein, 139 aa, Populus alba
FLLGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTPHLVLRLRGGMQIFVKTLTGKTITLEVESSDTIDNVKAKI

SEQ ID NO: 17051 - protein, 364 aa, Cryptococcus neoformans
MSLWSNIWLWIRYQVNVIIHCGFPCFFWVQPTWSIDKIENQEGKVVLITGGNSGTGYATALALYNAGATVYIACRNLTRAKEAAEDIKKGGERGIWGVTYPSKELDKAGGNKKGRVEIIQLDLTDLASVEKCAEEFLNKEKKLDLLFANAGIMATPEGQYTKQGYTLQLGTNTLGHHRLITLLLPLLLSSPPSLPSRVILTSSAGHSMAPKGGVNIKSVVRDPSDTGSGQGKYELDKWTEYAQSKWGNIASAKYLEDTYGKEGRLIAVAVHPGLVATNLTNHLPFVGIFYRWVPWLRHLFTRDPSTGALNQLYAATLPLPDAWFLNGEYVVPYNTVGICRSDLLDKKRIEEVWNWCDEQGKKFA

SEQ ID NO: 17052 - protein, 553 aa, Vibrio angustum
MFCIQCEQTIQTPQVKGCAFAAGMCGKTAEVSDLQDVLVYTLQGVSYWAELAKRFDIINDEINQWAPRAFFATLTNVNFDPARVIELAEQAQSYKAQLKDIVITASTLQAEALPVLPAVAQFELPLSATEILAIAPQVAVNRGHDTLHEDVIGLRLLCLYGLKGAAAYLEHARVLGQTNDDVYAEYHQIMAWLGTEPTDLNQLLDCSMRIGLMNYSIMEMLDTGETTTFGHPEPTQVNVKPVQGKCILVSGHDLHDLEKILQQTEGKGINVYTNGEMLPAHSYPELKKYPHLVGNFGSAWQNQQKEFANFPSAIVMTSNCLLNPNVGQYADRLFTRSIVGWPGVEHIDGDDFSQVIDCALALEGFKHNEIEHMITIGFGRNALMSAAPAVIDEVKKGNINHFFLVGGCDGDKSERSYYTDFTTQAPEDSVILTLACGKYRFNKNQFGDINGIPRLLDVGQCNDAYSAIQLALALAKEFDCGINELPLTLVLSWFEQKAIVILLTLFALGVKGIYTGPTAPAFLTDNLLAIIQDKFDMRPITTVENDLKTILNA

SEQ ID NO: 17053 - protein, 376 aa, Prochlorococcus marinus
MADFYDLLGVSRDADADTLKRAYRQQARKYHPDVNKEAGAEDKFKEIGKAYEVLSDSQKRARYDQFGEAGIGGAAGMPDMGDMGGFADLFDTFFNGFGGASSAGGSRPQRRGPQQGDDLRYDLTIDFDKAIFGQEKEITVPHLETCDVCRGTGAKKGTGPVTCSTCSGAGQVRRATRTPFGSFTQVAECPTCGGTGQVIKDPCNACGGKGVKQVRKKLKINIPAGVDSGTRLRVSGEGNAGLKGGPSGDLYVFLKVKNHPNLKRDGLIILSEVNISYLQAILGDTIEIETVDGPTKLQIPAGTQPNSILNLENKGVPKLGNPVARGNHQVSVKIKLPTKLSDSERNLLEELAGHYSARGPQHHYHKSGLFSKLFGK

SEQ ID NO: 17054 - protein, 681 aa, Oryza sativa
VLGTPGREGGLVLRASGSGEGVPLAPAAGGASLAAELSFDPTRAPFYLSFLLTDASGAEIRTHRKTSFRVPVGVGPGSPAPLGMSISGDGAVNFAVYSKNANAVSLYLYAAAVGGGGGDEPALEIDLDPYIHRTGNVWHVSLASVDGYVSYAFCCGGIRRPLLDPYAKVIGDFVSSNSVYDEGVTAPSMRCFASLAIAPSYNWGRDRHPRLPLEKLVVYRANVALFTKDRSSGLPDDAAGTFTGLSAKVEHFRSLGVNAILLEPVFPFHQVKGPYFPYHFFSPMNLYSSKGLSVSAIKSMKDMVRVMHRNGIEVLLEKLILDSLRHWVLDFHVDGFCFINAPFLVRGPGGEYLSRPPLLEAITFDPVLSMTKIIADPWSPLDISNVQFPFPHWKRWAEVNTRFSIDVRKFLKREALISDLATRLCGSGDLFSTRGPAFSFNHVSRNSGLSLVDLVSFSNDDLLSGPRGNCGEEGPSENSAVLQTRLRQIRNFLFILFVSLGVPVLNMGDECGHSAAGSVSYKDRGPLNWRGMKTTFVKEVTGFISFLTALRSRRGDIFQRREFLKLENIHWYGSDLCEPGWDDPTSNFLCMHINAEVDEMAADSVRGDLYICFNANEESVSAALPALAEGSVWLRLVDTSLAFPGFFATESNPKVQQVPGLSSYHVEAHTCVLFESKSALA

SEQ ID NO: 17055 - protein, 414 aa, Mycoplasma gallisepticum
MWINLMEIFKLINQELQRQQDQIELIASENYVSEAVLRATGSVLTNKYAEGTPNKRYYGGCEYVDQIELIAIEKLKKLFGARHANVQPHSGSTANAAAYLALLQPHDKVLAMGLNDGGHLTHGSKVNFSGKIYDFYHYNVDPNTYLLDYDEILKKAIEVKPKLIVCGASNYSRAIDFAKFRQIADHVSAYLMADIAHIAGLIVAGYHQNPVEYCDIITSTTHKTLRGPRGGIILTNREDLIKKIDSAVFPGELGGPLMHVIAAKAIAFDEALQPKFKTYIKNVIDNSKAFCEAFINKGYQIIANGTDNHLFSINLFKKFNLTGDLVENWLYQANIVVNKNMIPYDSNKSMNPSGIRLGTAAMTSRGLVQSDFVQIADWIDQIIKAKGDLNVINKVKSEVKKLLVKYPIYQDRDY

SEQ ID NO: 17056 - protein, 978 aa, Unknown
  Synechococcus sp. WH 7805
MTLLDQRTAASKTVQPISPFVRRHIGPEPQAVDQMLQALGFADLDAFIQAVVPGDILDPEPPCADLPEGVDEAPALAELRTIASCNQLSRSLIGLGYFETVTPALIQRQVLENPSWYTAYTPYQAEIAQGRLEALLNFQTLISELTGLPIANASLLDEATAAAEAMSMSFGVCKREGANRFLVDAAVLPQTLAVLRTRCEPIGVQLDVAEPEAFRWGDDVFGVLLQLPGRCGRLWDPRACIERAHTHGALVTVSVDPLAQVLLEPVGALGADIAVGSAQRFGVPMGGGGPHAAFFATRDAYRRQVPGRLVGQSRDAEGRPALRLALQTREQHIRRDKATSNICTAQVLLAVMASFYAIHHGPEGLETIANRIVMLRSRLELGLAALGFPVPGGVRFDSVDVHCPQAPLVHRLAAREGYNLRVLPDGVPADEAHGFGISLDELSDEAEIQSLLSICAEVVQTVPPVSSQPSSPAEVMAGVPLRQRPWLQQSVFHRYRSETELMRYIQRLVSKDLSLVHGMIPLGSCTMKLNAAAELAPVSWREFAAVHPFAPVAQQEGFQALIRDLERWLAALTGFAGVSLQPNAGSQGEYAGLLVIRAWHRSRGEAQRDVCLIPTSAHGTNPASAVMAGLRVVAVACDEEGNVDVGDLRSKAREHADVLAALMVTYPSTHGVFETRIREICSLVHEHGGQVYLDGANLNAQVGLCRPGAFGADVCHLNLHKTFCIPHGGGGPGVGPIGVAAHLQPFLPGHPLMPCGGNQPISSVSAAAWGSAGILPISWMYLRMMGAEGLRTATAVALLSANYLAHRLHAHYPVLFRGEGGLVAHECILDLRGLKRSAGLEVDDLAKRLMDYGFHAPTVSWPVAGTVMVEPTESESLEELDRFCDAMIAIREEVSRIESGESDRDNNPLKRSPHTLAAVTDDHWERPYSRQEAAFPLPGQQQNKFWPAVARIDNAFGDRNLICTCPSVAELAESLPVR

SEQ ID NO: 17057 - protein, 72 aa, Unknown
  Candidatus Kuenenia stuttgartiensis
MAKEEPIRVEAVVKESLPNAMFRVELQNGHKILAHVSGKMRMHFIKILPGDKVTVEMSPYDLDKGRIIYRQV

SEQ ID NO: 17058 - protein, 483 aa, Buchnera aphidicola
MQKNLIWFRNDLRVYDNTALHQACQNDTDKVISLFISTPKQWHNQSVSKKKISFMYYHLISLQKELLKLNIILYYHESTDFLNSIEYLIFFCKKHKVNNLFYNYEYAINERYRDYLVKKKLSQKGFLVKGFHDNLLFSNRQIRNQKNETYKVFTFFKKKVIQNLHNNIPQCFPVPSKRKSDRDIFLTSISLKNVNLNFNKNFFPVGEKEAINRLKNFCIYKFNDYFLKRDYPFLDATSMLSPYLSAGIISSRYCLKVLLKTKNSLPLNVLLTSPWFDQILWREFYYHLLIGFPKISRSESLVTWEKEIHWINNIKHFNAWKEGNTGFPIIDAGMRQLNELGWMHNRLRMITSSFLVKNLLINWREGEEHFISNLIDGDLALNNGGWQWSASVGCDSVPYIRIFNPLHQSKTFDESGNFIKKFIPELKNVPNHHIHQPHEWSKQKNFKIDYPNPIINYSESRKTSLSLFKQARLKLHKNGLKNS

SEQ ID NO: 17059 - protein, 203 aa, Arabidopsis lyrata
SSAKFRRGYDTNVLKPLLSFLRSTSSPFVVNPYPFFGYSIETLDFALFRPNPGLFDQHTKLLYTNMLDAQLDSVYSAMDRLGFSDVEIVIGEIGWPSEGDIDQIGVDVATAAEFNKNLVTRVNSGTGTPLMPNRTFETYIFALFNENLKSGPTSERNFGIFRSDLSPIYDIGIFRPTFRSSNPENNPVSPEKRWCVTKAGAET

SEQ ID NO: 17060 - protein, 472 aa, Escherichia coli
  misc_feature (309)..(309): Xaa can be any naturally occurring amino acid
MTTHLVWFRQDLRLHDNLALAAACRNSSARLLALYIATPRQWAAHNMSPRQAELINAQLNGLQIALAEKGIPLLFREVDDFAASVEIVKQVCAENSVTHLFYNYQYEVNERARDVQVERTLRNVVCEGFDDSVILPPGAVMTGNHEMYKVFTPFKNAWLKRLREGMPECVAAPKVRSSGSIKPAPSITLNYPRQSFDTAHFPVEEKAAIAQLRQFCQNGAGEYEQQRDFPAVEGTSRLSASLATGGLSPRQCLHRLLAEQPQALDGGAGSVWLNELIWREFYRHLMTYYPSLCKHCPFIAWTDRVQWQXNPAHLQAWQEGKTGYPIVDAAMRQLNSTGWMHNRLRMITASFLVKDLLIDWREGERYFMSQLIDGDLAANNGGWQWAASTGTDAAPYFRIFNPTTQGEKFDREGEFIRQWLPELRNVPGKSVHEPWKWAEKAGVKLDYPQPIVEHKEARVQTLAAYEAARKGK

SEQ ID NO: 17061 - protein, 263 aa, Schizosaccharomyces pombe
MLSRKLSPEQLVARRLKIRDWNHKIGAVVAPHYSPTLSIRNPAPPSQLSLPLLLSSGAHLGHSTSIWNPYTQPFIYGKREGIHIISLDQTMVYLRRAISVVRSIAKENGIILFIGTRNGQKDSVVAAAKRARGYHIFDRWLPGLLTNAREVQGKLGGSILCKDNRGKLIQTDKKPSYVFPDLMVILNPLENKSACLEAQKTHVPTIGIIDTDADPRMVTYPIPANDDSLRCTDLIAGLLSRVAEQEYQKANQAFEKDKFTLPL

SEQ ID NO: 17062 - protein, 328 aa, Prochlorococcus marinus
MAKIYEDNSFAIGNTPLVKLKSVTKNAKATVLAKIEGRNPAYSVKCRIGANMIWDAEKSGKLTKDKTIVEPTSGNTGIALAFTASARGYKLILTMPESMSIERRRVMAVLGAEIVLTEASKGMPGAIAKAKEIAESNPSQYFMPGQFDNPANPEIHFKTTGPEIWDDCDGEIDVLVAGVGTGGTITGVSRYIKQEKGKNITSVAVEPSHSPVITQTMNGEEVKSGPHKIQGIGAGFIPKNLDLSIVDKVEQVTNEESIEMALRLAKEEGLLVGISCGAAAAAAVRLAEQDEYAGKTIVVVLPDLAERYLSSIMFTEVPSGIIQEPVKA

SEQ ID NO: 17063 - protein, 445 aa, Unknown
  marine gamma proteobacterium HTCC2207
MYIFDQSNTQDWTLGGASRWWLHHALQSLDKSLDGKLNIFSGDALAILSELSASMSAKAVYWNRCYEPQSIERDANIKTRLKEAGLDVQSFNGSLLWEPWQVLKKDGTPYKVFTPYYRRGCLQKVAPRQPLPVPKTLDLVKADNSLTVEDLSLLPAIDWDKKLHGDWDISEDGAKDRLDDFVFNGIQDYREGRNFPNKKNVSRLSPYFHFGQMSVNTAWYAANDAAALIDNESNLDTFLSELGWREFSYYLLYHFPKLPTDNLQQRFNVFPWAKNTDAELKAWQKGKTGYPLVDAGMRELYGTGYMHNRVRMVVGSFMVKNLLIHWHSGERWFWDCLVDADLAANSASWQWIAGCGADAAPFFRIFNPITQSEKFDKQGDYIRRHVPELAEMPAKYIHAPWLAPADVLAAAGVEIGTDYPAPIIDIKESRERALAAFKMTKNDVL

SEQ ID NO: 17064 - protein, 467 aa, Schizosaccharomyces pombe
MSSNDSIMLTPLKEQDPTVAEIMRHEADRQRSSVVLIASENFTSRAVMDALGSVMSNKYSEGYPGARYYGGNKFIDQIETLCQERALAAFNLDPAKWGVNVQCLSGSPANMQVYQAIMPPHGRLMGLDLPSGGHLSHGYQTDTKKISAVSTYFESMPYRVDPNTGLIDYDMLEHDAQLFRPKILVAGTSAYCRLIDYARMRQIADSVNAYLVVDMAHISGLVSAGVIPSPFEYADVVTTTTHKSLRGPRGAMIFFRRGLRKHDKKGNPIYYDLEDKINFSVFPGHQGGPHNHTITALAVALKQCQEPAYKEYQAQVVKNAKVCEEEFKKRGYKLAADGTDSHMVLVDVKSKGVDGARAERVLELINIVTNKNTVPSDKSAFSPSGIRVGTPAMTTRGFKEQDFVRVVDYIDRALTFAANLQKELPKDANKLKDFKAKLGEGEQYPELVQLQKEVAEWASSFPLADKW

SEQ ID NO: 17065 - protein, 526 aa, Pseudomonas stutzeri
MASVHSITYELLRRQGIDTVFGNPGSNELPFLKDFPEDFRYILALQEACVVGIADGYAQASRKPAFINLHSAAGTGNAMGAMSNAWNCHSPLIVTAGQQNRAMIGVEALLTNVDAASLPRPLVKWSYEPASAAEVPHAMSRAIHMASMAPRGPVYLSVPYDDWDKEADPQSHHLYDRSVNSAVRLNDQDLEVLVEALNSASNPAIVLGPDVDSANANADCVTLAERLKAPVWVAPSAPRCPFPTRHPCFRGLMPAGIAAISQLLEGHDVVLVIGAPVFRYHQYDPGQYLKPGTRLISITCDPLEAARAPMGDAIVADIGTMTAALASRIGESERQLPAVLPSPERVNQDAGRLRPETVFDTLNEMAPEDAIYLNESTSTTAQMWQRLNMRNPGSYYFCAAGGLGFALPAAIGVQLAEPDRQVIAVIGDGSANYSISALWTAAHYNIPAIFLIMNNGTYGALRWFAGVLEAENVPGLDVPGIDFCAIAKGYGIPALKADNLEQLKGSIHEALSAKGPVLIEVSTVSL

SEQ ID NO: 17066 - protein, 303 aa, Lactobacillus plantarum
MLIQHVQELIGHTPLMALPIEVPNHSHIYAKLEMFNPGGSIKDRLGAYLIEDGLQRGRVNAKTTIIEPTAGNTGIGLALATQAHHLRTILVVPEKFSMEKQVLMQALGAEIVHTPSEEGIKGAIRKAEALAATISNSYVPMQFKNPANPAAYYHTLAPEILADMPAPITAFVAGAGSGGTFAGVAAYLQAQDSATKAVVVEPEGSILNGGPAHAHRTEGIGVEFIPPFFDQVRIDQTLTIADNDAFAQVRHLARDHGLLIGSSSGAALAASLQLATNLPANSHIVTIFPDSSERYLSQKIYTK

SEQ ID NO: 17067 - protein, 320 aa, Buchnera aphidicola
MIKKIGVLTSGGDAPGMNAAIRGVVRTALSERLEVFGIYDGYLGLYENRMVQLDRYSVSDMINRGGTFLGSARFASFYQDKIRSIAVQNIKKRKIDALVVIGGDGSYIGAQKLTEMGIPCISIPGTIDNDVSGTDYTIGYFTALQTVVEAIDRLRDTSSSHQRISIVEVMGRHCGDLTLAAAIAGGCEFIVLPEIDYKKEDLVIEIQAGIAKGKKHAIVAITEYICDVEELAQYIEKKTNRETRATILGHIQRGGAPVVYDRILASRMGAYSVELLIKGYQGKCVGIQNEKMVFNDIKNALKNMKRTFKKDWLITAKKLY

SEQ ID NO: 17068 - protein, 213 aa, Oryza sativa
MAATTTSSSSSGGGNRIWTSSLAVLALAVALVSLLSLRAPPPAAPSMADDLPTSVHDISVKDIKGNDVKLSEYEGKVLLIVNVASKCGLTNSNYKELNVLYEKYKEKGLEILAFPCNQFAGQEPGSNEEIEQTVCTRFKAEFPIFDKIDVNGKEAAPLYKFLKSQKGGFLGDGIKWNFTKFLVGKDGKVVERYAPTTSPLKIENDIQKLLGTS

SEQ ID NO: 17069 - protein, 436 aa, Unknown
  delta proteobacterium MLMS-1
MGNTRKNQDLSPGRQTEDLHQALAQALDVAALALDRAERADTAKSRFMAGFSHEVRNPLNSLLGLIDLLRQTELTPRQQQFMEMIDHTGQHLLGVLNQALSFTSLEQASLELNEMEFDLPALLRGIFSPYQLQWQQRGISGQLQLDPELPALWHGDPHRLRQVLVNLLDNAGKFTQQGRITLAANMEQRNGRPFVHCRVEDTGVGIPAAKAEKIFTPFAQADGSISSRFGGTGLGLTICRQLIELMGGEIWVTGGDRSGSSFHFVLPRHPDPEPKQVPPPDAPGQTKAPVLSITGLKVLVVDDDFVGRTVTGEMLKEEGCRATLAASGEEALARLAADRFDLVLLDMQMPEMDGPATATAIRRHQRQPVVRRDEPPQPVPFLPLIAMTGESAEELGDSLAAFDGYLQKPFNRRRLLEEINSVRQARPPAAATEGKA

SEQ ID NO: 17070 - protein, 402 aa, Propionibacterium acnes
MIATMDRSVVGAIHGRMGTTRHRSGVVMSKKKKVGILTAGGDCPGLNAAIRGFGKAAIRQHDMELIGIQDGFLGLAGNRTISLDPRALSGILTVGGTILGTSRDKVNHMIIDGEERDMVPTIVENYEKLGLDALVTLGGGGTAKNAYKLAKAGLNVLHLPKTIDNDIVGTDDSFGFSTALEIATEAIDRLHSTAHSHHRIILAEIMGHRAGWLALGSGIAGGADVILLPEVPYKLDSIVQAVENRQKQGLNFSVIAVAEGARDEADSAAMAGAQALVDASKTSETKAAAKKAKKDLEHSMRDNTLKLATQLEEATGLESRVSILGYVQRGGIPCAHDRLLATRLGTVGAKLVDDGEFGIMVAAQGGDATTVPLKDVAGKVKYVPADHPWVKAARQVGTGLGD

SEQ ID NO: 17071 - protein, 410 aa, Leuconostoc mesenteroides
MSYQELDPIVWSAIQQESARQNRTIELIASENFTSQAVRAAQGSVLTNKYAEGYPYKRYYGGTEYVDVVEQVAIDRLKELFGAEYANVQPHSGSQANAAAYMAFLKPGDKILGMSLDAGGHLTHGAKVSFSGKVYESHTYGLNSETETLDYEAIAKQAREVKPQMIVAGASAYSRIIEFDKFRAIADEVGAYLMVDMAHIAGLVAAGLHPNPVGIADVVTSTTHKTLRGPRGGVILSQEKYAKQLNSAIFPGSQGGPLEHIIAGKAIAFGEALQPKFKDYAQQVIKNAQAMAKVFNDTEDIRVVAGGTDNHLFNLDLTKTALNGKQTQELLDTVSITTNKEALPNEQLSPFVTSGIRIGTAAITTRGFDEDDATNVAELIVTAIHHYDDEKVLKQVKREAEALAMTHLFE

SEQ ID NO: 17072 - protein, 559 aa, Pseudomonas aeruginosa
MSESFAELFEESLKSLDMQPGAIITGIVVDIDGDWVTVHAGLKSEGVIPVEQFYNEQGELTIKVGDEVHVALDAVEDGFGETKLSREKAKRAESWIVLEAAFAADEVVKGVINGKVKGGFTVDVNGIRAFLPGSLVDVRPVRDTTHLEGKELEFKVIKLDQKRNNVVVSRRSVLEAENSAEREALLESLQEGQQVKGIVKNLTDYGAFVDLGGVDGLLHITDMAWKRIKHPSEIVNVGDEIDVKVLKFDRERNRVSLGLKQLGEDPWVAIKARYPEGTRVMARVTNLTDYGCFAELEEGVEGLVHVSEMDWTNKNIHPSKVVQVGDEVEVQVLDIDEERRRISLGIKQCKSNPWEDFSSQFNKGDRISGTIKSITDFGIFIGLDGGIDGLVHLSDISWNEVGEEAVRRFKKGDELETVILSVDPERERISLGIKQLEDDPFSNYASLHEKGSIVRGTVKEVDAKGAVISLGDDIEGILKASEISRDRVEDARNVLKEGEEVEAKIISIDRKSRVISLSVKSKDVDDEKDAMKELRKQEVESAGPTTIGDLIRAQMENQG

SEQ ID NO: 17073 - protein, 385 aa, Populus nigra
MAIDCIKTMPSITTPHHHPKDQDQCKDDGKSFVFDAQVLRHQTNIPQQFIWPDHEKPNINAPELQVPLVDLGDFLSGNPVAAVEASRLVGEACQKHGFFLVVNHGVDKTLIAHAHNYMDTFFELPLSEKQKAQRKIGESCGYASSFTGRFSSKLPWKETLSFRYTAEKNSSKHIEEYFHNRMGEDFAEFGRVYQDYCEAMSTLSLGIMELLGMSLGVSREHFREFFNENDSIMRLNYYPPCQKPDLTLGTGPHCDPTSLTILHQDQVGGLQVFVDNEWRSISPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQQSFS

SEQ ID NO: 17074 - protein, 558 aa, Buchnera aphidicola
MNESFAQLFEESLKEIKTRPGSIIRGTIVSIEKDMVLVDAGLKSESAIPVEQFQNSQGLLDIQVGDQIDVALDAIEDGFGETLLSREKAKRHEAWLILEKAHEKSETVIGIINGKVKGGFTVELNDIRAFLPGSLVDVRPVRDTIHLEGKELEFKVIKLDQKRNNVVVSRRAVIESENSAERDQLLENLQEGMHVKGIVKNLTDYGAFVDLGGVDGLLHITDMAWKRVKHPSEIVNVGDEINIKILKFDRERTRVSLGLKQLGEDPWIAISKRYPEETKLSGRVTNLTDYGCFVEIEEGVEGLVHVSEMDWTNKNIHPSKVVTVNDVVEVMVLDIDEERRRISLGLKQCKINPWKEFSETHKKGVHVLGKIKSITDFGIFIGLNGGIDGLVHLSDISWTIPGEEAVVKYKKNDEISAVVLQVDAERERISLGIKQLEEDPFNTYIANHKKGAIITGIIKSLDKKNIIVKLPENLEGVIKLTEITRVYSETMINKLKIEDKILVKLSSFDRKNRIIYLTIHMIDEDEKKDLTAPSNNKTNDDSFSNVMTEAFKAAKNTE

SEQ ID NO: 17075 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPRYYDGRYWTMWKLPLFGCTDSAQVLKEVEECKKEYPNAFIRIIGFDNTRQVQCISFIAYKPPSFTG

SEQ ID NO: 17076 - protein, 331 aa, Magnaporthe grisea
MEPASRRHFFKHGGQDPSIGLNSAEIQECHWCQLRSFANHEKYPISIINTTKDGASLPPDFRFISERILGEGVSRAEASFLSGCECTSNEDCMYGGCECLSDLPDSGLESDGDADFRRSRNNRIKKFAYYSSGERAGLLRESYLDTRTAIYECHEQCSCGPDCPNRVVERGRTLPLQIFRTDDGRGWGVRATVDIKCGQFVDTYIGEVITDSEAVERRKATRKKDLYLFDLDKFWEVIQDDQSRLVIDGEYRSGPSRFFNHSCDPNMRIFARVGAHAELNLHDLAFFAIRDISNGEELTFDYVDGQVLPDGESLDDECLCKSTNCRGVLWS

SEQ ID NO: 17077 - protein, 486 aa, Ralstonia eutropha
MTEDILVNITPQETRVAIVQQAAVQELHVERTLTRGLVGNIYLGKVVRVLPGMQSAFIDIGLERAAFLHVADIWHPRDPDKNGTQLAIEKTLFEGQALMVQVIKDPIGTKGARLSTQVSIAGRTLVYLPQDPHIGISQRIEGEVDREALRSRVQGLVPADERGGFIVRTIAEEASDEELGNDIAYLRKIWATIRQNATTQPAPSLLYQDLDLAQRVLRDFINDATGVIQIDSRENYQRLVEFAQEYTPAVLARLSHYTGERPIFDLFNIDAEIEKALSRRVDLKSGGYLMIDQTEAMTTIDVNTGGYVGARNFDDTIFKTNLEAAHTIARQLRLRNLGGIIIIDFIDMENVEHREAVLSELKRALSRDRTRITVNNFSQLGLVEMTRKRTRESLAHVLCEQCPVCQGKGQVKTPRTVCYDILREIMRESRQFNPREFRILASQEVIDLFLEEESQHLAMLGDFIGKPISLQVESTFHQEQYDIILM

SEQ ID NO: 17078 - protein, 381 aa, Arabidopsis thaliana
MSHSAVSQAGAVSVSIENQRSLRRSVFKNNSISFNSKSWSSSLALNQKTTSIRDGKRYPSTTICMSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKIEEYSDEIFKLLDNGAHIYFCGLKGMMPGIQDTLKRVAEERGESWDLKLSQLRKNKQWHVEVY

SEQ ID NO: 17079 - protein, 521 aa, Hebeloma cylindrosporum
MSPPKSSRGAPKFKWSHLWEPAIVNPVNLKSYTIPIFNLGDPYARAFHLSWLGFFVAFLSWFAFPPLIPDAIKSDLHLSAAQVANSNIIALCATFVVRVGVGPLVDQYGPRKVMAYLLILGAIPSGLAGTARSAEGLYVLRFFIGILGATFVPCQAWTSAFFDKNCVGTANALVGGWGNMGGGATFAIMTSLFQSLTQTYGLSTHVAWRAAFAIVPAPILLFVAVLTFIFGQDHPAGKWSERHTLPVAALAVQQGHQIPNIQPEKSLKSSSESSKDEKDPEGNAAVTVRPAIADEDLALVKSTVDVAINEPLTLKTTVKILTNPLTWLPALAYLTTFGVELAIDSKFADVLFVLFSKRRPGFDQTTAGYYTSILGLLNLVTRPAGGYFGDLVYRHYGTNGKKAWTLLCGLIMGAALVAGGFYMQNNRTSGDEQLSVLMGVFSVAAIFSEFGNGANFALVPHCNAYNNGVMSGLVGSFGNLGGIIFALVFRFQTEVGKAFWIMGVISIGINALLIPVSVPAL

SEQ ID NO: 17080 - protein, 281 aa, Medicago sativa
IRHEKRSNAVLHKIITSAIPDTVGGKLIGLVTSREAIPDLLKLDDVIDLVVPRGSNKLVSQIKDSTKIPVLGHADGICHIYIDKAANINVAKKIVKDAKTDYPAACNAMETLLVHKDLAGKWWDLNETCCWNSKEGVQLYGGPKASVLLKISEAKSFHLEYSSLACTIEIVDDVYAAIDHIHDHGSSHTDCIVTEDSKVAETFLRQVDSAAVFHNASTRFCDGARFGLGAEVGISTSRIHARGPVGVEGLLTNRWVLRGNGQVVDGDRSMIYTHKELPIKA

SEQ ID NO: 17081 - protein, 211 aa, Brassica napus
  misc_feature (197)..(197): Xaa can be any naturally occurring amino acid
MAAPEAPVKYVGILKESAAFRLMKSMGWEEGEGLGKDKQGIKGYVRVKNKQDTTGVGVDKPNPWAFDTTQFDNILKKLKVQAAPSKKDDASDKEAESEDEGGKSDEPVKSNVAKVTRPQGRYKRREKGKLVNSYSSKDLEGILVKRTEEPSPAVCDIADAMGIEIISEDQHPDVKEQKIEEPSSDWWGFKSGLVSGXLLELAWQKNHPVNE

SEQ ID NO: 17082 - protein, 212 aa, Erwinia carotovora
MNSIDKTQRITQSDALPGRSTPMPVARLHVVHEHSMTHVPDHMSVAIFAMGCFWGAERLFWQQPGIYSTAAGYIGGYTPNPTYREVCSGQTDHAEAVRVVFDPATISYSQLLQLFWENHDPAQGMRQGGDIGSQYRSAIYTLTPEQEQAAQASLQRFQQAMRENSDGRAISTEIEPAGPFYYAEEDHQQYLHKNPNGYCGLGGIGVCLPPPR

SEQ ID NO: 17083 - protein, 347 aa, Solanum tuberosum
MADECAAFVKGTELPVKRPREEEAETEMEAANNSNNNNGCSTNEKEEPSPYISSVLPGWFSEISPLWPGEAHSLKVEKILFQGKSDYQNVLVFQSSTYGKVLVLDGVIQLTERDECAYQEMITHLPLCSIPNPKKVLVIGGGDGGVLREVSRHSSVEQIDICEIDKMVVEVAKQFFPDVAVGYEDPRVNLRIGDGVAFLKNVPAGTYDAVIVDSSDPIGPAQELFEKPFFESIAKALRPGGVVATQAESIWLHMHIIEEIVANCRQIFKGSVNYAWTTVPTYPSGMIGFMLCSTEGPAVDFKNPINPIDDESPVKTIEPLKFYNSEIHQASFCLPSFAKRVIETKGK

SEQ ID NO: 17084 - protein, 245 aa, Pseudomonas putida
MSQVNMRDMLKAGVHFGHQTRYWNPKMGKYIFGARNKIHIINLEKTLPMFNDALAFVERLAQGKNKIMFVGTKRSAGKIVAEQAARAGSPYVDHRWLGGMLTNYKTIRASIKRLRDLETQAEDGTFAKLTKKEALMRSRDLEKLDRSLGGIKDMGGLPDALFVIDVDHERIAITEANKLGIPVIGVVDTNSSPEGVDYIIPGNDDAIRAIELYMTSMADAIIRGRNNVAGGTEVYVEEAAAPAAE

SEQ ID NO: 17085 - protein, 263 aa, Glycine max
  misc_feature (39)..(39): Xaa can be any naturally occurring amino acid
  misc_feature (63)..(63): Xaa can be any naturally occurring amino acid
  misc_feature (141)..(141): Xaa can be any naturally occurring amino acid
LLHAPAPTHVRSGHPLKKVQLRAGGGRRIVAAQKDRVRXDGFVNSVQKLQRREISSQRDRSFXMSDAQERFRNIRLQEEYHTHDPKGPSSMMLPLLRKGPKSIEIVAARDIVSALAQSGACAGFIRETMQRICFLNGTPEXKVIRSPFYNKKTRAPFIKVIRICVTTAEALWKPLKAPRDGNLCRQGYPQNAWVIGPFWESPRSSGKWRRASERGLRSKQKGEGELTPILTPGQPPRQGIWTREKPIRMAGTSISGKRKGSKD

SEQ ID NO: 17086 - protein, 339 aa, Lactobacillus acidophilus
MTKIAVLGNGSWGSVLGSMLADNGNDVVLYGNIESVNDEINATHTNSHYMKDWKLNENTRATGDLEDALDGAEVVLFVLPTKAVRIVAKNVREILDKSGAKPLLVTATKGIEPGTKKLISEILTDEIYPNDEDKIVAISGPSHAENVAQKDLTAIACASTNEENAKKVQKLFSNDYVRFYTNDDLVGVEVGGAVKNVIAIAAGILVGQGYGDDAKAALMTRGLAEITRLGVNYFGAKPMTFSGLSGIGDLIVTCTSVNSRNWRAGKQIGEGKSLDYVLKNMGQVVEGATTVKAVHELCEEKNIDMPISEAIYRVLYEGTDVETEIKKMMGRAPKPEIRL

SEQ ID NO: 17087 - protein, 308 aa, Lactobacillus acidophilus
MADKYDVIVIGAGPGGMTAALYATRANLNVLVLDRGPYGGQMNNTDAIDNYPGFTEVKGPELSQKMYDTLMKFEPDYKYGNVQSVELDGDEKVIKTDDEEYRAPVLIIATGADHRHLNVPGEEEYSGRGVSYCAVCDAAFFKDEDVVVVGGGDSAIEEGIYLSQMAKSVTVIHRRDQLRAQPTLQKRAFANEKMKFIWNAQTEEILGDGNRVTGVKYLDKENGETKEVSAAGVFIYVGVLPQTEPFKKLGILNEQGWIPTNEHMETKVSGIFALGDVRDKDLRQIANAVGEGSVAGQAAYNYFQDLKN

SEQ ID NO: 17088 - protein, 208 aa, Fusobacterium nucleatum
MYYNFNQYINLGATLEKNGCNFAIYIKEVKTLSLNIFYSSEDIVPYEKYTLDSSEHRVGDIWSIFLENIKEGTLYNWEINGVPILDPYALAYTGNETIENRKSIVLARVGTETRHILIPKKDMVIYESHIGLFTKSPSSNTLNRATYSAFEEKIPYLTELGINVVEFLPIFEWDDYTGNLDRESFFLKNVWGYNPINFFALQKIFFFK

SEQ ID NO: 17089 - protein, 504 aa, Glycine max
  misc_feature (381)..(381): Xaa can be any naturally occurring amino acid
MEQPPSSSLQVETAQQPGPSPLRKMFAVSSIAAGIQFGWALQLSLLTPYVQTLGVPHAWASFIWLCGPISGLLVQPIVGYSSDRCRSRFGRRRPFIFVGAIAVAIAVFLIGYAADIGHAAGDDLTKKTRPRAVVVFVVGFWILDVANNMLQGPCRAFLGDLAAGDHRKTRTANAFFSFFMAIGNVLGYAAGSYDKLHRAFKFTQTEACDVFCANLKSCFFFSIVLLLVLCFVVLICVDDPQFTPRGDDNNGENDGVSGSCFGELWAAFKGLKRPMWLLMVVTAINWVAWFPYMLFDTDWMGREVYGGKVGEKAYDSGVHKGALGLMLNSVVLALMSLTVEPLGRFVGGVKWLWGIVNVILAVCMAMTVVITRAAEHERKKXVSAVGHPSVGVQVAALTFFSVLGVPLAITFSVPFALASIYSSTSGAGQGLSLGVLNVAIVVPQMIVSAISGQWDKWFGGGNLPAFVLGAVAAAVSAVLAVVLLPTPKPADVAKVTSVTAGSFH

SEQ ID NO: 17090 - protein, 412 aa, Fusobacterium nucleatum
MPYKKYSSSNDKNSADEIKEFKKLISSLHKNGIEVILDVVYNHTAEGGSGGKVYNFKAMDENTFYIKNKNNIFVNFSGCGNTLNCNHKVVKDMIIQSLLYWYLETGVDGFRFDLASVLGRDSNGQWAKHSLLHELIEHPILSHAKLIAESWDLGGYFVGAMPSGWSEWNGAYRDTVRQFIRGDFNQVPELIKRIFGTVDIFHANKNGYQSSINFICCHDGFTMWDLVSYNLKHNLLNGENNQDGENNNHSYNHGEEGLTENPQILSLRKQQIKNMLLILYISQGIPMLLMGDEMGRTQLGNNNAYCQDNPTTWVDWDRKKDFEDVFLFTKNMINLRKSYSVFKKETPLIEGEEVILHGIKLYQPDLSYHSLSIAFQLKDIETDTDFYIAFNSYSEQLCLELPILENSLVSSN

SEQ ID NO: 17091 - protein, 381 aa, Lactobacillus acidophilus
MSTEMLGLILAGGKGTRLGKLTSDQAKPAVPFGGRYRIIDFTLSNCANSGVKNIGIITQYQPLLLNEHIGNGVSWGLDGLNASATILQPYTDNSGSKWFEGTAHAIYQNIDYIDSKDPEYVLILSGDHIYKMDYESMLEEHIKNGASLTVAVIDVPMKEASRFGIMNTDVSGRITEFEEKPEHPKSNHASMGIYIFNWKRLREVLTTGFTTNDDMVDFGKNVIPYYLKSDERVFAYHFSGYWKDVGTIDSLWAANMEFLDGSDGLNLYDRSWRIYSKNPIDPAQVITENAEVNNSMIVDGCYVDGTINHSILSTDVDVQRGSEITDSVIMPGVKIGKDVVIKHAIVGENAQIGDGAVVEGNKDNIKVIGNSERIGVLPNED

SEQ ID NO: 17092 - protein, 180 aa, Agrobacterium tumefaciens
MPVVRGKNIEPLYTAEQIAERNRDMAKHIAGGPTKDLLVIAVLKGSFIFAADLIRALHDSGLAPEVEFITLSSYGAGTVSQGVRIVKDIDSDVKDRDVLLIDDILESGRTLRFAKELLYERGARNVTIAVLLDKKVKRKEDLEADYVGFECPDYFVVGYGMDVAYAFRELPFVGVVTGDA

SEQ ID NO: 17093 - protein, 346 aa, Rhizobium leguminosarum
MTKYKLEYIWLDGYTPVPNLRGKTQIKEFDVFPTLEQLPLWGFDGSSTQQAEGRSSDCVLKPVAIYPDPARTNGALVMCEVMMPDGVTPHASNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTDWNGSGMHCNFSTKYMREVGGKAYFEALMAQFDKNLMDHIDVYGPDNDKRLTGKHETAPWNKFSYGVADRGASIRVPHSFVKNDYKGYLEDRRPNSQGCPYQIASQVLKTISEVPTASSASAAA

SEQ ID NO: 17094 - protein, 118 aa, Fusarium cerealis
TARRSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKD

SEQ ID NO: 17095 - protein, 594 aa, Unknown
  Synechococcus sp. WH 7805
MITLPIAEGLTCFRGLSPKRSRFELEYALERGSTANSFLFAAGPDTAEVTQPAVLVHPPGAAYASVFLPVLQQTLPDPASKLVVVVGHVNPNRVALLRDLVSAYSGLELVASNAGAKLLRELWSLRRPQAPGDESPQPPLPDLPEIKVIRQEQTLPVSHGHQLHVLPTPTPRWPGGLLAFEETLGLLMSDKLFSAHICTSEWAELNRSETEEERRHFYDCLMAPMASQVDALVERLEELDIRTVAPGHGPAIDTSWRSLFNDYRRWGESQQQASLSVALLFASAYGNTAAIADALAQGVSRTGVRVTSLNCEFTPADELVRTIQTADGLLIGSPTLGGHAPTPIVSALGTLLAEGDRSKPVGVFGSFGWSGEAIDLLETKLKDGGFRFAFEPIRIKFSPDAATVRTLEETGTRFGRSLRQEQRKQQRRGGGGLRESRSDPAVLALGRVVGSLCVLTTRKGSLSGAMVASWVSQASFAPPGITVAVAKDRAVEALLHKGDRFALNVLAEGRESGPMKQFLQPFEPGADRFNGLDLQSSPSEQPLLPEALAWMEGEVKQRMECGDHWLVYAEVLHGGLFDSEANTAVHHRRSGANY

SEQ ID NO: 17096 - protein, 140 aa, Picea glauca
VEDGSGGETDFQEVDHHAVEDRELKDHLLRRYSGYLSSLKQEFMKKKKKGKLPKDARQKLLGWWSLHDKWPYPSETEKIALAECTGLDQKQINNWFINQRKRHWKPSEDMHFMVMNSHSPHSAALYVERHLMTEGYHLDC

SEQ ID NO: 17097 - protein, 584 aa, Unknown
  Synechococcus sp. WH 7805
MAASTQAVAGRLSLQCQTIASDCTAIRSLDWDRSRFDIEFGLRNGTTYNAFLVRGERTALIDTSHAKFRETWLPLLQEQIDPQAIDHLIVSHTEPDHSGLIGDLLDLNPEIEIVGSKVALQFLKDQVHRPFRSRAVKSGDSLDLGTNPESGVEHRFEFLSAPNLHWPDTIFSFDHGSGILYTCDAFGLHYCSEELFDSDPGAIAPDFRFYYECLMGPNARSVLQAMKRMDGLPTINTIAVGHGPLLRQHLSHWLNDYREWSSQRSKGDSYAAVCYVSQYGFSDRLSQAIAHGIGKADAQVQLVDLRATDAQELTALVGEAKAVVVPTWPAEPDAELQSSIGTLLAALHSKQLVGVYDAFGGNDEPIDAVADQLRAQGQKTAFAPLRIRQLPSGADYQRCEEAGTDLGQLLTREKTIAAMKSLDGDLDKALGRLSGGLYVVTASQGEGESLRRSAMVASWVSQASFSPPGITVAVAKDRAIEALMQVGDRFVLNILREDNHQQLMRHFLKRFPPGADRFAGVNLLEHEAQGGPVLSDALAYLGCRVEQRLEGPDHWIIYAEVEQGNVADADATTAVHHRKVGNHY

SEQ ID NO: 17098 - protein, 356 aa, Dehalococcoides ethenogenes
MANKRDYYEVLGIERSASDEDIKKAFRKMAMKHHPDRNHEDGAAEKFKEINEAYEVLSNPEKRAAYDRFGFSAGSDAFGQGGFENFDFGGLGSIFETFFGGATQSAKRGPRRGPDMSYDIRITLEEAATGVEKEITTERLEYCSECSGTGAKAGTSLVKCTNCNGTGQVYQVQKSVFGRFTSVTPCPKCRGEGTIIGEPCAKCRGTGKEYVKRTVQVKIPAGVADGNQIRLNGYGGVGDKGASAGDVYINVSIASHADFKRDGDDVIYELEINFAQAALGTEVNVPGLSTSHKLKIPSGSQNGKYFVLKGKGIPHLNRFGSGDEMVHLNVVTPEKLSRKQKQLFEELEKSFAEDKK

SEQ ID NO: 17099 - protein, 466 aa, Escherichia coli
MGQSSQPHELGGGLKSRHVTMLSIAGVIGASLFVGSSVAIAEAGPAVLLAYLFAGLLVVMIMRMLAEMAVARPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIGKILRAEGSEIRLRMWLYPWLTWLVIGFITFVLVVMLFRPAQQLEVISTGLLAIGIICTVPIMARWKKLVLWQKTPVHNTR

SEQ ID NO: 17100 - protein, 389 aa, Mesorhizobium loti
MADTTTRPGVEQVAAVEPAIVIGAGAAGLAVAQALIKAGVPVAILEKESRLAEPWHRRHQQLHLNTHRDLSALPGLSYPGGTPAFPPKSVVIRHMNDFREANQLPVEFGVAVETLVFRGDHWAVRTSAGSRLARHVVVATGRDKEPFTPQWQGMQAFTGRIIHSADFGDAQSYAGKKVLVVGAGNSGFDALNHLAGVDTASLWLSARNGPALLPKRIGKIAVHRLSPLMARLPLRVADAVMAATQRLVFGDLTKFGMPPAPSGGASRLTSDYTAIAADDGAVDAIKSGKITVVPAIREFTRDGVILANGSLVDPDIVIAATGYRTGLERMVGNLGVLDGKGVPLFNGGQADPKLPGLWFTGMRPSIRGCFANAAILGKAIARRIAGAGR

SEQ ID NO: 17101 - protein, 359 aa, Dehalococcoides ethenogenes
MSKVCIIGTTTWGITLGTVIAHKGREVMLWARTEDEAALLSAQRRPADFLPEDYYFPEYLNVTASLEEALSGADMVLMAVPSQRMRPNIRLAAPLLTKNMLVCSASKGLEIGTAKRMSQVIADEISPDFSQNICVLSGPNLAMEILKGLPAVTVLAADTEKTAKKAAKLVTASNFCAYTNTDIIGVELGGSLKNIIALGAGIADGLSFGNNAKSALITRGLTEISALGAALGANPLTFSGLAGLGDLIATCSSNLSRNHFVGVELTKGRSLNDIMYSMSNVAEGVSTTAVAYELARSMDLEMPVTENIYNVLYNNADPKEAARKLMAAQAAHELAGRKWDLFKMFRRRRTRKTPELNPD

SEQ ID NO: 17102 - protein, 149 aa, Triticum aestivum
MLRSFPQARRLLKRLGFEKGDAYFFKQMGKGMLCTYALFGAAWFWNETSPLGWWTLKPRPKEEKEMAHLYERREFPYPGDEEAVEEFIKSGGALGTTIGPKGFADANMDSDNMQKQLQSKKFDQEARKLWFRMRNEVVQELQEKGFDVE

SEQ ID NO: 17103 - protein, 319 aa, Buchnera aphidicola
MDKVKHSKIIILGSGPAGYTAAIYAARANLDPFLITGTNKGGQLMNTNEIENWPGDYNKISGSELMNRMYKHAIELKTKVICDTVISVNFKKNPFFLIGENNKYTADSVIIATGANPRYLGLQSESLFKGKGVSTCAVCDGFFYKNKEVAVVGGGNTAIEETLYLSNFVKKVHLIHRGINFRAEKILLDRLEKKIKSQKIIIYLNSIVKNILGNSSGVTALLIEQKNSKEKTESKIQVSGLFVAIGYTPNTNIFVNKLKMKDGYIQVTRQEHGNYTQTSIPGIFAAGDVIDHVYRQAITSSASGCMAALDSERYINSLV

SEQ ID NO: 17104 - protein, 970 aa, Mesorhizobium loti
MNIKADFPSLVEEIDYGTPESRAQKQVTLNVDGRSITVPEGTSIMRAAMEGGVEIPKLCATDMLDSFGSCRVCLVEIEGRGGTPASCTTPVGEGMVVRTQSDRLDAIRRGVMELYVSDHPTGWNEKAGTGASEFDTVAKSVGLTENRYGVEGRNHVKQEDGVAPGHGSLAVDYIARDESNPYFTYDPAQCIVCSRCVRACEEVQGTFALTIEGRGFESRMVAGMHEDFIASECVSCGACVQACPTDALREKTVLEKGMPERSAVTTCAYCGVGCSFKAEVKDDEVIRMMPYKDGKANHGHSCVKGRFAYGYATHKDRILSPMIREKISDPWREVSWEEAIAHTAKEFRRIQYQYGRTSIGGITSSRCTNEETYLVQKLVRQGFRNNNVDTCARVCHSPTGYGLGQTYGTSAGTQDFDSVEFTDVAVVIGANPVSAHPVFASRLKKRLRQGAKLIVLDPRRTEMVKSAHIEADYHLPLKPGTNVAVLTSLAHVIVTEGLFDEAFIRERCDWTEFQDWASFVALPENSPETVGKLSGVDPDLIRGAARLYAKGGNGAIYYGLGVTEHSQGSTTVMAIANLAMATGNIGRPGVGVNPLRGQNNVQGSCDMGSFPHELPGYRHISGEAVRDIYESLWGVKLDDEPGLRIPNMLDAAVDGSFKGIYIQGEDILQSDPDTKHVAGGLAAMECVVVHDLFLNETANYAHVFLPGSTFLEKDGTFTNAERRINMVRKVLEPKARYADWEATQELARAIGLDWNYTHPSQIMDEIAQTTPSFANVSFELLDRVGSVQWPCNEKAPLGTPIMHIDGFVRGKGKFIRTEYVATDERTGPRFPLLLTTGRILSQYNVGAQTRRTDNVMWHSEDRLEIHPHDAENRGLRDGDWVRLTSRSGETTLRALITDRVSPGVVYTTFHHPDTQANVITTDFSDWATNCPEYKVTAVQVGASNGPSDWQREYDEQARNSRRIASLQAAE

SEQ ID NO: 17105 - protein, 72 aa, Buchnera aphidicola
MSKEENIEMQGVVIDTLPNTMFRVELENKHIVTAHISGKMRKNYIRILTGDKVTVELTPYDLTKGRIIFRSR

SEQ ID NO: 17106 - protein, 162 aa, Triticum aestivum
  misc_feature (10)..(10): Xaa can be any naturally occurring amino acid
VPASRKNFSXYLGAGYSCAVVPGGLREMRYMDHESDSEVAFIRSRKGFVRIAIQTGCPLVPVFCFGQDRVYNWWRPGSNLLVKIAGLLKAPAIVFWGKFGTFIPFRLPMHVFVGRPIEVTKNNQPTMDEINEVHEKFVMALQELFNKHKYKVGCPNLQLQVI

SEQ ID NO: 17107 - protein, 189 aa, Unknown
  Rosa hybrid cultivar
AWHSAGTYDVKTKTGGPFGTMKQPAELAHGANNGLDIAVRLLEPIKEQFPILSYADFYQLAGVVAVEVTGGPDVPFHPGREDKPAPPPEGRLPDAGKGSDHLRDVFGKTMGLSDQDIVALSGGHTLGRAHKERSGFEGPWTPNPLIFDNSYFTELLSGEKEGLLQLPTDKALLSDPVFRPLVEKYAADE

SEQ ID NO: 17108 - protein, 548 aa, Pseudomonas putida
MQSAYTVLILLTLVSLSKLVGRMIPLPLPLVQIAAGALLALPTLGLHVALDPELFLFLFLPPLLFADGWRIPKRELWRIRGPVVALAVGLVLFTVVGAGYFIHWLLPSIPLPVAFALAAVLSPTDAVAVSAIAQDRLPTPLMHMLQGEALMNDASGLVTFKFALAAAITGVFSLTDASFSFVLVALGGLAVGVGLSWLVGRLRAWMIARGWDDPATHVVFMLLLPFAAYVLAERLGVSGILSAVAAGMMQSWLDLLPRQTSTRLLNRSVWSLLEFAFNGLIFLLLGLQLPDIIKAVVSHEPTVWPTLAYRCLDVVAIFAALILLRYIWVQSIWRSIGVVRRWRGKPALVLMPTARSCWLLTLGGVRGAVTLAGVMSVPLLMGAGKAFPERDLLIFIAAGVILLSLISACIALPLLLRGVTKSPDERLRQEVQEAWRRTAEAAIHALEAEEVIDSNAPQDAAQATLATELKARLMAEYRDELDSYNDSAEAKALAEQMDLLERHLRLRALRAQRLELYNLHRQHLVGDEVVRQVLGELDMSEANLGQVR

SEQ ID NO: 17109 - protein, 448 aa, Dechloromonas aromatica
MGDITKKPGRLRPAPENFLSEDQVKAVGAGRRDFLRKSFLAAGAAMAAPLAVRASEGDPNILNLPAWSTSLGMPVATNPYGMPSKFESQLVRRESPGLARVGGASVSFAPLQGLFGIITPSGLHFERHHQGWQDVDPTKHRLMINGSDDSLLKKPKVYTMDELMRLPSVSRIHFIECGANTGLEWGNVAVPTVQYTHGMLSCSEFTGVPLKLLLEDCGVDYKKARYVLAEGADGSSMTRTIPMEMVESGEVIVAYGQNGEMLRPENGYPLRLVVPGVQGVSWVKWLRRIEVGDMPYATKDEAVHYIDLLPSGLHRQYSSIQEAKSVITTPSGGQTLVEKGFFNVSGLAWSGRGRIKQVDVSFDGGLNWQTARLEGPVQNKALTRFNINWVWDGSPAILQSRATDETGYVQPSYGQLRKVRGTKSIYHNNAIQSWKVVESGEVTNVQVL

SEQ ID NO: 17110 - protein, 555 aa, Erwinia carotovora
MSENYTVGDYLLDRLTQIGIQHLFGVPGDYNLHFLDHVIRNPDITWVGCANELNAAYAADGYARCRPAAALLTTFGVGELSAINGIAGSYAECLPVIHIAAAPCLASQRNGELLHHTLGDGDFSHFSRMAAEVTVAQASLTVENATAEIDRVIGEALAQHKPVYLFLPVDVAAAPVGARPYPLVIPEPLHSDDSLRAFTTAATDMLSKAKSVSLLADFLAQRFSLAGKIQRWLDKTPLPHATLLMGKGTLNEQHRSFTGTYSGSGSHESIRAHIEDADAIISIGVRYTDTITTGFSHQIPIEKNIDIQPTLARVGNQVFPSVPMSDAIAVLEKITEKFASRWDHCTITPPVLPQSEHRSALSQREFWQQIQRFLRPDDILVTDQGTSCFGAATLRLPAGCHFIVQPLWGSIGYSLPAAFGAQIAEPERRVVLLIGDGSLQLTVQELGSIIRDRLNMVIVVLNNEGYTVERAIHGSEQRYNDIAAWNWTQLPTALGANENEILCKQVRSPIALAQVLEQVNAESRLSLIEVVLPRMDIPALLHTITQSLETRNTVQ

SEQ ID NO: 17111 - protein, 645 aa, Chlamydomonas reinhardtii
MLPASLQRKAAAVGGRGPTNQSRVAVRVSAQPKEAPPASTPIVEDPESKFRRYGKHFGGIHKLSMDWLDSVPRVRVRTKDSRQLDDMLELAVLNERLAGRLEPWQARQKLEYLRKRRKNWERIFEYVTRQDAAATLAMIEEANRKVEESLSEEAREKTAVGDLRDQLESLRAQVAQAQERLAMTQSRVEQNLQRVNELKAEATTLERMRKASDLDIKERERIAISTVAAKGPASSSSSAAAVSAPATSATLTVERPAATTVTQEVPSTSYGTPVDRAPRRSKAAIRRSRGLESSMEIEEGLRNFWYPAEFSARLPKDTLVPFELFGEPWVMFRDEKGQPSCIRDECAHRGCPLSLGKVVEGQVMCPYHGWEFNGDGACTKMPSTPFCRNVGVAALPCAEKDGFIWVWPGDGLPAETLPDFAQPPEGFLIHAEIMVDVPVEHGLLIENLLDLAHAPFTHTSTFARGWPVPDFVKFHANKALSGFWDPYPIDMAFQPPCMTLSTIGLAQPGKIMRGVTASQCKNHLHQLHVCMPSKKGHTRLLYRMSLDFLPWMRHVPFIDRIWKQVAAQVLGEDLVLVLGQQDRMLRGGSNWSNPAPYDKLAVRYRRWRNGVNAEVARVRAGEPPSNPVAMSAGEMFSVDEDDMDN

SEQ ID NO: 17112 - protein, 414 aa, Clostridium difficile
MFENLKKADPEIYESMKRELKRQQRNIELIASENIVSVPVMETMGSHLTNKYAEGYSGKRYYGGCEYIDEVETLAIDRIKKIFGAEHANVQPHSGANANIGVYFAMLKPGDVVMGMNLSQGGHLTHGAPVNISGQYYKFYEYGIDKDSGLIDFDEVRKIAHEVKPKMIVAGASAYPREIDFKKFREIADEVGALLMVDMAHIAGLVAAGLHQNPCEVADFVTTTTHKTLRGPRGGVILCKEKYAKDIDKAIFPGIQGGPLEHIIASKAVCFKEALSDEFKEYQVQVAKNAKALAEELIKRDFKLISGGTDNHLILLDLTNKNITGKAAEKRLDDAYITANKNTIPFDPNGALVTSGIRLGTPAVTTRGMKEEDMAIIAEAIDLCLTYDEESKARTLVVGLTEKYPLYEEYNVMD

SEQ ID NO: 17113 - protein, 66 aa, Glycine max
MVRFFRVVSILILVSVTALMVVLPLMLPSLPPPPLVLLFFPVGIMAVLMLLAFVPSEAPMTTNIIV

SEQ ID NO: 17114 - protein, 166 aa, Brassica napus
  misc_feature (148)..(148): Xaa can be any naturally occurring amino acid
MGTPESSREPCPDRILDDIGGAFGMGAVGGSAFHFLKGTYNSPKGSRFLGGKQAVAMNAPRLGGSFAVWGGLFSTFDCSMVYLRQKEDPWNSIIAGAATGGFLSMRQGPNASCEVCAWLGGVLLSLIEGAGIALNKMMAEPQHMQMEXGMAGMPGMPGMQMGQGQQ

SEQ ID NO: 17115 - protein, 487 aa, Shigella flexneri
MKPSTEWWRYLAPLAVIAIIALLPVPAGLENHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASHATLSWGDWFLGMLPLSILLVLLVPWLAYVLYPPVLKSGDQVPRWAETELQAMGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVTLIVVFYLLRYFFASATAYTCALAPMMIAAALAMPEIPLPVFCLMVGAAIGLGSILTPYATGPSPIYYGSGYLPTADYWRLGAIFGLIFLVLLVITGLLWMPVVLL

SEQ ID NO: 17116 - protein, 591 aa, Brassica napus
MPTWWVRKSSKNKDDSHLLQTQTRSVSDKSIRRISADNSKSSPDPVTPSRCTPRCSREFAGASGFSDEKKCHPLPLPSLSNDQVNGSVSGSGSVSSVSSSGSGEDQSQPTAPRKSNAAAASPKAGARPTSPLHNRFSGMTLESSSTGRNDDGRSSEYHPLPLPPGSPTSPSVVLPCSPTSPSSGVQGSWVVGGSEKEISKWKKGRFIGSGTFGKVYQGFNSEEGRICAIKEVKVISDDKNSKECLKQLNQEINVLSQLCHPNIVQYYGSELSEETLSVYLEFVSGGSIYKLLTEYGAFTEPVIQNYTRQILYGLAYLHGRNTVHRDIKGANILVDPNGEIKLADFGMAKHVTAYSTMLSFTGSPYWMAPEVVMHKNGYTLAVDVWSVGCTILEMATAKPPWSQFEGVAAIFKIGNSKDMPEIPDHLSNDAKNFIRLCLQRNPTVRPTAAQLLEHPFLRVHSPRVANTSMHKDVPPRPYDGSSSMPTREPPYSGRHPVFHPIKSPSRENVRAITSLPVSPCSSPLRQLGPAYKSCFLSPPHPSYAFPVQESGYNHQAEFAASPFRFKKDTSLIEPSSYRAQAPSSPFRSRLV

SEQ ID NO: 17117 - protein, 104 aa, Streptococcus pyogenes
MALEVTDATFVEETKEGLVLIDFWATWCGPCRMQTPILEQLSQEIDEDELKILKMDVDENPETARQFGIMSIPTLMFKKDGEVVKQVAGVHTKDQLKAIIAELS

SEQ ID NO: 17118 - protein, 828 aa, Oryza sativa
AVAAVADGMKAWGVMRERAYAFDLVLTEVTMPTLSGIELLSRIVASDECKNIPVIMMSSQDSIGTVLRCMQKGAVDFLVKPVRKNELRNLWQHVWRRHAMNSQTNASENNAASNHLSANGGNGSKTGEHSDEESDAQSSGSKREVEIQSAEKLPEVVADGGAGSSREHKIQNGFIDGMNTKSHALKGNDDAPSGNACGDSELQVLSTEKNVRSKFLNGITSAKVAGQIMDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRKDSLTHPSYGFIPVPIPVGAAIPYHYGAIMQPMYYPQGAFMHCDSAAINKTAIQHVSCQSNYHENLGKPPQIDEHKQPEENHQLHHSRQILRESGEPVDLAKAHMERINQSASCSQDIRKGSGCTGSGETDANTNTVIALESGNESGVQNCSNNVLDGDRSRREAALLKFRMKRKDRCFEKKVRYHSRKKLAEQRPRVKGQFLSSISNGGRRSSGGAGRDAGRVRDRLAVGGVLRRRRGAGREPAVRQRVRDVPDDMHVAAAAASARAAVVVVAVDAVRAAAVLGASAAVPDAAAPAAISGGRERHVPASGGADDDEPAAITAASTVVTTAADDEEQQRVDGVAAVVLVPLLIAAVSAVVVQPVLLLLPLRQRQALRRRRRGERLHGADPSGVAAHRHIPDVTTRTNFSARYDRN

SEQ ID NO: 17119 - protein, 225 aa, Arabidopsis thaliana
  misc_feature (179)..(179): Xaa can be any naturally occurring amino acid
MTTFNYYLAEHPTIVNFRWSPTQSYASTWSFLFTAVSSYIIAAVTLHLLLLITLSLSNRRRGFSLGPIPALHSLTISIISAVIFVGILLSAAAEIRDTRWLWRRTRTTALQWFLCFPVGTRASGRVFFWSYAFYLSRFLHLFRTFFSVIRRRKLSFFQLINQSSLLCISFLWLEYSQSXFRFWTEIGLRGACFPFVGNCQAILLGCMTVCHVGVLCIHLVKRGGC

SEQ ID NO: 17120 - protein, 524 aa, Senecio odorus
GDDDLANNWCFHILVISLLRFNLYMWYTNICNMLFLTRNRRILHQSIDFNQIDKEWNWDNFVILQALIASLAIYMFPQEFANLPVWKTKGLVAIVVIHVVVSEPLYYWLHRLLHTNYLFTPYHSFHHSSAVPQPVTVGSTTFLEELLVTAVLGLPILGCSLSGYGSKSIIYGYVLVFDFLRCLGHSNVEIMPHWIFDYFPFFRFIIYTPTYYSLHHSEMKSNYCLFMPLYDTMWNTLNTKSWGLHKKISLDSGKSTRVPDFVFLAHVVDITSALHVPFVIRSFSAMAYSARLFLLPLWPFTFAVMIVMWARSKTFLLSSYNLRGRLHQTWVVPRFGFQYFLPFACQGINNHIEEAILRADKLGVKVISLAALNKNESLNRGGTLFVKKHPNLKVRVVHGNTLTAAVILNEINEDVKEVFLTGATSKLGRAIALYLCRRGVHVLMLTLSTERFQNIQEEAPSKCRKNLVQVTKYQAAKNCKTWVIGKWITPGQQRWAPSGTHFHQFVVPPILAFRRTAPTETLPL

SEQ ID NO: 17121 - protein, 490 aa, Rhodopirellula baltica
MWWRRSRTNSLRYTVHPFASLQRSMIAPMDWTTIDACRTSTELPRPVEIRGWIRTRRDSKGGFSFLEVNDGTSLGNLQVVAPAELENYAEEIQKLTAGCSVVVQGELVESPAKGQSTELHASSVRVIGWCDGETYPLQKKRHSFEKLREWSHLRARTNTLGAVMRVRNRISQSIHRFFDDEGFNYLHTPIITASDCEGAGEMFRVTTLNLEKLAGSNRPFDTKQDFFQKPTHLTVSGQLEAETYATALSRVYTFGPTFRAENSNTSRHLAEFWMVEPEAAFYDLNDNMQLAERFLKRVFSDCLSHCGEDMDFFNERIEKGKIDQLKSVIEKPFEHMTYTDAVERLLACDEKFEYPVNWGTDLQAEHERYLTSVVGGPVILTDYPSSIKPFYMRVSDDGKTVAAMDVLVPGVGEIIGGSQREERLDVLQRRMAEGGLDESEYWWYVDLRRYGTVPHAGFGLGLERAVQYVTGMANIRDVIPFPRTPGNAEF

SEQ ID NO: 17122 - protein, 234 aa, Brassica napus
MGDTEEVKLLGVWFSPYAIRPKIALRIKSVDYDYFEEDLFGSKSELLLKSNPVHKKVPVLIHNNKPILESLNIVEYIDETWNASGPSILPSHPHDRAQARFWSAFVDDKWFPALKAAAITKSEEAKEKGMKEVEGGLLQLEEAFVSISKGKPFFGGEAIGFMDICLGSFVGILKAREKLKGEKLLDESKIPFLCKWANEFLSDDTVKNVVPEIDKVVEFLGELEVRAQSAVSKT

SEQ ID NO: 17123 - protein, 879 aa, Clostridium thermocellum
MRLVNSLGRRKILLILAVIVAFSTVLLFAKLWGRKTSSTLDEVGSKTHGDLTAENKNGGYLPEEEIPDQPPATGAFNYGEALQKAIFFYECQRSGKLDPSTLRLNWRGDSGLDDGKDAGIDLTGGWYDAGDHVKFNLPMSYSAAMLGWAVYEYEDAFKQSGQYNHILNNIKWACDYFIKCHPEKDVYYYQVGDGHADHAWWGPAEVMPMERPSYKVDRSSPGSTVVAETSAALAIASIIFKKVDGEYSKECLKHAKELFEFADTTKSDDGYTAANGFYNSWSGFYDELSWAAVWLYLATNDSSYLDKAESYSDKWGYEPQTNIPKYKWAQCWDDVTYGTYLLLARIKNDNGKYKEAIERHLDWWTTGYNGERITYTPKGLAWLDQWGSLRYATTTAFLACVYSDWENGDKEKAKTYLEFARSQADYALGSTGRSFVVGFGENPPKRPHHRTAHGSWADSQMEPPEHRHVLYGALVGGPDSTDNYTDDISNYTCNEVACDYNAGFVGLLAKMYKLYGGSPDPKFNGIEEVPEDEIFVEAGVNASGNNFIEIKAIVNNKSGWPARVCENLSFRYFINIEEIVNAGKSASDLQVSSSYNQGAKLSDVKHYKDNIYYVEVDLSGTKIYPGGQSAYKKEVQFRISAPEGTVFNPENDYSYQGLSAGTVVKSEYIPVYDAGVLVFGREPGSASKSTSKDNGLSKATPTVKTESQPTAKHTQNPASDFKTPANQNSVKKDQGIKGEVVLQYANGNAGATSNSINPRFKIINNGTKAINLSDVKIRYYYTKEGGASQNFWCDWSSAGNSNVTGNFFNLSSPKEGADTCLEVGFGSGAGTLDPGGSVEVQIRFSKEDWSNYNQSNDYSFKQACLRQRTLIYLYATWLR

SEQ ID NO: 17124 - protein, 439 aa, Kluyveromyces lactis
MIPSSCVIGRSFGYNLIHQNISSKLRGIFKHYTKSSTANTIKITNTNTISNMSPASDRLKQTSSILSKSVEPQADAPFKVTVVGSGNWGTTIAKVVAENCALRPNLFVNRVDMWVFEENINGEKLTEIINTRHENVKYLPGIKLPSNLVANPDLVDAAKDADILVFNIPHQFLPRICSQLKGNVKPQARAISCLKGFDVGKDGVKLLSTYIKETLNIECGALSGANLAPEVAKENWSETTVAYQIPEDYKGPGKDVDHSLLKALFHRPYFHVNVIEDVAGISVAGALKNVIALGCGYVEGLGWGNNASAAIQRVGLSEMIKFGRTFFPECKVETYFQESAGVADLITTCAGGRNVRVAKHMAITGKSAEEAEKELLNGQSAQGIITTKEVHEWLATCGKTAEFPLFEAIYQITYGNASMEQIPDMIEDFEGIDYNVKKH

SEQ ID NO: 17125 - protein, 631 aa, Oryza sativa
MALVVVPPGQMLLYLLYGPVVGKVVQEWREQGRLPLGTSWCLHLILLLALRSLTYQLWFSYGNMLFFTRRRRVVDDGVDFRQIDTEWDWDNMVIMQTLIAAVLVTSRVFPATSDLSAWDLRGWAIAVVLHVAVSEPAFYWAHRALHLGPLFSRYHSLHHSFQATQALTAGFVTPLESLILTLVAWAPLAGAFMAGHGSVSLVYGHILLFDYLRSMGYSNVEVISHKTFQDFPFLRYLIYTPSYLSLHHREKDSNFCLFMPLFDAPGRDPQPQVLAASEGGKNHRVPDFVFLVHVVDVVSSMHVPFAFRACSSLPFATHLVLLPLWPIAFGFMLLQWFCSKTFTVSFYKLRGFLHQTWSVPRYGFQVTRFIQASRLISIELYFIPSAKKGINEMIELAILRADKMGVKVLSLAALNKNEALNGGGTLFVRKHPDLRVRVVHGNTLTAAVILNEIPGDVAEVFLTGATSKLGRAIALYLCRKKIRVLMLTLSTERFMNIQREAPAEFQQYLVQVTKYQAAQNCKTWIVGKWLSPREQRWAPAGTHFHQFVVPPIIGFRRDCTYGKLAAMRLPEDVEGLGTCEYTMGRGVVHACHAGGVVHFLEGWDHHEVGAIDVDRIDAVWNAALRHGLTPA

SEQ ID NO: 17126 - protein, 479 aa, Pseudomonas putida
MSVQTTTTRNASAHTFKQDMQTRHIVMLALGGVIGTGLFLTSGYTVNQAGPLGAVIAYILGAIMVYLVMMCLGELAVHMPEVGSFSSYATRYLGPGTGYMVAWMYWLTWTVAIGSEFTAAGILMVRWFPDTPVWMWSALFGAAVFISNIISVRSFAETEFWLSLVKVLAVIAFLVVGGGAILGGFEIQQAHSAGLGNFTREGLFPTGFWSIAMTLLAVAFAFSGTELIGIAAGETKDPEKNVPKAIRTTVLRLALFFIGTIFVLATLLPREQAGVIESPFVMVFAMIGIPYAADIMNFVIITALLSAANSGLYAASRMLWTLSDQGNMPRRYATLSRRGTPFNAIVLSMAGGMASLLSSVFAPDTIYLALVSISGLAVVVVWISIAASQIAFRRHYIASGGKLEDLKFRVRGYPFVPLGAIFCCVLACVGIAFDPAQRVALYFGLPFIAWCYLAYWLTCKYRSRRTAPLEIVAPGSEAA

SEQ ID NO: 17127 - protein, 236 aa, Daucus carota
MTKRYWNIDLEEMMKAGVHFGHGTRKWNPKMAPYISAKRKGIHIINLTRTARFLSEACDLVFDAASRGKQFLIVGTKNKAADLVAWAAIRARCHYVNKKWLGGMLTNWSTTETRLHKFRDLRTEQKTGRLRRLPKRDAAVLKRQLSHLQTYLGGIKYMTGLPDIVIIIDQHEEYTALQECITLGIPTISLIDTNCDPDLADISIPANDDAISSIRLILNKLVFAIREGRSSYIRNP

SEQ ID NO: 17128 - protein, 951 aa, Pseudomonas putida
MTINLGTANEFIARHIGPRAVDEQAMLAALGFDSLDAMTAAVIPDSIKGTSVLGSHDGQSEADALAALKAIAGKNQLFKSYIGQGYYNTHTPAPILRNLLENPAWYTAYTPYQPEISQGRLEALLNFQTLISDLTGLPIANASLLDEATAAAEAMTFCKRLSKNKASHTFFASVHCHPQTLDVLRTRAEPLGIEVVVGDERELGDVSAFFGALLQYPASNGEVFDYREVVQRFHAANALVAVAADLLALTLLTPPGEFDADVAIGSAQRFGVPLGFGGPHAAYFATRDAFKRDMPGRLVGVSIDRFGKTALRLAMQTREQHIRREKATSNICTAQVLLANIASMFAVYHGPAGLKRIAERTHALTAILAAGLKALGVPVVGTSAFDTLTLATGTATTSLHDKARAQGINLRQIDAAHLGLSLDETSSQADVESLWQLFAGDQAQPDFVALAASTGSLLPTALLRQSAILEHPVFNRYHSETELMRYLRRLADKDLALDRSMIPLGSCTMKLNAASEMIPVTWAEFGNLHPFAPAEQSQGYLQMTTELEAMLCAATGYDAVSLQPNAGSQGEYAGLLAIRAYHRSRGESHRDICLIPSSAHGTNPATAHMAGMRVVVTACDARGNVDVEDLRAKAIEHRERLAAIMITYPSTHGVFEEAIGEICAIIHDNGGQVYIDGANMNAMVGLCAPGKFGGDVSHLNLHKTFCIPHGGGGPGVGPIGVKSHLAPFLPGHAKLENTEGAVCAAPFGSASILPITWMYIRMMGGAGLKRASQMAILNANYIARRLEEHYPVLYTGGNGLVAHECILDLRPLKDTSGISVDDVAKRLIDFGFHAPTMSFPVAGTLMIEPTESESKEELDRFCNAMIQIREEIRAVENGSLDKDDNPLKNAPHTAAELVGEWAHGYSREQAVYPLPSLVEGKYWPPVGRVDNVFGDRNLVCACPSIESYQDA

SEQ ID NO: 17129 - protein, 404 aa, Unknown
  Mycobacterium sp. JLS
MRELPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSMNLIYDEDPDYIVVFGADHVYRMDPEQMVQFHIESGAGATVAGIRVPRAEASAFGVIDADESGRIRSFVEKPADPPGTPDNPDEAFVSMGNYIFTTKVLIDAIRADADDDDSDHDMGGDIIPRLVGDGMAAVYDFSNNEVPGATERDHGYWRDVGTLDAFYDAHMDLVSVHPIFNLYNKRWPIRGESENLAPAKFVNGGSAQESVVGAGSIISAASVRNSVLSSNVYIDDGAIVEGSVIMPGTRIGRGAVVRHAILDKNVVVGPGEMVGVDLEKDRERFSVSAGGVVAVGKGIWI

SEQ ID NO: 17130 - protein, 307 aa, Treponema pallidum
METDYDVIIVGAGAAGLSAAQYACRANLRTLVIESKAHGGQALLIDSLENYPGYATPISGFEYAENMKKQAVAFGAQIAYEEVTTIGKRDSVFHITTGTGAYTAMSVILATGAEHRKMGIPGESEFLGRGVSYCATCDGPFFRNKHVVVIGGGDAACDESLVLSRLTDRVTMIHRRDTLRAQKAIAERTLKNPHIAVQWNTTLEAVRGETKVSSVLLKDVKTGETRELACDAVFFFIGMVPITGLLPDAEKDSTGYIVTDDEMRTSVEGIFAAGDVRAKSFRQVITATSDGALAAHAAASYIDTLQN

SEQ ID NO: 17131 - protein, 929 aa, Oryza sativa
  misc_feature (291)..(291): Xaa can be any naturally occurring amino acid
  misc_feature (328)..(328): Xaa can be any naturally occurring amino acid
MAGFADALRPDKFTGVHFKRWQIRVTLWLTAMKCFWVSTGKPEGVLTAEQQKQFEEATTLFVGCILSVLGDRLVEVYMHMTDAKELWDALNTKFGATDASNDLYIMEQFHDYKMADNRSVVEQAHEIQTMAKELELLKCVLPDKFVAGCIIAKLPPSWRSFGTALKHKRQEYSVEGLIASLDVEEKAREKDAASKGDGGQSSANVVHKAQNKSKGKYKAQQTTNFKKQKKNNNNPNQDERTCFVCGQVGHLARKCPQRKGMKAPAGQTSKSANVTIGNTGDGSGYGNLPTXRTGFHRPNGEWVTCFCSWCWHGRSEVYFGKDRAAEEXDTHSGSNQPSEIIPSSITPPEQTEHTHELVSEEDVSEAPRRSKRQRTAKSFGDDFTVYLVDDTPKSISEAYASPDADYWKEAVRSEMDSIIANGTWEVTERPYGCKPVGCKWVFKKKLRPDASHGLLVHQMDVKTAFLNGELDEEIYMDQPDGFVVEGFAVNEADKCVYYRHGGGEGVILCLYVDDILIFGTNLEVINESHYVEKILNRFGYIDSKPSPTPYDPSLLLRKNKRIARNQLEYSQIIGSLMYLASATRPDISFAVSKLSRFTSNPGDDHWRALERVMRYLKGTVELGLHYTGYPAVLEGYSDSNWISDVDEIKATSGYVFTLGGGAVSWRSCKQTILTRSTMEAELTALDTATVEAEWLRDLLMDLPVVEKPVPAILMNCDNQTEIKKLRSYNVGLHPNSEKPGRSLHEGTITKYYSIPLAGVHQRSGEQVSGTSAFDVLHREKAAIRVLTWNDGFYNGEIKTRKIENNLVTELTAEQLLLQRSEQLRELYNSLLSGESADQQRRRPVTALSPEDLGNVEWYYVVCMTYAFRPGQCVPGKSFASNGCAWLCNAQSADSKAFPRKLLAKNASIQTIVCVPFMTGVLELGTTDPG

SEQ ID NO: 17132 - protein, 110 aa, Arabidopsis thaliana
  misc_feature (2)..(2): Xaa can be any naturally occurring amino acid
  misc_feature (4)..(4): Xaa can be any naturally occurring amino acid
  misc_feature (17)..(18): Xaa can be any naturally occurring amino acid
  misc_feature (23)..(23): Xaa can be any naturally occurring amino acid
  misc_feature (32)..(32): Xaa can be any naturally occurring amino acid
  misc_feature (49)..(49): Xaa can be any naturally occurring amino acid
  misc_feature (52)..(53): Xaa can be any naturally occurring amino acid
  misc_feature (59)..(59): Xaa can be any naturally occurring amino acid
  misc_feature (74)..(74): Xaa can be any naturally occurring amino acid
  misc_feature (78)..(78): Xaa can be any naturally occurring amino acid
  misc_feature (85)..(86): Xaa can be any naturally occurring amino acid
  misc_feature (109)..(109): Xaa can be any naturally occurring amino acid
HXQXQLQIMQQWGNPYXXPATLXFAMHNHMLXGNGSAHGLNPTNHMMPXPVXXALNWPXPPLTNISFPHSSRQXLFLXTSSPASXXQSLHGLVPYFPSFLDFSSHAMRXL

SEQ ID NO: 17133 - protein, 294 aa, Erwinia carotovora
MKKVTVAATQMACSWDLPKNIENAEKLVRQAHAKGAQVILIQELFAAPYFCIDQSPEHYALAQELETSPLIKHFSALAAELNVVLPLSFFERANNAYYNSLVMIDADGSVLDVYRKTHIPNGPAYQEKQFFIPGDTGFKVWQTRYAKIGVGICWDQWFPETARSLALQGAELIFYPTAIGSEPAYPDIDSQPHWTRVQQGHAAANLVPVIASNRIGTEASKYIDGLEMTFYGSSFIADQTGALLAQANKTDEAILVHEFDLEAIAAQRASWGLFRDRRPEMYGTIASSDGKTRR

SEQ ID NO: 17134 - protein, 196 aa, Coprinopsis cinerea
MLKLVEDDVPSIEEFMASYRMDHPAALHRIRVGVPATVEHSSEAGPETAKWVAATTQSFITLMDALKLNMRAKDQLHSLLQELVTGFARFKGSKDWEGRSKMVSWLITLNGMKASEELTEEQARQFFFDVDHAYAEFFRSLGGGKDDDPSPDSGTTSRTVPLLKATSIQKPYRLSRYINAYLWPDHYFLLFDNSGI

SEQ ID NO: 17135 - protein, 164 aa, Brassica napus
MASSSQAFLLLTLSMVLVHFSLAQSPMMAPSGSMSMPPMPSGGSPMPMMTPPPMPMMTPPPMPMMTPPPMAMAPPPMPMTPPPMPMAPMPMTPSSSPMSPPTTMAPSPETVPDMASPPMMPGMESSPSPGPMPPAMASPDSGAFNVRNDVVAISFLVAAHLLLV

SEQ ID NO: 17136 - protein, 381 aa, Unknown
  Fragaria x ananassa
  misc_feature (107)..(107): Xaa can be any naturally occurring amino acid
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIXDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 17137 - protein, 640 aa, Oryza sativa
MGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGIGGSNGGVFEDVNGMMQQPQQTTPAQQQFFIRDDTPFGNQMGDINGASEFRFGSGFNMSGAVEYPGAMQGQQKNDGSNWYY

SEQ ID NO: 17138 - protein, 606 aa, Arabidopsis thaliana
MDTKIGSIDDCKPTNGDVCSPTNGTVATIHNSVPSSAITINYCDATLGRHLARRLVQAGVTDVFSVPGDFNLTLLDHLMAEPDLNLIGCCNELNAGYAADGYARSRGVGACVVTFTVGGLSVLNAIAGAYSENLPLICIVGGPNSNDYGTNRILHHTIGLPDFSQELRCFQTVTCYQAVVNNLDDAHEQIDKAISTALKESKPVYISVSCNLAAIPHHTYSRDPVPFSLAPRLSNKMGLEAAVEATLEFLNKAVKQVMVGGPKLRVAKACDAFVELADASGYALAMMPSAKGFVPEHHPHFIGTYWGAVSTPFCSEIVESADAYIFAGPIFNDYSSVGYSLLLKKEKAIVVQPDRITVANGPTFGCILMSDFFRELSKRVKRNETAYENYHRIFVPEGKPLKCESREPLRVNTMFQHIQKMLSSETAVIAAETGDSWFNCQKLKLPKRYEFQMQYGSIGWSVGATLGYAQASPEKRVLAFIGDGSFQVTVQDISTMLRNGQKTIIFLINNGGYTIEVEIHDGPYNVIKNWNYTGLVDAIHNGEGNCWTAKVRYEEELVEAITTATTEKKDCLCFIEVILHKGETSKELLEWGHASLLLTAVLPNPQ

SEQ ID NO: 17139 - protein, 303 aa, Streptococcus pneumoniae
MYDTIIIGAGPAGMTAALYAARSNLKVALIEGGLPGGQMNNTSDIENYPGYANISGPELAEKMFEPLENLGVEHIYGYVENVEDHGDFKKVMTDDQTYETRTVIVATGSKHRPLGVPGEEELNSRGVSYCAVCDGAFFRDQDLLVVGGGDSAVEEALFLTRFAKTVTIVHRRDQLRAQKVLQDRAFANEKISFIWDSVVKEIKGENRVESVVFENVKTGQVTEQAFGGVFIYVGLDPLSDFVKELNIQDQAGWIVTDSHMKTAVDGIFAVGDVRLKDLRQVTTAVGDGAIAGQEAYKFITEHS

SEQ ID NO: 17140 - protein, 99 aa, Capsicum annuum
GWEYSTDGKCEKMPSTRLLNVKIKALPCFEQEGMIWIWPGNDPPAATLPSLLPPSGFQIHAEIVMELPVEHGLLLDNLLDLAHAPFTHTSTFAKGWSVP

SEQ ID NO: 17141 - protein, 796 aa, Oryza sativa
MDGLIRPNWLDTPIQYLRGLFFGALGIEIHASEYRYWTAAVTDDPLSVLSSWSESDPDPCRWPGVTCSNVTAAGGEPRRRVVGVALAGKNLSGYIPSELGSLLFLRRLNLHDNRLAGGVPAALSNASSLHSLFLYGNRLTGALPAALCDIPRLQNLDVSRNALSGGLPGDLRNCRSLQRLILAGNSFSGEVPAGIWAEMASLQQLDISSNGFNGSIPADLGELPRLAGTLNLSHNRFSGVVPPELGRLPATVTLDLRFNNLSGAIPQTGSLASQGPTSFLNNPGLCGFPLQVPCRAVPPPTQSPPAPTTTTTTTTPSSASAAAAAASEHHQPIRTSLIALISIADAAGVALVGVILVYVYWKVKDRKKQGRSSTVAAGDENESRHGLCRCIWGHRGVDSDTDTDDSSASENGGGGGKYGEGELVAIDRGFRVELDELLRSSAYVLGKGGKGIVYKVVVGNGATPVAVRRLGGGGGGGERCKEFAAEARAVGRARHPNVVRLRAYYWSADEKLVVTDFVGNGNLAAAMRELAGEAGVLAGRPGQTPLSWSTRLKIARGAARGLAYLHECSPRRFVHGEVKPSNILLDADFTPRVADFGLARLLAVAGCADDVVDAPPAAPSSGGLLGGAIPYAAKPASSVAADHRGGGYRAPEARTAGARPAQKWDVFSFGVVLMELLTGRGPGDHASPSTSASFSAPSSSSAATTDRSGSGEHGHGAGVGGAVVPEVVRWVRRGFEEEARPVSEMVDPALLRDAPPLPKKEVVAAFHLALACTELDADLRPRMKAVADTLDKIASS

SEQ ID NO: 17142 - protein, 358 aa, Zea mays
MSRRLYQHAAVMSAWAPAAYTLVLLLHLLAGAVVTAKTNNGVDPGPRQQEPSMPVDSSGDEALSALTWMATGSEASKAAEAVVDWHKHDSKRMLHAVYRVGDLDRTIKYYTECFGMKLLRKRDVPDEKYTNAFLGFGPENTNFAVELTYNYGVDKYDIGTGFGHFAIANDDVYKLAENIKSKGGKITREPGPVKGGSTVIAFAQDPDGYMFELIQRADTPEPLCQVMLRVGDLERSIKFYEKALGMKLLRKKDVPDYKYTIAMLGYADEDKTTVLELTYNYGVTEYSKGNAYAQVAIGTNDVYKSAEAVDLATKELGGKILRQPGPLPGINTKIASFVDPDGWKVVLVDNTDFLKELH

SEQ ID NO: 17143 - protein, 354 aa, Pseudomonas syringae
MHPKNAWYVACTADEVADKPLGRQICNEKMVFYRDQNQQVVAVEDFCPHRGAPLSLGYVENGQLVCGYHGLVMGGDGKTVSMPGQRVRGFPCNKTFAAVERYGFIWVWPGDREKADPALIHHLEWAVSDEWAYGGGLFHIQCDYRLMIDNLMDLTHETYVHASSIGQKEIDEAAPVTTVEGEEVVTARHMENIMPPPFWQMALRGNNLADDVPVDRWQICRFTPPSHVLIEVGVAHAGKGGYDAPKEFKASSIVVDFITPETDTSIWYFWGMARNFNPADEALTASIREGQGKIFTEDLEMLERQQQNLLQHPHRNLLKLNIDAGGVQSRKILERLIAAEQAGPGEQIPVMATK

SEQ ID NO: 17144 - protein, 1186 aa, Cryptococcus gattii
MSVARPTPNLRTPRFPLDHRASLSDGHTNTSSSSRDDALSSHSTGTAFHKFQSYSSFAPHYLNAPPGLAFKTYLDKWGPEQVMGFLAIHGCEHHSGIFIKHSIDGKLLLDFDMSVLTSLGITKVGERIRLMGGIKCLRQRVAHEAKKHNIRSARICDGSLGTDQAKVMIHPKRSASLYAHCQNPFDSDGQSTACRSRLTPSSPADRESDPSPMQRSMNRSIITTFSRRQIIGSLPSEQIHNQSVDSSPTSSLCPPALQRLSPRSTGVSYSDITPKGTPPLITQSTNGAFDHTFSVTGPRDTTSPLGGHLHRPNFFYSTNDISQTCNRPANNTISEQPQRDRESSPSERKENGVICEDEAMGDNSLFAPTFANHPFAISITESNVLEYPRNLSIKNCLPLTSFPSPDKPAAEDTSVMNPSAPSLDDLRRQLIKFVNADDGTTRTVNVMEVTSGAEVLERALKKFGKTGSGRASFLDEDIYGDGKHEGFLCIDGWGVFAENLSGEEMGPMTEGDLLDICSSLRSGAAIQRDALVLRQTSKPQKRKDMRLYLGNTSVLPTPVNLPISFSSPYSGQFVQNSTLQYPAQHQPLLSTNRSRASMMSIMSGLGVSHPGIEKPTDESVQSSTSVTMPSSKKKSMYNFFGHRPPSELISSHLADYFPSAKKRDVAKARGSMLRLNTSHSTEGDPRDVETRPMIEVDDIFFPSTEESSTERRDHYFDPSTFQQRDTSSPRHVGNFTSNRGGSSKGNCKPHSDQKALSTLKTQELHSVNSVTPLLGASPPEVPLTYQPAWLTDFDRDPSFSQLQPLQHSSASSSKQPSSSNRRTMDEITAEMQHRQTSLSCDRPPSKVDSDISAPPSDSETSLGHSSDASDVLESSSGYSDDRSSVSSEDSEEDMAVHTRAFTSNGSKRNIKWIKGALIGAGSFGSVFLGMDAHSGLLMAVKQVELPRGIAKMEARRRDMLSALEREIELLKDLQHDNIVQYLDSSTDANHLNIFLEYVPGGSVAALLSNYGAFEEALAGNFVRQILTGLNYLHKRDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPEIPSDISVHAADFLSCTFALDYRMRPSAASLLEHTFIIHDGRLNQEM

SEQ ID NO: 17145 - protein, 209 aa, Haemophilus somnus
MGKKKRSASSSRWLNEHFKDPFVQKAHKQKLRSRAYFKLDEIQQSDRLFKHGMTVVDLGAAPGGWSQYAVRQIGDLGRVIACDILEMDPIVGVDFLQGDFRDENVLQALLERVGEKKVDVVMSDMAPNFSGMPAVDIPRAMYLVELALDMCKQVLATNGCFVVKVFQGEGFDDYLKEIRSLFNTVKVRKPEASRGRSREVYIVAMGYMG

SEQ ID NO: 17146 - protein, 554 aa, Vibrio cholerae
MCSIFGILDIKTDAATLRPIALEMSKKLRHRGPDWSGIYASDKAILAHERLAIVGLNSGAQPLYSPDRKLILAVNGEIYNHKEIRERYKGQYEFQTDSDCEVILALYRDKGADLLEELNGIFAFVLYDEEKDEYLIGRDHIGIIPLYQGHDEHGNFYVASEMKALVPVCKTLSEFPPGSYLSSKDQAVTRYYVRDWNSFDEVKDNVSSKEELTQALEAAVKRQLMTDVPYGVLLSGGLDSSITSAIAKRFAAMRIEDDEKSAAWWPQLHSFAIGLEGAPDLKAAREVAEKIGTVHHEMTYTIQEGLDAIRDVIYHIETYDVTTIRASTPMFLMGRKIKAMGIKMVLSGEGADEIFGGYLYFHKAPNAKEFHEETVRKLLALNLFDCARANKSLAAWGVEGRVPFLDKEFIDVAMRLNPADKMCGNGKMEKHILRECFEHYLPESIAWRQKEQFSDGVGYGWIDTLKATAEAKISDQQMETAKFRFPYNTPTTKEGYVYREIFEELFPLESAARCVPGGPSVACSSAKAIEWDESFKNCIDPSGRAVKAVHKQAY

SEQ ID NO: 17147 - protein, 876 aa, Kineococcus radiotolerans
MTWRWPSPSPPRTGGRRSRCAPGWSTRSRTGCRCGSTSTSTTAPRSGWPARERGEGRAGRGRPRPPRARRRRGGRAAGRRRGGAGGAGRARGRGAPGPGGRGPDVRGEPQPRRHPRGRPGRARPPARPRAGGRRARGDRGLRAGAGAGLRGAGGLPGAGRGRRAGGTGDPPARLPAPGAAGGRAPPRVEPARVPRRGRGGGAGVGARHGREGPRRRRPDRAERRGARPAGGALGGDGRHRARGGADLHEHPGPRRSGDPGAAGRAPAAAGRRGRADGGLHRVHRHAVPRRPRPVAARHAGAARRGAAAAGRVRRPRPGGLAQARPGPDRAAAARRGRRPRRVAARRFAGPRGRPGGGHHPEPRGGRGARGPAGPAAAPAHDPLRRARGPVTGASAGPATEVDVAVVGAGFAGIGAALRLARRGRESFVVLERGDDVGGTWRDNTYPGVACDVPSHLYSFSFAPKPDWSRVFAPGAEIQEYLRACAREVAGNLRLRTEVLRARWEGSRWVLTTSTGPVRARVLVLAAGRLTEPRTPALPGLDGFDGPVFHTARWDHAVDLAGARVGVVGTGASAVQVVPRIAGTAAHLTVFQRSAPYVVPRGDREFSAEELAGFVADPALPAALREETFTEMERGLAARRLVAQALDPLRRRALDHLAAQVPDPVLRAALTPDYEVGCKRVLLSDDFYPALGRDDVTLVASALRGFEGRTARAADGSRHPLDVLVLATGFHAARQPYARRVVGRGGLTLDAAWSGGMVSHASTVVHGFPNLFVLDGPNASLGHNSALHVIESQLGYLLGALEHLEHHAGALEVSAAAQRAYTADVDAMAAASVWLRGGCSSWYVDARSGRLTLLWPDTAGEFRRRNGTFDPAPFLAG

SEQ ID NO: 17148 - protein, 429 aa, Caulobacter crescentus
MMTQTDLSAFFGADLATADRDIFDRIGRELGRQQNQIELIASENIVSKAVLEAQGSILTNKYAEGYPGKRYYGGCEYVDEIETIAIERAKALFGAGFANVQPHSGSQANQAVFMALLQPGDTFLGMDLAAGGHLTHGSPANQSGKWFKPISYSVRQQDQLIDYDGVAEVAQREKPKLIIAGGSAYSREIDFAKFREIADSIGAYLMVDMAHYAGLIAGGAYANPIPHAHIVTTTTHKTLRGPRGGLVLTNDEAIIKKVNSAVFPGLQGGPLEHVIAAKAVAFGEALQPSFKDYARQVVANARALAEALLKSGVNIVSGGTDSHLMLVDLRPKGVTGRDAEHSLERAYMTCNKNGVPFDTAPFTITSGIRLGTPAGTTRGFKEAEFTRVGELIGEVVNGLAVNGPEGNAAVEAKVREEVLALTGRFPIYN

SEQ ID NO: 17149 - protein, 322 aa, Thermus aquaticus
MKRIGVFTSGGDAPGMNAAIRAVVRQAHALGVEVIGIRRGYAGMIQGEMVPLGVRDVANIIQRGGTILLTARSQEFLTEEGRAKAYAKLQAAGIEGLVAIGGDGTFRGALFLVEEHGMPVVGVPGTIDNDLYGTDYTIGFDTAVNTALEAIDRIRDTAASHERVFFIEVMGRHAGFIALDVGLAGGAEVIAVPEEPVDPKAVAEVLEASQRRGKKSSIVVVAEGAYPGGAAGLLAAIREHLQVEARVTVLGHIQRGGSPTAKDRILASRLGAPAVEALVGGASGVMVGEVEGEVDLTPLKEAVERRKDINRALLRLSQVLAL

SEQ ID NO: 17150 - protein, 394 aa, Zea mays
MAAAAVVFDAEALSREEHIPAQFVWPTEERAPAGGVEEVAIPVVDLGEFLRRGVLPRGVAEACERHGVFQVVNHGVGAALLAEAYRCCDAFYALPLADKQRAQRRHGENHGYASSFTGRFHCCLPWKETLSFNCPAGAGTARAVVGYFVDVLGEDYRHMGSLLLYPIFLRACACHAARTETGKKCREVYQEYCDAMTRLALDVTEVLAAALGLDRGALRGFFEGGDSVMRLNHYPACRQPHLTLGTGPHRDPTSLTLLHQDDVGGLQVRAGGGPWRAVRPRADAFVVNIGDTFAALTDGRHTSCLHRAVVTGGGSRRSLAFFLNPPLDRVVRPPGALLQENKQAGRPRAFPDFTWREFLEFTQKHYRSDAGTMDAFVSWIAGGRRHHGGQEEGN

SEQ ID NO: 17151 - protein, 335 aa, Leptospira interrogans
MKIGVIGSGSFGTALGSLLADKGYEVILWCRNDSQVESINRNHINNKHLPNFTLPEKLTASKDLRNVVQGKDMIVSSPPSHALSEVLREIKEYLPEKVPIVSASKGIENGTLRLVSEIFESELPEKYHSYLSYLSGPSFAKEIIQKVPTIVSIASKNETTARKVQEIFSFLYFRTYWTPDVIGVEVGGSLKNVIALAAGVSDGLGFGQNTRAALITRGLNEITKIGLKLGADPMTFLGPSGMGDLILTCCGEQSRNRTVGFRLGKGETLEQILSSMNEVAEGVKTTQSAYELSQKLGIEMAITNEVYKMLYEGKNPREVVKDLMKRDLKREGVSV

SEQ ID NO: 17152 - protein, 300 aa, Ralstonia eutropha
MAYKTIEDTIGNTPLVRLQRIPGAANDARGNVILGKLEGNNPAGSVKDRPAVSMIARAEARGRIKPGDTLIEATSGNTGIALAMAAAIRGYKMVLIMPEDLSLERRQSMAAYGAEIILTPVKGGMEYARDLADSMERDGKGVILDQFGNPDNPLAHYETTGPEIWRDTEGRITHFVSAMGTTGTITGVSRYLKEQNPAIEIVGAQPAEGSRIPGIRKWPEAYLPKIYDAKYVDRTEPVSQADAEHMARRMASEEGIFSGISAAGALCVALRVAEEVENATIVFVVCDRGDRYLSTGVFPA

SEQ ID NO: 17153 - protein, 406 aa, Methanosarcina barkeri
MEIRIAAVTNFSCIPKIFYEALLLTDRNEFLNDINKIVIKIGTSSLTKQNCDSTKENCSIDPTFIENIAAQVSELRKLGKEVIVVSSGAIGVGLYELGIAPKPREIPIRQAAAAVGQSILMQYWSEAFSKHGIKVAQILLTYEFYSDRVSYLNLRNSISTLLEYGVVPIINENDCTCTNEIEAIFGDNDKLSAMVASKIDADLLIILSDIDGLFDKNPKIHEDARLISLVEKITPEIESYGGDPTSFKGVGGMRTKIKAAKICSMAGCYVLIANSEIEDVLLKVLSGKEIGTLFLAERHIQKNRARWIILSRASGTIRVDAGAKAAVLGKNSLLSAGVVDVEGNFDRGDVVRLECEGRVFAKGITDYTSEELMKIKGAHTDEIEGILGYNNYSNVIKKENIGIMEN

SEQ ID NO: 17154 - protein, 591 aa, Unknown
  uncultured bacterium 581
MSNLTGSPRMIYAATLILAACSLLYELLIAQALATFAANTVTWYSVTVGLYLAGMGLGALLHDQHPTDNLWARFFKVEIALSAAGAIAVPLLHFSHTGALLLELYGLTFLGKVLFFGTGFLSITTIGILTGFELPVLIDLANTAKDKKRLTNRVLASDYTGSLLGGLAFPLILLPKLSLVAIGLIAATLNVFLATLALYFFLPKLHRSSFGFIVSGSLIIMLGLGLSFAPSLDRYFTKLYYFYWDQSEDFKQLFASMDNTEDVFRVRSPYQRIDLVHDKNGSGPSPVDDFYSSKFVDNPQQPKNYSLFLNGDFQLASNYEEYYHEFFAHIPIMTNGAVPRHVLVMGGGDGLLLRELVKYSDIKTIVHVDLDRELIEQATTHPVLLAMNEGSLSDPRITRHFDDAYRFIRNSSDQFDAIYLDFPDPRDYNLSKLYSREFYHFVRQRLTSDGFIALDSPGLRHNKERREIYTSTLAAAGYQFVTPYISKIETINEAAYEFLLASGYEEEKARRLLASHAASMRLGFITARDNWPDRPIYQDPRVKLHVINDTRLYLTLRNLIPSLAPTDPDKINSIFRPTLPSGNIWHVRDPW

SEQ ID NO: 17155 - protein, 464 aa, Xanthomonas axonopodis
MTVVSVEHALAGKLPEGGEVTVRGWVRTLRGSAGLAFINVTDGSCFAPIQVVANDTLPNFDEIKRLTSGCSLIAKGVLVKSQGKGQSFEIQASGVDVVGWVEDPLTYPIQPKPMTPEFLREVAHLRPRTNLFGAVTRIRNCLAQAVHRFFHQNGFNWISTPIITTSDAEGAGQMFRVSTLDMVNLPRDASGAVDFSRDFFGKETFLTVSGQLNVEAYCLALSKVYTFGPTFRAENSHTTRHLAEFWMIEPEIAFADLAEDARLAEQFLKYLFRAVLDERGDDLAFLAERVDKNAIAKLEAFINAPFEQIDYTDAVKLLQNSGKKFDFPVEWGLDLQTEHERWLTEEHIGRPVVVTNYPEHIKAFYMRLNDDGKTVAAMDVLAPGIGEIIGGSQREERLDVLDARMAQFGLDKEHYSWYRDFRRYGSVPHAGFGLGFERLVVYVCGLSNIRDAIPYPRAPGSAEF

SEQ ID NO: 17156 - protein, 447 aa, Methanosarcina barkeri
MAEDIKSKVIQAKKASIELSSVSTEVKNLALEAMAQALDKERKAILDANAKDLEAAAELKKKGKLTQALVDRLKVSDSKIDGMIAGIRDVIKLKDPVGDTLSTLELDKDLILYQVSCPIGLIGVIFESRPDVVPQVMSLCLKSGNATIFKGGSEARESNRTIFQILVKAIESTDGMPAGAFQLMETREEIMDLLSLDAYVDLLIPRGSNEFVKFIQENTKISVLGHTSGICHIYVDEYVDLDTAWKVCFDAKVQYPAVCNAIETLLINRKIADTFLPKMAEMYLSAGVELRCDEDSYALLEKRGLSPLSRATEEDWSLEYNDLILSIKLVDTIKEAIDHINTFGSHHTDGIITEDASRRKAFTALVDSSSVMVNASTRFADGYRYGKGAEVGISTNKIHSRGPVGMEGLLIYKYILLGKGQVVADYAGENAKPYTHRKLDLKFEDVN

SEQ ID NO: 17157 - protein, 421 aa, Unknown
  Azoarcus sp. EbN1
MEPAMEQTQYLVVGSSHAALEAISAIRMHDATGTLTVVTRDAHLPYSPTVLPYVVSGKSAPERVFLRDDDFFARNAVSYRPGAGLAALHADSNTAELADGTRLAYDKLLLATGTSPAIPPIPGIDTVSYHVLRTLDDALGLREAIAQSRQAVVLGAGLVGMHAAENLVKAGASVTIVEMSDQLTAGYFDKVAAQMIEQAFTDNGAKILTGSRVVRLEPSSVGARLTLANGQSLEADLLLVATGVKPNLEYLNGSGVAFDHGILVDDTMRTSVANVWAAGDCAQAKHFFSPTPRVNAILPSATEQGRLAGMAMAGDAGIKPYAGGVPLNTYHFFGRHAISVGSSEAPEGSEVLTRFDEKTGRYLKAIFRDGRLAGIFGVNEFFDGGIMCQLIVRRMDLTADKERLVADPLKVGRELMSRTWR

SEQ ID NO: 17158 - protein, 160 aa, Glycine max
MNALAATNRNFQRAARILGLDSKLEKSLLIPFREIKVECTIPKDDGTLVSYVGFRIQHDNARGPMKGGIRYHPEVDPDEVNALAQLMTWKTAVADIPYGGAKGGIGCNPRDLSISELERLTRVFTQKIHDLIGVQRDVPAPDMGTNAIIKTFHIDIRVIL

SEQ ID NO: 17159 - protein, 455 aa, Arabidopsis thaliana
MNPEEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGIEA

SEQ ID NO: 17160 - protein, 444 aa, Triticum aestivum
MDPQTFVRLSVGQLGLRLPGASARKAFHCEIRLRGFPVQLAPVPLENSSEFHLDPHANAAVFSLDEPGLKALPTSRWFRTPEPPYLEIAVYVSRRDGGGHCVGLKRRLVGAVRVDVGPEWRDGKPVLLRHSWTGIGRAAELHVRVRVEADPRYVFRFEDEVALNPQVVQLHGGASQPIFSCKFIRDVRRASQPDHLGGKYWSSSGSGEEKETEMAGRRRERKGWKVAIHDLSGSAVAAAFMATPFVPATGSDTVARSNPGAWLIVRADTTGSSESWQPWGRLEAWRECAAPAGGKDAVCLRLHLLPERRDACVLVSETPLSCDKGGEFSIDMDRQSILPEDAVASETPSASSYCAASMGESCAGGGFVMSCSVQGEAATSSRPPLVHLAARHVMCMEDAAMFLALAAAVDLSVKACRPFRSKTAAAKKKTAAGSSSPDSLELDT

SEQ ID NO: 17161 - protein, 407 aa, Oryza sativa
  misc_feature (39)..(39): Xaa can be any naturally occurring amino acid
MAAATTSRRGPGAMDDENLTFETSPGVEVISSFDQNLGXGIRDDLLRGIYAYGFEKPSAIQQRAVLPIISGRDVIAQAQSGTGKTSMISLSVCQIVDTAVREVQALILSPTRELAAQTERVMLAIGDFINIQVHACIGGKSIGEDIRKLEHGVHVVSGTPGRVCDMIKRRTLRTRAIKLLILDEADEMLGRGFKDQIYDVYRYLPPELQVCLISATLPHEILEMTSKFMTDPVRILVKRDELTLEGIKQFFVAVEKEEWKFDTLCDLYDTLTITQAVIFCNTKRKVDWLTERMRSNNFTVSAMHGDMPQKERDAIMGEFRSGATRVLITTDVWARGLDVQQVSLVINYDLPNNRELYIHRIGRSGRFGRKGVAINFVKKEDIRILRDIEQYYSTQIDEMPMNVADLI

SEQ ID NO: 17162 - protein, 979 aa, Nostoc punctiforme
MVLNAPILKSNEQQVLNQKSQKLSSFAPRHIGPNSDDIQQMLKVLGFPSLDALIDKTVPQTIRLKQPLKLPEAESEYAALASLKKIAAKNQVFRSYIGMGYYDTITPLVIGRNILENPGWYTAYTPYQPEIAQGRLEALLNFQTLIIDLTGLEIANASLLDEATAAAEAMSLSYGVSKNQANAYFVSHDCHPQTIDVLQTRAKPLGINIIVGDHQTFDFDRAIFGAVLQYPASDGTIYDYRAFIEKAHAKGALVTVAADPLSLTLLTPPGEFGADIAVGSTQRFGIPLGFGGPHAAYFATKEEYKRLVPGRIVGVSKDAQGKPALRLALQTREQHIRREKATSNICTAQVLLAVMASMYAVYHGPDGLKQIAENIHQLTLMLAAGLKHLGYKISSEHFFDTLRVELGTRSLEVILEACQARNINLRIFDDTAVGISVDETTTADDLIELFEIFAAPDSLLFGFKEIGDLIAARRKSSLQNSTFARTSNYLTHPVFNRYHSETELLRYLHKLESKDLSLTTSMIPLGSCTMKLNATAEMIPVTWEEFGKIHPFAPASQTQGYQILFQQLEAWLAEITGFAGISLQPNAGSQGEYAGLLVIRQYHENRGEAHRNVCLIPTSAHGTNPASAVMCGMKVVAVACDSQGNIDVDDLKAKAEKHSHELAALMVTYPSTHGVFEEPIQEICAVVHSHGGQVYMDGANMNAQVGICRPGDIGADVCHLNLHKTFCIPHGGGGPGMGPIGVASHLVPFLPGHPVVTINDSTQHSHIGAVAAAPWGSASILVISWMYIAMMGADGLTQATKVAILNANYIAKKLESYYPVLYQGKNGLVAHECILDLRSLKKSAAIEIDDVAKRLMDYGFHAPTVSWPVGGTIMVEPTESESKQELDRFCDALIAIRQEIAEIEVGKVDAQDNVLKNAPHTAESLITGEWQHPYSREQAAYPAPWTREYKFWPAVGRIDAAFGDRNFVCSCLPMDAYSS

SEQ ID NO: 17163 - protein, 489 aa, Burkholderia xenovorans
MNEEILINVTPQETRVALVQQGAVQELHVERTLSRGRVGNVYLGKVVRVLPGMQSAFIDIGLERAAFLHVADIWHPRIAGEPQHQAPHQPIEKIVFEGQTLMVQVVKDPIGTKGARLSTQVSIAGRTLVYLPQEPHIGISQKIESEAEREAVRARLTAVLPADEKGGYIVRTIAEDATSEELAGDVAYLRKTWATILSQGQRMPPTSLLYQDLNLAQRVLRDFVNDETSRIQVDSRETYQMLADFAAEFTPAVSSKLHHYTGERPLFDLYNIEAEIQRALSRRVDLKSGGYLVIDQTEAMTTIDVNTGGYVGARNFDDTIFKTNLEAAHTIARQLRLRNLGGVIIIDFIDMENVEHRDQVLGELKKALSRDRTRVTVNGFSQLGLVEMTRKRTRESLAHVLCEPCPVCQGKGQVKTPRTVCYDVLREILRESRQFNPREFRVVASQQVIDLFLEEESQHLAMLIDFIGKPVSLQVESNLSQEQYDIVLM

SEQ ID NO: 17164 - protein, 448 aa, Streptococcus mutans
MSKDYISIIDVKNHVGEEVTIGAWVANKSGKGKIAFLQLRDGTAFFQAVAFKPNFIEKFGEEAGLEKFNTIKHLNQETAIEIKGIVKEDKRSKFGYELDATDLKVIGTSDNYPITPKEHGTDFLMDHRHLWLRSRKQMAIMQIRNAVIYASYEFFDQNGFVKFDSPILSGNAAENTTDLFETDYFGEPAFLSQSGQLYLEAGAMAFGRVFDFGPVFRAEKSKTRRHLTEFWMMDAEYPFMSHEQSLDLQEAYVKTLIQGVLDRAPQALGILERDTDLLRKYIAQPFKRVSYDDAITLLQEHEEDEDTDYEHIEHGDDFGSPHETWISNYFGIPTFVVNYPASLKAFYMKPVPGNPDRVLCADLLAPEGYGEIIGGSERETDYNTLLAKIKENGLNPDDYAFYLDLRQYGSVPHCGFGLGLERMVTFVAGTKHIREAIPFPRMLHRIEP

SEQ ID NO: 17165 - protein, 328 aa, Salmonella typhimurium
MPLHHLTRFPRLEFIGAPTPLEYLPRLSDYLGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDALTDPDAQLQTLATRIEAQGFRPYVIPVGGSSALGAMGYVESALEIAQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLASLEGVLLDPVYTGKAMAGLIDGISQKRFNDDGPILFIHTGGAPALFAYHPHV

SEQ ID NO: 17166 - protein, 149 aa, Zea mays
  misc_feature (100)..(100): Xaa can be any naturally occurring amino acid
MAPKAEKKPAAKKPAEEEPAAAKAPAGKKPKAEKRLPAAKSSGKEGGDKKGKKKAKKSVETYKIYIFKVLKQVHPDIGISSKAMSIMNSFINDIFEKLAXEAAKLARYNKKPTITSREIQTSVRLVLPGELAKHAVSEGTKAVTKFTSS

SEQ ID NO: 17167 - protein, 258 aa, Oryza sativa
MLRTPTPTRRLLQSVGGGSNPNRIPGIPPADPPSGGVSSDVVVILAALLCALICVVGLAAVARCARNRRNSGGAGAGAGSASPSHSPAHAGHFGGGGSGGGGVTTTTTTTTAATTAAKGLKKKALKALPKLAYADAVAAAAAARGTVVGEEEEGKVEVLAECAICLSEFGEREEVRVMPQCGHGFHVACVDTWLRSNSSCPSCRRPIVLDDPSPPKRCRKCEAIVLEAVVAASSSSSSAATATGSGGGGGGGGGRFLP

SEQ ID NO: 17168 - protein, 308 aa, Prochlorococcus marinus
MVRLNEIKMQDGKIFLITGANSGLGYETSKFLLERGATVIMCCRDLLKGEKAKKELLKFKFSGKIELVELDLSDLINVKKFAESIKNTFDHLDVLINNAGIMAPPKTLSKQGFEIQFAVNHLAHMFLTLELLPMLEEKNNSRVVTVTSGVQYFGKIQWEDLQGNLKYDRWASYAQSKLANVMFGLELDSKLKETNSKTSSLLAHPGFARTNLQPKSVEANQSWQEELAYKLMDPMFQSAKMGALPQITAATLTSASGGEQYGPRFNFRGFPKICRNAPKALNQTSRKKLWDISEKLIKDFDTLSKQSK

SEQ ID NO: 17169 - protein, 231 aa, Phyllostachys pubescens
TRRYWNINLKEMIEAGVHFGHGIKKWNPKMAPYISAKRKGTHIINLARTARFLSEACDLVFDAASQGKSFLIVGTKKRAAYLVASAAIRARCHYVNKKWFSGMLTNWSITKTRLSQFRDLRAEEKMGKFHHLPKRDVAILKRKLSTLQRYLGGIKYMTRLPDIVIVLDQQKEYIALRECAILGIPTISLVDTNCDPDLANISIPANDDTMTSIRLILNKLVFAICEGRSLY

SEQ ID NO: 17170 - protein, 639 aa, Rhodopirellula baltica
MCGITGFWNPSRTNERELRFALDPMLDVLDHRGPDERGSRFFQERGLAMGHTRLSIIGLACGHQPIETDDGDYAVTVNGELYDYKRIRTALACENYECNGKSDSAITLPLYLKHDLAMVDHLRGEFAVVLYDDRKERLVLIRDRFGVKPLYYAVNDNGFIWGSEVKSILQHPDVEPRLCPKAAVHQMMQVMVPGSTAFEGVDALLPGHMLVVQRNGDSLEVQTKRWWDFEFPESHDENADPEPFIQGVQDRLIDAVAARLEADVPVGCYLSGGIDSCSILGLANTLQQSPVKAFTIAFDSDEYDESNIAKRMAERTGAEQELLRLTEKELYGPAFERATWHAERTFYNTLAVAKWHMSRRVRACNYKAVITGEGSDELFGGYPFFKRDWLGRDDEGGIFAGAILAEEDLKHSAWQDLCGFTPSWIQPWMLVLKRFEPILSSSLTDLLQEYDPVGEVAGAIDPAQVRGRHRLDVSQYTWSKTMLEGQILTWGGDRMDMANSMEARPAFLDHHVAEYATTIPPNIRIRNGVEKWVLREAMVNVLPRELYERKKFAFMAPPAHTDPVKRAAVQEMIDHWLTPSRVESVGFFQHDKLMQFIDDAWKESDGTIARRNDIVMNHVLQLHMLHGQYVEGLPLPAVD

SEQ ID NO: 17171 - protein, 320 aa, Oryza sativa
MVYISNAQDASKLIVTAKGGGGEADDAAASSAAVVLDLWRQPAKIPAPFVWPRADVALPPSSPPTGELDVPVVDLAAALRDAAGMRRAVAQVAAACASHGFFQVSGHGVPPSLARAALDGAAGFFRLPPAAKQRARRAPGTVTGYTAAHADRFVDNLPWKETLSFGHRHANAAGNNSSTVADYFSTLGDDFKHLGEVYQEYCEAMEEVTKAIMAVLGESLGVGGGYYREFFEDSSSIMRCNYYPPCPEPERTLGTGPHCDPSALTVLLQDGDVDGLQVLVAGAWRPVRPLPGAFVVNIGDTFMACSDIRDLSLTTVSKQC

SEQ ID NO: 17172 - protein, 446 aa, Unknown
  Candidatus Protochlamydia amoebophila UWE25
MDFISNKTPQIEAMLTEIGIQNVEELFKSIPSSLILQAPSVDDGLSEYEGIQLIESLAVRNTFPNLVSYLGAGAYEHHIPALVGAVCSKSEFLTAYTPYQAEASQGMLQIIFEFQSAICALTGMDVANASVYDGASACAEAILMSLRHHKTRRQILLSDSLHPHYKKVIEQYLKSQDCELITVPFLQEGTLDASFLKMYLNDQTAAILLQSPNFFGCIEDVQPITEMAKSQGALTILCANPISYGLLSSAKELGVDIAVGDCQPFGLSLSFGGPYAGYMACKQELMRQLPGRIVGETLDVQGSRGFVLTLQAREQHIRREKATSNICTNQALAALASLVAMLWYGKEGVKELALTNYQRANYLKFHLGKISTINVWNQGASFNEFVVDFKQDSNQVLEFFRLNGIEPGIELKRYYPSLKTCLLIAVTETKNQIQLDQFIKVCKELF

SEQ ID NO: 17173 - protein, 480 aa, Unknown
  Candidatus Protochlamydia amoebophila UWE25
MTKTIFEKSQFKQKAYSLPYSWENLKEFSLPKKFLRQTSVPLPEVSEIDLTRHFAVLAKRNMGIDTNFYPLGSCTMKLNPRINEWCANLPNFTRVHPLAPDHTVQGNLQIIDELIQMLCKVSGMTAGSLVPNAGAQGEFAGIQMIAAYHQHHGDFERNELLIPDNAHGTNPATAAMAGFKTISLRTNAQGDVDIDHLKSLVSDKTAGLMLTNPNTLGLFSSVIKEIAEIVHKVGGFLYYDGANLNSILNVARPGDMGFDVMHINLHKTFSTPHGGGGPGSGPVLCGDLLKPFLPNPRVEKENDHYVVKWKDSMSIGQIASFHGNFAIYLRAYLYAKLHGHYGLRKIAEVAVLNANYLKKRISKLFNIPFEQFCMHEFVVQADNYLGKGVRALDIAKRLLDYGVHAPTVYFPLIIKECMLIEPTESESKNTLDQFVSILERIVAEIHQDPQTVKNAPHQQSVSRLDEVLAAKRPILKHQAD

SEQ ID NO: 17174 - protein, 275 aa, Pyrococcus horikoshii
MPRKAREYPEEGEFVVATVKRIHNYGAFLELDEYPGKEAFMHISEVASTWVRNIRDYLKEGQKVVAKVIRVDPRKGHIDLSLRRVTQQQRKAKLQEFKRAQKAENLLRLAAEKLGKDFEAAWREVWVPLEEEWGEVYAAFEDAAKDGIEVLKGHVPDEWLPVLKEIVENYVEVPTVTIDAEFEITVPKPNGVEIIKEALIRARDRANKEKDIEVKFTYQGAPRYRIDITAPDYYKAEEVLEDIAEEILRVIKQAGGEATLLRKEKRIRKVKKRKK

SEQ ID NO: 17175 - protein, 249 aa, Listeria monocytogenes
MAEVHFVGAGPGDKELITLKGYQLLKEADVVIYAGSLVNPELLEYCKPDCEIHNSASMNLIEIIDCMEAGVTAGKEVVRLQTGDFSIYGSIREQVEEMKKRSIPFTCTPGVSSFLGAASSFGVEYTVPEVSQSVIITRMAGRTPVPSRESLRSYAAHQTSMVIFLSVQGIRKVVSELIKGGYKPETPAAVIYKATWAEEKKVTGTLEDIAEKVTEAGITKTALIMVGDFLGEEFYYSKLYDKDFKHEYR

SEQ ID NO: 17176 - protein, 63 aa, Oryza sativa
GKCYTAKVRTEEELKEAIEEAQGPKKECWCFIEVSVHKDDTSKELLEWGSRVSAAKSRPPEPQ

SEQ ID NO: 17177 - protein, 496 aa, Candida albicans
MTSTNKPPALKEDILELIGNTPLVKLNKIPQSLGIKAKVYAKVELFNAGGSIKDRIAKNMVLEAEKQGKIKPGYTLIEPTSGNTGIGLALVGAVRGYRTIITLPEKMSNEKVSVLKALGAEIIRTPTEAAWDSPESHIGVAKKLEKEIPNSIILDQYGNPANPDAHYYGTGYEIWEQTEGKITHLVAGAGTGGTITGISKYLKEKNSKIHVTGADPKGSILAEPESLNNSTEGYLVEGIGYDFIPDVLNRKYVDDWIKTDDAESFKLARRIIREEGILVGGSSGSALQAALQVAKDLTEDDTVVVVFPDSIRSYLSKFADDEWLISNGFEVEDSPGANKADEFLNGKTIKDLVAGKAPVVTVTLSDTVAKTFDLLQSNGFDQLPVLNNSGRLVGLITLSKILKSLSTKKIQTTNSISSIIIDFRKLADFEKSFTITKKSGFTKRSYEPIKLDTPLAALNKFFETNSNAIITDDELKPVQIVTKVDLLSYLTKNASF

SEQ ID NO: 17178 - protein, 420 aa, Oryza sativa
MAGEGSGGEGGAGAFEDEAEPTVTIGEYIEGIEAEELEADLVLGGDDGKECTYGGGYLKRQAVFSCLTCVPAGVAGVCTACSLACHDGHEVVELWTKRKFRCDCGNSKFGSHVCKLCPEKDPENPVNSYNHNFKGSYCTCGRPYPDPEAEKQVEMIQCCICEDWFHEDHIGLNSIEEIPRDEEGEPLYEDFICPKCSPKCYFLKLYPDTIWASNKQSSAPQAETTNSTVMNGNSSLGDIEKSENGALINHLNCEKTSDNENCPKDSVAPEKASLDDSSDGKCKLGMNICSNTPSADSEKKMPFFMSKSWREVICRCETCTDFYAQQGVAYLIDKEDSIEEYEKVAKQKREKKLEQQEGVEANFLNSLDHVQKIEILSGINDMKNELQSFLETFDSSKPVTSEDIRAVFENLAKKKKQRLS

SEQ ID NO: 17179 - protein, 545 aa, Oryza sativa
MELGLGMGMGLGDPPADYGSIAAVGMFVALICVCIVVGHLLEESRWMNESITALIIGLGTGGVILMVSSWKHSRILVFSEDLFFIYLLPPIIFNAGFQVKKKQFFRNFMTITLFGAIGTLISFSVISLGSLGLISRLNIGSLDLGDYLALGAIFSATDSVCTLQVLNQDETPFLYSLVFGEGVVNDATSVVLFNAMQNFDLANFSSVKFLQFIGNFLYLFATSTFLGVAAGLLSAYIIKKLYFGRHSTDREVSIMMLMAYLSYMLAELLDLSGILTVFFCGIVMSHYTWHNVTESSRVTTKHAFATLSFIAETFLFLYVGMDALDMEKWKIVGETFSPMKSIALSSTILFLVLVARAAFVFPLSFLANLTKKTEEGKISIKQQVIIWWAGLMRGAVSIALAYNKFTRSGHTQLPSNAIMITSTITVVLFSTMVFGLLTKPLIRLLIPARHLNRESSALSDPPSPKSFLDPLILNGSDVDPEIGVGIRRPTSLRLLLASPTQSVHHYWRKFDNAFMRPVFGGRGFVPFVPGSPTERSVPLLQGNEN

SEQ ID NO: 17180 - protein, 333 aa, Caulobacter crescentus
MHLARFPRARFAHLPTPLEPMPRLGAELGIDLWVKRDDCTGLAGGGNKTRKLEFLLGEALIQGADTLVTQGAVQSNHVRQTIAAGARFGLKTEVILEERTGSKASDYMGNGNVLLDKLMGASLRYVPGGTDMVAELDSTAENVRQRGGKPYVIPGGGSNTVGALGYVDCARELVVQADQMDLKIDRLVTATGSAGTHAGLVAGFAALSVDIPILGFGVRAPKPKQEENVYNLAVATAETIGAGGRVRREAVVADCDYVGEGYGLVDQGVIDALALAARTEGLLLDPVYSGKAMKGLIDQARKGAFKGERVVFLHTGGAQGLFGYQTVLEPALG

SEQ ID NO: 17181 - protein, 902 aa, Buchnera aphidicola
MKRMLINATQQEELRVALVDGQRLYDLDIEHSGSEQKKSNIYKGKITRIEPSLEAAFVDYGEEKNGFLPLKEISKNYFPENHIETLGFNIKNVLQEGQEVIVQISKEERGTKGAALTTFISLAGSYLVLMPNSPKSGGISRRIEGNDRIALKELLTLLELPEEMSLIIRTAGAGKSIESLRWDLSLRLQHWKTIQIIAKSRTAPFLIHQESNIIVRAFRDYLRQDIGEILIDNPKILDLARKHITFLGRPDFVNKIKLYSGEVPLFSYFQIETQINSAFQRKVRLPSGGSIMVDSTEALTAIDINSSRSTSGTDIASTAFNTNLEAVDEISRQLRLRDLGGLIVIDFIDMSAISHQRAIENRLREIARDDRARIQIGQISRFGLLEMSRQRLSSSLGESSHHICPRCTGTGTIRDNESLSLSILRLIEEEALKENTYEVRAIVPVEIACYLLNEKRDAVHAIEKRQAGGKTIIVPSKKMKTPHYSVSRIRKSESKNYTRYGLSNIRQSKITSFLKKNLLKKKQKEILDVANFNFYDNCYNKIQEAQENILKKNNYNNILLKVLSNNRNFIFKMITWFKNSFFIKNMLITSDIFKKNTLKNTNNIFFKKKYSSLNKKNNNQKKRVILSKLFEANIENIPLKNKKLDTSSANYLYDNIERKKNITKKNDLIQKNIHENSYLKHVLMNRYNVINIINNNYIFYKIFNRTKIFKNQNTNNSFLKFSSVTSPIFIFSSVFSLELALGKVWIKYPIAILDETKKQKKLNRKQILHISSISETNTIVNKNNYSGIKKIKHETYSFKKYVKNNIQNQEVTQSQLIKRTKKRNVFILDKKNFLYKRTCNRKNKIHQSSAPITKISKQSDLNKKEKEFHYNLSMMKSSLRGKNSAGVHSATNFSNSPVSKLK

SEQ ID NO: 17182 - protein, 92 aa, Triticum aestivum
  misc_feature (39)..(39): Xaa can be any naturally occurring amino acid
  misc_feature (43)..(44): Xaa can be any naturally occurring amino acid
  misc_feature (46)..(46): Xaa can be any naturally occurring amino acid
  misc_feature (48)..(48): Xaa can be any naturally occurring amino acid
  misc_feature (50)..(50): Xaa can be any naturally occurring amino acid
  misc_feature (52)..(52): Xaa can be any naturally occurring amino acid
  misc_feature (57)..(57): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(68): Xaa can be any naturally occurring amino acid
  misc_feature (73)..(73): Xaa can be any naturally occurring amino acid
  misc_feature (75)..(76): Xaa can be any naturally occurring amino acid
  misc_feature (78)..(79): Xaa can be any naturally occurring amino acid
  misc_feature (84)..(85): Xaa can be any naturally occurring amino acid
  misc_feature (90)..(90): Xaa can be any naturally occurring amino acid
SIGWSVGALLGYAQGASDKRVIACIGDGSFQVTAQDVSXCCGXXKXAXIXLXKNGGXTIEVXXHXGXXNVIKXWXXTXXVEAIXXGEEKXWT

SEQ ID NO: 17183 - protein, 1326 aa, Acidobacteria bacterium
MGLLSKFKIRRKLLIALLPLVVMAIIAVAYSSLQLRQVDSRYSELVTKDVHTLQNLIDARALCTRFWLLLYEQIAAENSTATLAEDAEFDKLANQVSTLISEAGEQSPRLTESARNTTFLFNQAINESRPVRDSNIAGDHVKALALMRDKTGPRLLVARDALESLIALQSKALDEESAALTVETNHTILIVWAFMGLGIVATFGFSLVVIQREVVDVILSFRDRVLDVAENRLDQKIEGLALPNEIGEMSRALHSLQTAAKERETQRWLKSEVATTIESLQKSESHEAFARTLLSRISESVGIVYGAAYFLDRARQRYVRSATFAFDGSGGSNEFAAGEGLAGQAVAEKRALQIHLSEQNELSIPAGIGVVRPAQLWFVPITTSDEVIGVVELASAGTLTAEQIELLHALLPAIALNLEILNANLATRKLLERTQQQAIEIAETEEKSRLILGSVDEGIAGMDAKGYITFINPAGADMLGYDQAGIVGAHLHSTIHYAHSDGSPYSRDDCPMYRTAITGEACAVDDEVLWRKDGGAFPAEYAATPVLKDGRAVGTVVAFRDITERKKNEAELRRAREAAEDATRTKSDFLANMSHEIRTPMNAIIGMSHLALKTNLSPQQRDYLNKIQISSHHLLGVINDILDFSKIEAGKLNVESIDFSLEKVLETLANLIGEKASAKGLELIFDISPDVPHNLIGDPLRLGQILTNYASNAVKFTEHGEIVIGAKVQERTDDEVLLYFAVRDTGLGLTAEQKARLFQSFQQADTSTTRKHGGTGLGLAISKQLSALMHGEVGVESEPGKGSTFWFTARMGIGQSKADKYLPVSDLRGRRVLVVDDNESARKVLDEMLSSMTFQVTTANGGHEAIDQVRQAAQAESPYDIAFLDWRMPGMDGIETAKAIRGLGLERSPRMVMVTAYGREEVMRGAAEAGIEDVLIKPVGASLLFDTIMAVLGGSRQEDRQSEGSDNAIAAHLADLKGAVVLLAEDNEFNQQVATGLLNEVGVNVEIAGDGKQALARLAERTYDAVLMDMQMPEMDGLAATREIRKQARFKDLPIIAMTANAMEQDKERCIAAGMNDHIAKPIDPDHLFNTLLKWIKPRSQAAPEAKATAVKPPAVAVALPTIEGLDTAQGLQRVMGNKTLYTGLLQRYITNQKSVCAELRAALAAGDRQTAERIAHTAKSVNGNIGAGQLQELAAEMENMIRSGADVPTVGERVSVFAEIQQKLISALSAAFPAEESVVQSAPVDAAKLAAVSQELLRLLKDDDSASTDLLQEHRDLLRSAYPEHFRTIENSIRAFNFEAGLAALTKAMESLPQGETHGQSAGTT

SEQ ID NO: 17184 - protein, 309 aa, Unknown
  Nocardioides sp. JS614
MNIYDDVTQLVGNTPLVRLNRVVGDAGATVLAKLEFYNPANSVKDRIGVAMIDAAEAAGVLAPGGTVVEATSGNTGIALAMVGAARGYRVVLTMPETMSRERRALLRAFGAELVLTPGSEGMTGAVRKAEEIAETTGAVPVRQFANAANPAIHRDTTAEEIWKDTDGEVDILVAGIGTGGTITGVGQLLKERKPDVQVIGVEPAESPILNGGAPGPHKIQGLGANFVPEILDTTVYDEVLDVPVEEAVTWARRAATEEGLLVGLSSGAAISAAVQVAQRPENAGRTIVVIVPSFGERYLSTLLFEGLVD

SEQ ID NO: 17185 - protein, 459 aa, Glycine max
MASEEAECISNLFKPIYLKEVAELRQYVPNLQSRPNPLDHNPYFDTRQLQQQQGFYLTESDVLLRQIGNDLSPSPRFAYHRAGPRKNIYFDPSIVRVAIVTCGGLCPGLNTVIRELVVGLWQLYGVRHIFGITAGYRGFYSSVPLPLNPKLVHHWHNVGGTLLQTSRGGFDLHNIVDAIQTHAFNQVYIIGGDGTMRGAVKIFDEIKHRKLEVAVVGIPKTVDNDVGIIDRSFGFQTAVEMAQEAISAAHVEAESAVNGIGLVKLMGRSTGHIALHATLSSRDVDCCLIPEIDFFLEGKGGLLEFLGQRLKENGHAVLVVAEGAGQDIIPRTDSQKDERDESGNPVFLDVGVWLKSELNKWWKREHPNELFTVKYIDPTYMIRAVHANATDNLYCTLLAHSAIHGVMAGYTGFVAGPINGNYAYIPLEDVARANNPVDTQDHKWSWVRSVTNQPDFVRR

SEQ ID NO: 17186 - protein, 201 aa, Zea mays
MEPKSTTPPPPPVMGAPIAYPPPPGAAYPAGPYVHAPAAALYPPPPLPPAPPSSQQGAAAAHQQQLFWAEQYREIEATTDFKNHNLPLARIKKIMKADEDVRMIAAEAPVVFSRACEMFILELTHRGWAHAEENKRRTLQKSDIAAAVARTEVFDFLVDIVPRDEAKDADSAAMGAAGIPHPAAGLPAADPMGYYYVQPPQ

SEQ ID NO: 17187 - protein, 592 aa, Ralstonia eutropha
MFNLTPLHMADCARSSRRPVYRGLLLTFMSDLQTNESFAALFEESIARSNMKAGEVISAEVVRIDHNFVVVNAGLKSEAFVPVEEFLNDQGELEVQAGDYVSVAIDALENGYGDTILSRDKAKRLASWLNLEKALEDGEIISGTVTGKVKGGLTVMVNGIRAFLPGSLVDVRPIKDTTPYEGKTLEFKVIKLDRKRNNVVLSRRAVVEATLGEERQKLMETLKEGAIVNGIVKNITDYGAFVDLGGIDGLLHITDLAWRRVRHPSEVLSVGQEITAKILKFDQEKNRVSLGVKQLGEDPWVGISRRYPQGTRLFGKVTNLTDYGAFVEIEAGIEGLVHVSEMDWTNKNVAPSKVVQLGDEVEVMVLDIDEDKRRISLGMKQCKANPWDDFSRNHKKGDKLSGQIKSITDFGVFIGLPGGIDGLVHLSDLSWQETGEEAVRKYKKGDEVEAVVLGIDVDKERISLGIKQLSGDPFNNFISANDKGSLVTGTIKAVDPKGAVVQLADDVEGYLRASEISADRVEDARNVLKEGEQITALVVNVDRKSRNINLSIKAKDNVEQQEAMQKFQADTSTAGTTNLGALLKAKLGQDNQ

SEQ ID NO: 17188 - protein, 175 aa, Glycine max
KYHFCETSKLNKGSLRDYSKTYARSKYYDEAKPWSERCDVAFACASQNEIDQSDAINLVNSGCRILVEGSNMPCTPEAVQILRKASVLIAPAMAAGAGGVVAGELELNHECSLMHWSPEDFESKLQEAMKQTYQRAMKAATDFGYQKESPEALVHGAVISAFLTIAQAMTDQGSI

SEQ ID NO: 17189 - protein, 507 aa, Staphylococcus aureus
MLNADLKQQLKQLLELMEGNVEFVASLGSDDKSKELKDLLTEITDMSPRLSLSEKSLKRTPSFSVNRPGEETGVTFAGIPLGHEFNSLVLAILQVSGRAPKEKQSIIDQIKKLEGSFHFETFISLTCQKCPDVVQALNLMSVINPNITHSMIDGAVFREESENIMAVPAVFLNGEEFGNGRMTIQDILSKLGSTADASEFENKEPYDVLIVGGGPASGSAAIYTARKGLRTGIVADRIGGQVNDTAGIENFITVKETTGSEFSSNLAAHIDQYDIDAMTGIRATDIEKTDEAIKVTLENGAVLESKTVIIATGAGWRKLNIPGEEQLINKGVAFCPHCDGPLFENKDVAVIGGGNSGVEAAIDLAGIVNHVTLFEFASELKADNVLQDRLRSLSNVDIKTNAKTTEVVGEDHVTGIRYEDMNTGEEHLLNLDGIFVQIGLLPNTSWLNDAVELNERGEIVIDRNNNTNVPGIFAAGDVTDQKNKQIIISMGAGANAALNAFDYIIRN

SEQ ID NO: 17190 - protein, 195 aa, Azotobacter vinelandii
YRDNGIDLRLGCKVVDIDRENREVTRSDGSHAQYDRLLVATGSSPFILPIPGKDLQGVIGYRDIADTRAMMETARSHRHALVIGGGLLGLEAANGLRLRGMEVTVVHLGDWLLDRQLDRTAGKLLQNAGGTRASRFRLNTNTAPCSTMPGRVASAHFSDGEECPADLVVMRAGIRPNVELAERAGLECDRGIRVD

SEQ ID NO: 17191 - protein, 419 aa, Alkalilimnicola ehrlichei
MFSRDMTIASFDPELSEAMEAERRRQEDHIELIASENYASPRVLEAQGSVLTNKYAEGYPGKRYYGGCEHVDEAERLAIERAKQLFGADYANVQPHSGSQANAAVYLALLQPGDTILGMSLDHGGHLTHGAKVNFSGRLFNAVQYGVCPDTGELDYAQLERLAKEHQPKMIIGGFSAYSRVVDWQRLRDIADSVGAYLLVDMAHVAGLVAAGVYPSPVQIADVTTTTTHKTLRGPRGGLILARANAEVEKKLNSLVFPGTQGGPLMHAIAGKAVAFKEALEPEFKAYQQQVVANARAMAQGLIERGYKVVSGGTDNHLFLIDLVDKGLTGKAADAALGKAHITVNKNTVPNDPQSPFVTSGLRIGTPAITTRGFKEEECRELAGWMADVLDDIENEDVIARVREQVTQVCRRLPVYQQG

SEQ ID NO: 17192 - protein, 315 aa, Triticum aestivum
MGGTPRSSIGHILPGAGFFTVGLWHLFNHIRLFSQRPDSYVAPVWFPVPRARYLEPALVIAGSALEFVMEMFVDHSTFLPFDADGSIPSDRLHNHEHAIICLALIVYAGGAVHLDRARAPGRRALCLLLVSVVFAQELLVFHFHSTDHAGVEGQFHWILQVVVAACLGTALLGVGFPRSFAVSLARSACIMFHGVWLAVIGAMVWVPSMVPKGCSLVREDGRDTVRCHSKASLHRARALVNLQFGWYLSFMTVLVLAVYLYVCSKYPADQPYARLLRKAGDEEEEHDLEARKCGVPRDGGSDVHARGFAPLEIQV

SEQ ID NO: 17193 - protein, 471 aa, Chromobacterium violaceum
MSKRYRTALVWLRRDLRLDDHAAFYHALKHSEAVLPVFVFDASILAALPRDDRRVDFIWQSAAALKAELNQLGGDLLIRHGLPQHEIPRLAAELGAEAVFCNRDYEPAARARDAEVAQRLAEQGVAFRDSKDQVIFETDEVLTGAGKPFSVFTPYKNAWLKKLTPFHLQAYPVRRYLDALMPREPQSMPSLADIGFLPSDLASLPVKAGAAGAEALFADFAGRIERYKAQRDFPGVKGVSYLSVHLRFGTLSIRRLAAYAWHDGGEGAMTWLSELIWRDFYQQVLWHRPDAAKHAFKPEYDALPFPNDPEWFDAWREGRTGYPLVDAAMRQLNRSGYMHNRLRMVAASFLVKDLLIDWRWGEQYFAEKLLDFDLAANNGGWQWAASTGCDAQPYFRIFNPVSQSEKFDPDGRFIRRYVPELAALPDKLIHAPWQAKPEQLMSAGVRLGRDYPHPIVDHAVQRELALALFKR

SEQ ID NO: 17194 - protein, 340 aa, Prochlorococcus marinus
MKEKSNIFNRDKPLTVMITGGSSGIGFQAVLKLISLGHNIILPCKNISRANEVLTNLFNHSLDESSNKGEIYTPIMDLSDLSSIDSLCSEVKNRRWTIDVLILNAGLQYTGSKTPRRSTQGIELTFAVNHLSHFYLTQKILPFIDIRNDPKIIITSSEVHNPNSGGGKVGAKASLGKLKGLISGAGFEMIDGNKFNADKAYKDSKLCNILFARKLSDNFMKKKLSIPVIAWAPGLVISRDNQGFFRYSRKYNQLGQILFAFLARDILKITTSNKKAGLLLSNLACLSKYTKPGFNYYSNKIISSGKFIFDETEISNDAQRGDLSDNLWELSKSLIDKINK

SEQ ID NO: 17195 - protein, 447 aa, Unknown
  Azoarcus sp. EbN1
MRYKSLEEFLSHVEQRNPGQPEFIQAVAEVMESLVPFITEYPRYAEHGLLDRLIEPERAIQFRVSWVDDRGEVQVNRGYRIQHSSAIGPFKGGLRFHPSVNLSVLKFLAFEQTFKNALTTLPMGGGKGGSDFDPKGRSPGEVMRFCQSFMTELYRHVGSDTDVPAGDIGVGGREIGFLAGMMKKLSNKASCVFTGKGLSFGGSLIRPEATGYGMVYFAEEMLRHVGKTMAGMTVSVSGSGNVAQYGIEKAMALGAKVITASDSSGTVIDEAGFTPEKLAVLMDVKNVHYGRVSEYAERLGLHFEPGRRPWHVPVDIAFPCATQNELDGDDAAVLVRNGVSCVAEGANMPSNAAAVRVFEKNGVLYAPGKASNAGGVATSGLEMSQNAMRLSWTREEVDGRLLEIMQGIHHMCLQYGTKPDGSVNYSDGANVAGFVKVADAMLSQGVI

SEQ ID NO: 17196 - protein, 696 aa, Marchantia paleacea
MAARTIVWFRRDLRVEDNPALVAAARAGIVIPVFIWSPEEDGQFHPGRVSRWWLKQSLIHLDSSLKSLGSPLIMRKSPDTLTVLLDIVQQVGATQVFYNHLYDPVSLVRDHRVKQGLSIHNIPVHTFNGDLLYEPWEVYDDEGQAFTTFDDFWDKCMNMPFEPEAPLLSPRRLVGLPPGRISVGRIDDLGLENEYERSSNALLGRAWAPGWSSANKALEVFMKGPLHDYATHRIKADNANTSQLSPHLHFGEVSVRKIFHEARTKQILWARENSYVGEQSVGMFLRAIGFREYSRYLSFNFPFTHERSLLANLKSFPWRIDENSFKSWRQGRTGYPLVDAGMRELWATGWLHNRIRVVVSSFCVKFLQLPWRWGMKYFWDTLLDADLECDVLGWQYISGSLPDGHELDRMENPQIEGYKFDPEGEYVRRWLPELSRLPTEWIHHPWDAPANVLRAAGVELGSNYPLPIVDISSARDQLQQSLAEMWEREAASKAALANGSEEGLGETVETPGSCGPGVKMDVHRVVIRSSRAACSTASSRRDQLVPCMPTEDHKLAAASIMNWNQSPVDEEDEPVQPAFVPSQTGGLLDRPSDVRAEVIAHPPSDSSMAEAVHVDNELNSTAESSAAVGRRSEESRGEVPVWPQSSSSRPQRPHLEGLVPVVPEVRRATMNRRHLHSMQMVNLEARTSHKTSSLSA

SEQ ID NO: 17197 - protein, 185 aa, Triticum aestivum
  misc_feature (170)..(170): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCXESGKALNSSLTTGHI

SEQ ID NO: 17198 - protein, 129 aa, Burkholderia xenovorans
MTTRIALIAHDHKKDDIVKLAGEYVDTLRRCDIVATGTTGGRIADAHGLAVERMLSGPHGGDLQIGAQLAEGRVDMVIFLRDPMTPQPHEPDINALVRACDVHNIPCATNISTARMVLDSLTLRLTQQV

SEQ ID NO: 17199 - protein, 540 aa, Unknown
  Azoarcus sp. EbN1
MNLSQALLTALRDHGAREIFGIPGDFALPFFKIIEESGILPLHTLSHEPGVGFAADATARYRCCLGVAAVTYGAGALNMVNPVAGAYAEKSPVVVISGAPGAGESHSGLLLHHQAKTLDSQFEIYREITCDQARLTDARSAPREIARVLASCLRESRPVYIELPRDMVGVPCEPVIPLVPPASDREVLSACVDEILVRLRSAASPVLMVGVEVRRFGLEAKAAELARRLGVPVVTSILGRGLLAGTDAPLVGTYLGVAGQQQVTDLVEQSDALLLLGVIISDTNFGVSSKQIDLRKTIQALDRRVTLGYHTYPEVPLAALVDALLERLDKKIAPAMRFDPPHYPRGLQADDASITPNDIALAINDLMDTHGRMPIAADVGDCLFTAMDIEPTALVAPGYYATMGFGVPAGLGLQAASGVRPLILVGDGAFQMTGWELGNCRRYGWDPIVIVFNNSSWEMLRTFQPESAFNNLDDWRFAAMADGLGGDGARVGTRAELKAALDHALATRGRFQLIEAIIPRGVLSDTLSRFVAGVKRLSQK

SEQ ID NO: 17200 - protein, 326 aa, Solanum lycopersicum
SGNGQSCYNQQQQKNPPQQQTQGFFTRELNFSEFGFDGSSNRNGNSSVSCKPESGEILNFGDSTKKSASSANVNLFTGQSQFWGLGEENNNKNQEKISYFRGSNEEGMLSFVSGTVCFFGHEVRWRRRQDSEHSDLEASVVKEADSSRVVEPEKRPRKRGRKPANGREEPLNHVEAERQRREKLNQRFFSLRAVVPNVSKMDKASLLGDAISYINELKSKLQNTESDKEDLKSQIEDLKKESRRPGPPPPPNQDLKMSSHTGGKIVDVDIDVKIIGWDAMIRIQCNKKNHPAKANGSAHGIRPRRASCQCFSCQRFDDPTSHSENG

SEQ ID NO: 17201 - protein, 164 aa, Candida glabrata
MAAKSFYELECKDKKGETFKFDTLKGKVVLIVNVASKCGFTPQYKDLESLYQKHKDEGLVILGFPCNQFGGQEPGSQEEIGNFCQLNYGVTFPIMHKIEVNGDNTDPVYDFLKSQKSGLLGLNRVKWNFEKFLVDKHGKVHQRYSSLTKPMSIEDDIKQLLAQK

SEQ ID NO: 17202 - protein, 493 aa, Listeria monocytogenes
MGKVMLIGAGPGDAQLLTVKGLAALQKADVIVYDRLVEPAMLQERKASCKLIYVGKEPLHHPIPQEEIEQILVKEAATNELVVRLKAGDPYVFGRGGEEGETLYKAGIPFEVIPGITSAIGGLAYAGIPVTHRDFASSFHVITGHLKKGRDPLDWEALARLEGTLVFLMGMTNLPNICANLLENGRKAETGVAIVQWASRGKQLTVTGNLQNIEQKVAESGISSPALIVVGDVVSLRPQLNFFEEMPLFHTKVLLPRARAGKSMLAEQIRDLGGEVTMYPNIQVVDVVPTKTKEELSEVSELLFTSKEAVERFFDYLAQLDLDIRSLKNTHLTAIGKQTKEAFSEKGIIPDSFIKRRSTELILEHLPRLQKNVSNLIIGSIVDTAEVNAILAEVEAMEMMPLYDMRPVTERPFDLASFEQVCFSSSRSVQNLLDVLTTEEKAILQTKTILSIGRFTSATLASFGINNFIEAESATPESLIELIQKTKLEGVPQ

SEQ ID NO: 17203 - protein, 154 aa, Lupinus luteus
MGVLTDVQVALVKSSFEEFNANIPKNTHRFFTLVLEIAPGAKDLFSFLKGSSEVPQNNPDLQAHAGKVFKLTYEAAIQLQVNGAVASDATLKSLGSVHVSKGVVDAHFPVVKEAILKTIKGVVGDKWSEELNTAWTIAYDELAIIIKKEMKDAA

SEQ ID NO: 17204 - protein, 326 aa, Mesorhizobium loti
MNKPVTSARVPGRGRIYSSITDTIGDTPLVRLDKFAKEKGVVANLVAKLEFFNPIASVKDRIGVAMIEALEAAGKISPGKTTLIEPTSGNTGIALAFAAAAKGYKLILTMPETMSVERRKMLALLGAELVLTEGPKGMKGAIAKADELAATIPNAVIPQQFENPANPEIHRKTTAQEIWNDTQGEVDIFVAGIGTGGTITGVGQVLKKLKPSLHVVAVEPEASPVLSGGQPGPHKIQGIGAGFAPKILDTTIYDEIIKVSNEDSVANARLVARLEGVPVGISSGAALQAAIVVGSRPENKGKTLVVVIPDFAERYLSTILFEGLGA

SEQ ID NO: 17205 - protein, 184 aa, Vibrio cholerae
MAVTPVSRANHVVAVALSKIFVNSKIKCTQKANFPKNRYPESKELLMSNHRILHTMLRVGDLDKSIEFYTQVMGMSLLRKNENTEYKYTLAFLGYGDESQGAVIELTYNWGVADYEKGNAYGHIAIGVDDIYATCDTIKAAGGIVTREPGPVKGGTTHIAFVKDPDGYMIELIQNKQAHAGLEG

SEQ ID NO: 17206 - protein, 702 aa, Streptomyces avermitilis
MQVWPGEAYPLGATYDGAGTNFAVFSEAAHRIELCLLHDDGSETAVELRETDAFVRHAYLPGVMPGQRYGFRVHGPFAPGRGVRCNSAKLLLDPYAKAISGEIKWGEEVYGYHFGAPDKRNDLDSAPHTMTSVVINPYFDWGNDRRPRTEYHHTVLYEAHVKGLTMRHPALPEELRGTYAALAHPAIIEHLTELGVTALELMPVHQFVNDHRLVDMGLNNYWGYNTIGFFAPHNAYASWGDRGQQVLEFKSAVKALHEAGIEVILDVVYNHTAEGNHMGPTLSFKGIDNASYYRLTDDPRYYMDTTGTGNSLLMRSPHVLQLIMDSLRYWVSDMHVDGFRFDLAATLARQFHEVDRLSSFFDLVQQDPVVSQVKLIAEPWDVGEGGYQVGNFPPLWTEWNGKYRDTVRDMWRGEPRTLAEFASRLTGSSDLYQDDGRRPLASINFVTCHDGFTLHDLVAYNDKHNQANGEDNRDGESHNRSWNCGAEGDTDDPAVLALRARQMRNFIATLMLSQGVPMLSHGDEFARTQGGNNNAYCQDGELSWVAWPEDGSELLEFTRAMVWLRRDHPVFRRRRFFHGRPVEGTHDELSDIVWFTPTGEEMIQRDWDSAQARALTVFLNGTAISEPGPRGERISDDSFLLMFNASPKSLEFVVPVDHGRQWQVVVDTARTDGIPPGTVAKVKAGDRLTLVDRSLTVLQRPA

SEQ ID NO: 17207 - protein, 820 aa, Oryza sativa
MKAWGVMRERAYAFDLVLTEVTMPTLSGIELLSRIVASDECKNIPVIMMSSQDSIGTVLRCMQKGAVDFLVKPVRKNELRNLWQHVWRRHAMNSQTNASENNAASNHLSANGGNGSKTGEHSDEESDAQSSGSKREVEIQSAEKLPEVVADGGAGSSREHKIQNGFIDGMNTKSHALKGNDDAPSGNACGDSELQVLSTEKNVRSKFLNGITSAKVAGQIMDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRKDSLTHPSYGFIPVPIPVGAAIPYHYGAIMQPMYYPQGAFMHCDSAAINKTAIQHVSCQSNYHENLGKPPQIDEHKQPEENHQLHHSRQILRESGEPVDLAKAHMERINQSASCSQDIRKGSGCTGSGETDANTNTVIALESGNESGVQNCSNNVLDGDRSRREAALLKFRMKRKDRCFEKKVRYHSRKKLAEQRPRVKGQFLSSISNGGRRSSGGAGRDAGRVRDRLAVGGVLRRRRGAGREPAVRQRVRDVPDDMHVAAAAASARAAVVVVAVDAVRAAAVLGASAAVPDAAAPAAISGGRERHVPASGGADDDEPAAITAASTVVTTAADDEEQQRVDGVAAVVLVPLLIAAVSAVVVQPVLLLLPLRQRQALRRRRRGERLHGADPSGVAAHRHIPDVTTRTNFSARYDRN

SEQ ID NO: 17208 - protein, 306 aa, Schizosaccharomyces pombe
MSTTSCRMYENRFPEVDELVVVNVRQIQEMGAYVKLLEYDNIEGMVLLSELSRRRIRSVQKHIRVGRNEVVVVLRVDKEKGYIDLSKRRVSPEDVVKCEERFNKSKAVHSIMRHIAEKHNVPLETMYTTIGWPLYRKYGHAYDAFKLAISNPDHVFEGLEPPKSGVINDLLAQISRRLTPQPIKIRADVEVTCFGYEGINAIKAALKAAEDVHTEEVPIKVKLVAPPLYVLLTNALDKSLGLKKLEEAIGAIEKSITASNGTCTVKMKPKAVSETDELELADLMKKFEKENAEISGDEEDDQSGSE

SEQ ID NO: 17209 - protein, 570 aa, Schizosaccharomyces pombe
MSSEKVLVGEYLFTRLLQLGIKSILGVPGDFNLALLDLIEKVGDETFRWVGNENELNGAYAADAYARVKGISAIVTTFGVGELSALNGFAGAYSERIPVVHIVGVPNTKAQATRPLLHHTLGNGDFKVFQRMSSELSADVAFLDSGDSAGRLIDNLLETCVRTSRPVYLAVPSDAGYFYTDASPLKTPLVFPVPENNKEIEHEVVSEILELIEKSKNPSILVDACVSRFHIQQETQDFIDATHFPTYVTPMGKTAINESSPYFDGVYIGSLTEPSIKERAESTDLLLIIGGLRSDFNSGTFTYATPASQTIEFHSDYTKIRSGVYEGISMKHLLPKLTAAIDKKSVQAKARPVHFEPPKAVAAEGYAEGTITHKWFWPTFASFLRESDVVTTETGTSNFGILDCIFPKGCQNLSQVLWGSIGWSVGAMFGATLGIKDSDAPHRRSILIVGDGSLHLTVQEISATIRNGLTPIIFVINNKGYTIERLIHGLHAVYNDINTEWDYQNLLKGYGAKNSRSYNIHSEKELLDLFKDEEFGKADVIQLVEVHMPVLDAPRVLIEQAKLTASLNKQ

SEQ ID NO: 17210 - protein, 558 aa, Unknown
  Silicibacter sp. TM1040
MAQTTSMEEFEALLQESFEMDTPEEGSVVKGKIIAIEAGQAIIDVGYKMEGRVELKEFANPGEAPEVSVGDEVEVYLRAAENARGEAVISREMARREEAWDRLEKAYADDQRVEGAIFGRVKGGFTVDLGGAVAFLPGSQVDVRPVRDAGPLMGLKQPFQILKMDRRRGNIVVSRRAILEESRAEQRAEVIGNLSEGQAVDGVVKNITEYGAFVDLGGVDGLLHVTDMAWRRVNHPSEILSIGETVKVQVIKINKETHRISLGMKQLQEDPWDLVGAKYPLESVHKGRVTNITDYGAFVELEPGVEGLVHVSEMSWTKKNVHPGKIVSTSQEVDVMVLEIDGAKRRVSLGLKQTMRNPWEVFAETHPEGTQVEGEVKNITEFGLFIGLDGDIDGMVHLSDLSWDERGEDAIQNYRKGDMVSAVVSEVDVEKERISLSIKALGGDKFADAVGGVKRGSIVTVEVTAIEDGGIEVEYEGMKSFIRRSDLSRDRAEQRPERFSVGDKVDVRVTNIDSKTRRLGLSIKAREIAEEKEAVEQYGSSDSGASLGDILGAALKSE

SEQ ID NO: 17211 - protein, 466 aa, Buchnera aphidicola
MNRVSISDIYKDDIIVNSLITVCGWVRNRRSSKSGFSFITIYDGSCFNSIQVIANNTLPNYYKEILHLTTGCSVMLSGKLILSIGDKQKYEIQLKKIKVLGWVENPETYPISSKKHSTEYLREVAHLRSRTNLIGAIARIRNYILHSLHHFFYKEKYYWVPTPIITSLNTEGAGEMFRVSTLDMENIPKNLDSSVDFKKDFFGKESFLTVSGQLNLETYACSLSKVYTFGPTFRAENSNTGRHLAEFWMLEVESAFTDLNDISDFAECMLKYVCKSLLKKCITDINFLENYTNSNIVDRLEKFLLVDFVRIDYVEVINILLDSKIKFNNSVFLGIDLSSEHERFLVENYFKIPVIVKNYPKELKAFYMRLNNDKKTVAAIDILVPNVGELIGGSQREERIAILDERLLELGLKKEDYWWYRDLRRYGTVPHSGFGMGFERLISYFTGITNIRDLIPFPRTVNNAYF

SEQ ID NO: 17212 - protein, 455 aa, Acidobacteria bacterium
MSEAFDSRASKALPIEVLISPFVRFARMEAASGILLIVSTAAALVWANSPWKSSYDAIWDVPMVAGVGNFLLTESRHHWINDGLMSIFFFLVGLEIKREVLIGELTSLRNAAFPLIAAVGGTVVPAVIYLLCVGGGVAQKGWGIPMATDIAFALGVLILLGNRIPPSLRVFVTALAIVDDIIAVLVIALFYTHEIHLVSLLVALGGVGIAFGFNLLGISKPSVYALIGVCIWAAVLKSGVHATVAGVLLAFTIPARNYLDRDFFVKRGRWLLERFEKSEPHSFESHTAIHTLQHQCDMIESPLHRLEHGLQPWVSFLIMPLFAFSNAGVRFIGNIGVAVKHPVSIGVALGLFLGKPLGIWLFAWLAVKSRVANAPPELSWWQIFGASWICGIGFTMSLFIASLAFGYGNLLDMSKIGTLAASLVAGVCGSVVLWRRSALGTSEPPVSPATTSASV

SEQ ID NO: 17213 - protein, 415 aa, Thermotoga maritima
PEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRRELERLSRRFFREIQVIIGPYNDIPAPDVNTNADVIAWYMDEYEMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 17214 - protein, 747 aa, Novosphingobium aromaticivorans
MRKFSVSKVALLAATMAPALLPAAARAEGTAAPAATAPATPMSNRDWWPNRLDLSPLRQHGVESNPMGGKFNYAEEFKTLDLAAVKKDIEALMTTSQDWWPADYGHYGPFFIRMAWHSAGTYRTADGRGGAGGGQQRFEPLNSWPDNVNLDKARRLLWPIKQKYGRKISWADLMVLTGNVALESMGFKTFGFAGGRADDWEADQVFWGPENKWLADQRYHGDRKLQNPLAAVQMGLIYVNPEGPNGNPDPLLAAKDIRETFGRMAMNDEETVALIAGGHTFGKAHGARKPEGCVGVDPAAGAVEDQGLGWNNKCGKGNAEDTVSSGLEGAWTANPIAWTTQYLDNLYAFEWVQTRSPAGAIQWVPKEDATFVPDAHVKDKLHKPIMFTTDLALKTDPAYRKITTKFRQNPDAFADAFARAWFKLTHRDMGPRWRYLGAMVPAEELIWQDPVPKATYAMIDAADVSALKGRILATGLTGPELVRAAWASAASFRGTDMRGGTDGGRIRLAPQKDWAANNPAELARVLKALEGVATEFNRAAKDGKKVSVANLVVLGGNAAIEQAAAKAGVTVEVPFTPGRTDASQAQTDVASFEFLKPAADGFRNYYDASANRLSPSEMLVERANLLTLSVPEMTVLVGGLRALDANAGGARHGVFTDRPGTLSNDFFVNLLGMETKWQKAATDGVYEGLDRKTGKTRWTATPVDLVFGSNSELRAVSEVYGSADANAKFVNDFVAAWTKVMNLGRPS

SEQ ID NO: 17215 - protein, 144 aa, Unknown
  Dehalococcoides sp. CBDB1
MERITLALVAHDNKKQEMVELVKKHETDLASLNLVATRTTGKLIQASTSLNVTLLQSGPLGGDQQIGAMVASGVVTAIIFLRDPLTAQPHEPDISALMRVCDVHNVPLATNVSTAEAVLHLIFEHPEELKEHRLKSQLLNSLNS

SEQ ID NO: 17216 - protein, 1159 aa, Cryptococcus neoformans
MRRVSAPPLRQRLLPPRRLLSRSPAPARTLQTTSAIAFPRSPTPRRTFAAASSPSQPPPPSPPPPPDAPPAATGRDLLSYATAVVPPSPPASAIPPDLQPALTHLATGFLPRNQHLAPDPATSPFTHVISFPPGAHGRAQTDPAREEEDSEPAPENVIALASPFEGGDVYVQEAVQALANEMEADVVRLDLVMGVALDGMAAPLGVFGPPALAHSLNPLYQAAPSPFPNLRKESREADDQEEGMGLGFTSMPVAVLGGGGLPMPQMGHMGQQEEDFVAGRANEEWIAFFSRIINAETAEAGKKRIVVLESPLAMSKTFPVWWPSLVEAVQRRRRGLITPGRKKMIPKNGSAEPSLVHPTSIVLQCTPSPLLPHTSPSMFAPTEKEDHELAAEEHVEDVDEQEEATHAAISALEDKFRSMGFNVHHHVEVVKPRSGAKLWWGNEESDPAGRREGDQSRLKAILGKGLSSVLPPFDGQSSDSGNQSRNPLQRLLMSRMGHVNRSEQNESSGAPLVWKAFPIVPLHRNFDAEKESRTLRRRIYSAALITRAVYQLGGELQDPLEILKLSESTGRPLTRKTGPSSVSKGWGNAVVSWSDALHIASIAVGRAVQNGQVDGGGATVHWADIIAARQAAVEEKTMTADQISKHIPAALKRDGAGPAAKGAKKEEAQQVVDPVVENLRKDKKLSQHEKRLLNCIVDPSKLASTTFRDVHLPEKTIDGIRSMISLPLLFPEAFRGGVLKDHATTGALLFGPPGTGKTLLARAVAAESGARMLAIQPSDVNDMYVGEGEKLVKAVFSLARRLSPCVVFLDEVDALFGARISRGSSGSMSHNLILTEFMQEMDGLSSAIANKDKRVVVIGATNRPFDLDDAVMRRLPRRLLVDLPGVEDRKAILEILLRGEQLGEDVHLDQIAKETDGFSGSDLKHLCVSAALSAVKDTVSVPWRHLSPSSVVSSSLGSEERPRTPLPGGDGRGRGGGGGGLGNEVLVMAPTEGGGGGGGGRKKVRVKKEKASATASYGEESISSAAREESESPDEEQEQLGVGEVPEQVEEEQLLSADRTRDASPSEDAPEPAKPPPIEEEQTVPKRVLMHKHFKTALEEIRPSASEEGSLPELRKWAEQFGEGGKRRGKKSGFGKGFGFSDEPVRDRDTGYGKVRQDD

SEQ ID NO: 17217 - protein, 608 aa, Ipomoea batatas
MATITASHFVSHVCGGATSGESKVGLGQLALRSQAVTHNGLRPVNKIDMLQLRTSARNLAKMEGKMRVEWQAGTIVCKQQGMNLVFVGCEEGPWCKTGGLGDVLGGLPPALAARGHRVMTVCPRYDQYKDAWETCVVVEPQVGDRIEPVRFFHSYKRGVDRVFVDHPMFLEKVWGKTGSMLYGPKAGKDYKDNQLRFSLLCQAALEAPRVLNLNSSKYFSGPYGEDVVFVANDWHTALLPCYLKTMYQSRGIYMNAKVAFCIHNIAYQGRFAFSDFSLLNLPDEYKGSFDFIDGYDKPVKGRKINWMKAGIREADRVFTVSPNYAKELVSCVSKGVELDNHIRDCGITGICNGMDTQEWNPATDKYLAVKYDITTVMQAKPLLKEALQAAVGLPVDRNIPLIGFIGRLEEQKGSDILYAAISKFISMDVQILILGTGKKKFEQQIEQLEVMYPDKARGVAKFNVPLAHMITAGADFMLIPSRFEPCGLIQLHAMRYGTPCICASTGGLVDTVKEGYTGFHMGAFNVDCETVDPEDVLKVITTVGRALAIYGTLAFTEMIKNCMSQELSWKGPAKNWETVLLSLGVAGSEPGVEGEEIAPLAKENVATP

SEQ ID NO: 17218 - protein, 328 aa, Flavobacteria bacterium
MSEQIERVKCLIIGSGPAGYTAAIYAARADMKPLLYTGMEPGGQLTTTTEVDNFPGYPEGIDGPTMMVDLQKQAERFGTEVRIGMVTEVNFASEQGGIHTAIVDGKTKIEAHTVIISTGATAKYLGLPSEQRLRGGGVSACAVCDGFFYRGQDVAIVGAGDTAAEEATYLANICSKVTMLVRKGEMRASKAMQHRVAQTENIEVLFNSEVDEVLGDQVVDGLRIVNNQTNEKHDIAITGLFIAIGHKPNTDIFKGQLDMDEAGYLKTKAGSTYTNMPGVFASGDVQDKIYRQAITAAGTGCMAALDAERYLAEVGIVEEVIAGDYSIE

SEQ ID NO: 17219 - protein, 428 aa, Bacillus cereus
MVAEKGTQTKTQQQREQHFELLNSTQIVISEALEKLGYPNEVYELLKEPVRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRDIDIKGARVVVQGFGNAGSFLAKFMHDAGAKVIAISDAYGALHDPNGLDIDYLLDRRDSFGTVTKLFNNTISNKELLELDCDILVPAAIENQITEENANDIKAKIVVEAANGPTTLEATKILTDRGILLVPDVLASAGGVTVSYFEWVQNNQGYYWTEEEVEQRLEKVMVRSFDSIYETAQVRKVNMRLAAYMVGVRKMAEASRFRGWV

SEQ ID NO: 17220 - protein, 447 aa, Salmonella typhimurium
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSSCVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVEYGGDNKHTNYVQGANIAGFVKVADAMLAQGVI

SEQ ID NO: 17221 - protein, 388 aa, Fusobacterium nucleatum
MVRNYMAIIYLAENKENISPLTKVRALASIPVGGSYRIIDFSLSNVVNAGIRNVGLFCGNEELNSLTDHIGMGAEWDLARKKDGIFIFKQMLDSNFSLNQSRIRKNMEYFFRSTQKNIVVLNAHMVYNLDIADLIEKHEASEKEITMVYKKVKNANEHFNHCSSVKIDENNRVIGIGQNLFFKEEENISLDAFVLSKELMLKLLVDSIQEGKYNILSEIIARNLPSLNINAYEFKGYLQCINSTREYFDFNMNLLNQEVRDDVFGLKSGRKILTKVKDTPSTFFKETADVENSLVSNGCIIEGTVKNSILSRGAIIEKDVVLEECVILQDCHIKKGAHLKNVIVDKNNIIHENEKLSASREYPLVIEKSMKWNTKQYQDLMDYIRNKE

SEQ ID NO: 17222 - protein, 384 aa, Fusobacterium nucleatum
MRMKKKRIIAMILAGGQGTRLKELTEDLAKPAVAFGGKYRIIDFTLTNCSNSGIDTVGVLTQYEPRILNNHIGRGSPWDLDRMDGGVTVLQPHTRKNDKKGWYKGTANAIYQNIKFIEEYDPEYVLILSGDHIYKMNYNKMLQFHIQKEADVTIGVFKVPLKDAPSFGIMNTNDDMSIYEFEEKPKEPKSDLASMGIYIFNWDLLKEYLDEDEKNPNSDNDFGKNIIPNMLNDGRKLFAYPFKGYWRDVGTIQSFWDAHMDLLSEDNELDLFDKSWRVNTRQGIYTPSYFEKGSKVQNTIIDKGCLIEGEIKHSVIFSGVKVGKNTKIIDSIIMADTEIGNNVTIRKAIIANNVKITDNINIGDGEKIAVVGEKKIIDSQSLVK

SEQ ID NO: 17223 - protein, 398 aa, Bordetella parapertussis
MPTTPTRAPSLLQAFLRSEALGGYVLMIAAVLALIVANSPLAPAYFQLLGTKLGYASEAFTLKESVLHWINDGLMAVFFLLVGLEIKREMLDGQLRGVSRIVLPGVAAAGGMLMPALVYLLVNQGDPAGLRGWAIPAATDIAFALGILALLGSRVPTSLKIFLTALAILDDLGAIAIIAVFYTAELNTSALAAAGGLLAALCVLNRLRVLRLAPYLLVGALLWYFVLKSGVHATLAGVALALAIPLRRQDPRQPGAEHSPLHALEHALHRPVALLIVPVFGFANAGVSFDGMGIDSLTAPIPLGIALGLFLGKQLGVFGFAWLAIRTGLASMPRHASFAQLYGVALLCGIGFTMSLFIGALAFDDAATIDATKIGVLTGSLVSAVLGYALLRVLPPAD

SEQ ID NO: 17224 - protein, 507 aa, Oryza sativa
MALLRCLFLLAVLLPHRNAAVVAAASPHHGPAPHDYRDALTKSILFFEGQRSGKLPPSQRVSWRGDSGLSDGSSIKARNSPLLRVDLVGGYYDAGDNMKFGFPLAFSMTMLAWSVVEFGGLMKGELQHARDAVRWGSDYLLKATAHPDTVYVQVGDANRDHACWERPEDMDTPRTVYKVDPSTPGTDVAAETAAALAAASLVFRKSDPAYASRLVARAKRVFEFADKHRGTYSTRLSPYVCPYYCSYSGYQDELLWGAAWLHRATKNPTYLSYIQMNGQVLGADEQDNTFGWDNKHAGARILIAKAFLVQKVAALHEYKGHADSFICSMVPGTPTDQTQYTRGGLLFKLSDSNMQYVTSSSFLLLTYAKYLAFSKTTVSCGGAAVTPARLRAIARRQVDYLLGSNPMGMSYMVGYGAKYPRRIHHRASSLPSVAAHPARIGCSQGFTALYSGVANPNVLVGAVVGGPNLQDQFPDQRSDHEHSEPATYINAPLVGALAYLAHSYGQL

SEQ ID NO: 17225 - protein, 489 aa, Burkholderia vietnamiensis
MNEEILINLTPQETRVALVQQGAVQELHVERTLSRGRVGNIYLGKVVRVLPGMQSAFIDIGLERAAFLHVADIWHPRLAGEPQSGAPHQPIEKIVFEGQTLMVQVIKDPIGTKGARLSTQVSIAGRTLVYLPQEPHIGISQKIESEAEREAVRARLTAVVPPDEKGGYIVRTIAEDASSEELAGDVAYLRKTWATIVAQAQRLPATSLLYQDLDLAQRVLRDFANDQTTRIQVDSRETYQRLAEFAAEFTPAVSPKLHHYTGERPLFDLYNIETEIQRALSRRVDLKSGGYLMIDQTEAMTTIDVNTGGYVGARNFDDTIFKTNLEAAHTIARQLRLRNLGGIIIIDFIDMENAEHRDAVLSELKKALSRDRTRVTVNGFSQLGLVEMTRKRTRESLAHVLCEPCPTCQGKGQVKTARTVCYDVLREILRESRQFNPREFRVIAAQQVIDLFLDEESQHLAMLIDFIGKPVSLQVESNLSQEQYDIVLM

SEQ ID NO: 17226 - protein, 944 aa, Cryptococcus neoformans
MSSLASAPPTASIPASDSYNSPVQSSGPGLSNGNSTPSKWKSVFKLGRTATIGRGKENRSALGGESFVLDNKEQQSFAGEVSPAVPTEPYLPPRKTQLRAHTDPYPPKSPSVKNNPGSVSVEHFDSKVLHEEGMPKTREEGSSESFNVHLNSSNGNLQTTSTSGEQSRPYSSVTDSASASTTERTSHSSGGHFLPGDGSLHGVASSNTYGTASTRSPTGGPLGIGNLKSRFFSAPLSAPAGKNKHDKSKSEKYRGLGKVATDFPQSTAPPSSAGGASSSGGGRKKSDGSSSLSSRGAASPRTPAKSKREPSANSSRRMPFGQTNDNGSNSGSVAARFLRRVVSAPNTKALFSNNLFSNAPDVPPLPAPKNQPNSSTSSKEKSSSPVVIVGNSGGHIDLTSSPDSDHPPSISPLSNSSTMYTSQTSHTPSASASATPTPSPLKQKNHFLSPTASPSPGQGSGLSAKGTRASRSLTTGTAPVLKNIRQLQGYSGSSPGGGGYMDGESRHKQVFKRTYSSNSIKTKQVEVTASSFQKIKLLGKGDVGKVYLVREKKTDKLFAMKVLSKKEMIKRNKIKRALAEQEILATANHPFIVTLFHSFQSQDYLFFVLDYCMGGEFFRALQTRPGKCLSEEHAKFYAAEVTAALEYLHLNGYIYRDLKPENILLHQSGHIMLSDFDLSKQSGEAGGAPAAIRHGGPNGQTILVDTRSCIADFRTNSFVGTEEYIAPEVIKGHSHSSAVDWWTLGILVYEMIFATTPFKGPNRNATFANVMKNEVLFPESVPVSSNCKSCIRKLLIKDENKRLGSASGASEVKQHKWFASVNWGLLRNMTPPIIPEESNGIDTINFRPLRESKSIDFDRDDITTDIIHAKAGSPSVSGNSTPGMLTPKELVQTTSSSSPIGGGAGGTSGHSSSAMPIPGSMRGYDKEKNPFGEFSSVTRDFGEC

SEQ ID NO: 17227 - protein, 137 aa, Burkholderia xenovorans
MSDLNDEVSAAQPTAFELVGGEARVRELVDRFYDLMDLEADFAGIRALHPPSLDGSRDKFFWFLCGWLGGPDHYISRFGHPRLRARHLPFAIASSERDQWLRCMAWAMEDVGLAEPLRERLLGSFFETADWMRNRNG

SEQ ID NO: 17228 - protein, 415 aa, Burkholderia xenovorans
MFDRAQSTIANVDPELWKVIEQENRRQEEHIELIASENYTSPAVMAAQGSQLTNKYAEGYPGKRYYGGCEYVDIAEQLAIDRVKQLFGAEAANVQPNSGSQANQGVFFAVLKPGDTIMGMSLAHGGHLTHGSPVNMSGKWFNVVSYGLNEAEDIDYEAAEKLAQEHKPKLIVAGASAFSLRIDFERMSKIARSVGAYFMVDMAHYAGLIAAGVYPNPVPHADFVTTTTHKSLRGPRGGVILMKAEFEKQINSAIFPGIQGGPLMHVIAGKAVAFKEALSPEFKAYQQQVVENARVLAETLVKRGLRIVSGRTESHVMLVDLRAKKITGKAAEAALGTAHITVNKNAIPNDPEKPFVTSGVRLGSPAMTTRGFGVKEAEQVGNLIADVLDNPEDAATIERVRAQVAELTQRFPVYR

SEQ ID NO: 17229 - protein, 382 aa, Bacillus cereus
MVEKMNEEVMDSKELQVGDVVTGSVTKVEEKQVLVNVGYKTDGVIPISELANVHIEKASDVVELDQILELKIIKLEENDLVLSKRAVDAEKAWIELQEKFTSGHVFDVTVKDIVNGGLVVDLGVRGFIPASLVEVHYVEDFTDYKGKTLAVKIVELDREKNRVILSHKAVVELELDSKKKEAISSLKEGDVVEGTVQRLTDFGAFVNVGGVDGLVHISQISHERVEQPSEVLEQGQKVKVKVLSVDADTQRISLSIKAAQPGPWENIAGEVKAGDIREGIVKRLVTFGAFVEILPGVEGLVHVSQIANRHVKNPNEVLEMGQEVKVKVLEVHVAEKRISLSIKEAFEENNVTEDYSQYEPNADSATFQLSDIIGEQLKKLKK

SEQ ID NO: 17230 - protein, 434 aa, Arabidopsis thaliana
MEEVSPAIAGPFRPFSETQMDFTGIRLGKGYCNNQYSNQDSENGDLMVSLPETSSCSVSGSHGSESRKVLISRINSPNLNMKESAAADIVVVDISAGDEINGSDVTSEKKMISRTESRSLFEFKSVPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKPRRKLKSKPLN

SEQ ID NO: 17231 - protein, 258 aa, Oceanicola granulosus
MLRIALWQGAGIAGDLDATLAEVARRADEAREQGAGLLVFPEGYLTGYHVPGLAPGGLPGVEAALEQVADIAARTGLTILMGTHLDTPDGLSNAAVAFGPDGRELGRYAKRMLFGGWEKDTFRPGAAPLRFECGGLRVGVVICYDVEFPELLRAEAEAGVDLVAVPTALMEPHERISRQVVPVRAMENQVFVAYANRAGTEPDLRFVGLSRICGPRGETLTEADAAPTLLFADLDRQVLLDERAESSYLADLATARGA

SEQ ID NO: 17232 - protein, 380 aa, Pisum sativum
MAIECITSSAKLMTQKSDKNENEGSSKLVFDASFLKNQLNLPKQFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNSSNIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 17233 - protein, 519 aa, Ipomoea nil
MATLTLIFCTLVFAIFLYFLILRVKQRYPLPLPPGPKPWPVLGNLPHLGKKPHQSIAAMAERYGPLMHLRLGFVDVVVAASAAVAAQFLKVHDSNFSNRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGGSKSDPKAEEFKSMVEEMMVLAGSFNIGDFIPVLGWFDVQGIVGKMKKLHARFDAFLNTILEEHKCVNNQHTTLSKDVDFLSTLIRLKDNGADMDCEEGKLTDTEIKALLLNLFTAGTDTSSSTVEWAIAELLRNPKILNQAQQELDLVVGQNQLVTESDLTDLPFLQAIVKETFRLHPSTPLSLPRMGAQGCEINGYFIPKGATLLVNVWAIARDPNVWTNPLEFNPHRFLPGGEKPNVDIKGNDFEVIPFGAGRRICSGMSLGIRMVHLLVATLVHAFDWDLVNGQSVETLNMEEAYGLTLQRAVPLMLHPKPRLQPHLYTLN

SEQ ID NO: 17234 - protein, 771 aa, Ustilago maydis
MSKQELLLQVTTDVICPWCFVGSRRLKAFLNSEDYKTQIAPHVRLVLKLEPYILDPRLPATSYDTPDKYYDAIETTPYDKNVPPTKKFYYGSKFGGGLDAFDAKISAAASELGMPKFDWTSEGKVGATWNAHRLVLKAGQLDEQNNSRADRDDLETALQSLQMRFMDRFYQDFHSNSKDMSDNTYLAGVAEELGLFDAQEAALTWLESDDLEYELGNKLQQAEMNGVQSIPFYIVNDGADHMSETGSHGSFLKMMQMAVAPYLSELSAERDEPDKPTRLGFAVVSNDDFSTLTFCVTRTATCGRLSGVPIAARVSLCLLAYIAPQETFTNVRYKEFAIRRGNKYLIEPLLRVGLFLVTVISSWAHCHCDYAHRLAEMTRATSVPSVYDTHCDGPGLLPVTKPWSQYYCQLRKYTSDVYATLKFPDFKHADYDCTGKTVLISGSNSGIGKQAALYFARAGATVVMACRFTATHEQNPEEARKEIVATAGVDDSKVELWEIDCSSLANIEKFGIKWRESGRTLDILVNNAGLSAGKRRITDEGFELTHVINLLSHCLLTFYLLPSLNKSAAPRIINTCSCFHAGGKLDFANMDNEKLTSLGPDCVQAYCDTKLWFLMWSVELQDRLSRSDDYRHVIVHGIHPGFVGSNIWHNPDTRIPYPLRIIFQSAISKLSINSEQGSYAIIHAALEPSLGLPKKLTSARNKLAVGESAKFGGKFINRNFVDIRRPEVDDVLARSRLWQRVLEDVAAAKRGVAADLPDHYESVKLLGQSTK

SEQ ID NO: 17235 - protein, 448 aa, Trichodesmium erythraeum
MNMNFKSSNPASSLALPPGDLGLPFIGQNKKIFKNPQNFIEEVYQKYGPVYKTNFLGKNFIYFQGYEAIKFILTNENKYFTYSQILRNYQRIFGENDITVLAGKEHRERQKILAKTIKSKNLNNYIDIIHDLSQSYFLKWIKSDYVDLYSEINNYTLDMILKLLLGIDYASKSEISNYLKDMSSGLNTIPVVFPWTKFGSALESKNKLFNQFEQIIVRRKKENNFGSDILGILLTVQEQMNYELTPREIVGQMVNLLSLGKKELSSALSSFFILTSEHLDVLKLLQIEQEKMDVSEPLSLDKYKKMVYLEQVIKEVLRLVPPVSGGLRKIIEDCSFQGFRIPKGWHAYYYISSVLKDPEIYKQPEIFNPERFNPTNAEDKKKPLCYIPFGGGARECIGKEFAYLVIKIFISALLDNCSWKFKENQDLTINTFPVARPAHKIEVCFTPK

SEQ ID NO: 17236 - protein, 468 aa, Escherichia coli
MSKQQIGVVGMAVMGRNLALNIESRGYTVSVFNRSREKTEEVIAENPGKKLVPYYTVQEFVESLETPRRILLMVKAGSGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLTLSNEELAQTFTEWNEGELSSYLYDITKDIFTKKDEEGKYLVDVILDEAANKGTGKWTSQSSLDLGEPLSLITESVFPRYISSLKDQRVAASKVLSGPQAQPAGDKAEFIEKVRRALYLGKIVSYAQGFSQLRAASDEYNWELNYAEIAKIFRAGCIIRAQFLQKITDAYAQNAGIANLLLAPYFKQIADDYQQALRDVVAYAVQNGIRVPTFSAAIAYYDSYRSAVLPANLIQAQRDYFGAHTYKRTDKEGVFHTEWLE

SEQ ID NO: 17237 - protein, 177 aa, Listeria monocytogenes
MTKESLEKATFAGGCFWCMVKPFDTQPGIEKVISGYTGGHTVNPTYKEVCSGTTGHTEAIQITFDPAVFPYEKLVEVYWQQTDPTDAAGQFVDRGDSYRPVIFYHNEEQKEIAEKSKAALDASGRFKKPIVTEIAKAETFYPAEEYHQDFYKKEKAHYEGYQVASGRAAFIDANWKG

SEQ ID NO: 17238 - protein, 522 aa, Ipomoea tricolor
MATLTLILCTLVFAICLYFLILRVKQRYPLPLPPGPKPWPVLGNLPHLGEKPHQSIAAMAQSYGPLMHLRLGFVDVVVAASAAVAAQFLKVHDANFSSRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGSSKSDPKAEEFKSMVEEMMVLAGSFNIGDFIPVLGWLDLQGIVGKMKKLHARFDAFLNTILEEHKFVNNQDTTLFKDMDFLSTLIRLRDNGAAMDGEDGKVTGVTDTEIKALLLNLFTAGTDTSSSTVEWAFAELLRNPKILNQAQQELDLVVGPNRLVTESDLTQLPFLQAIVKETFRLHPSTPLSLPRMGAESCEINGYFIPKGATLLVNVWAIARDPNVWTNPLEFNPHRFLPGGEKPNVDIKGNDFEVIPFGAGRRICSGMSLGIRMVHLLVATLVHAFDWGLVDGQSVDTLNMEEAYGLTLQRAVPLMLHPKPRLQPHIYTLN

SEQ ID NO: 17239 - protein, 91 aa, Oryza sativa
MSRRSSSGASSAARITDEQIGDLVSKLQALLPEARLRSNDRVPSARVLQETCSYIRSLHREVDDLSERLAELLAAADVSTAQAAVIRGLLM

SEQ ID NO: 17240 - protein, 263 aa, Hyphomonas neptunium
MALPDFSMRQLLEAGVHFGHQTHRWNPRMKPYIYGERSGIHIMDLSHTVPALHQSLVFVRDTVAKGGRVLFVGTKRQAQEPVAEAAQRCAQYYMNHRWLGGTLTNWSTVSNSIKQLRELNAMFESGGGSGLTKKELLDLQRRRDKLQKSLGGIADMGGLPAAIVVIDTNKEAIAVQEARKLGIPVVAVLDTNCNPSDADFGFPGNDDAARAISLYCNLFADAVLDGLAESTAGLGVDLGASADIASLADADVKLADEEAAGEA

SEQ ID NO: 17241 - protein, 284 aa, Unknown
  Candidatus Protochlamydia amoebophila UWE25
MKKYHSLTPEENSVINFKGTEYPNTGKYNHFSEPGVYVCKKCDAPLYLSSDKFLSHCGWPSFDDEIKGSVDKKVDSDGRRIEILCHRCGGHLGHVFKGEGLTTKNLRHCVNSVSLSFLPALTKESYERALFAGGCFWGVEYLFQKLTGVIKTKVGYSGGVTIDPTYEDICSGRTKHAETLEVVYDKNKITYEALAKFFFEIHDPSQFQRQGPDIGNQYRSAIFYLTKQQEEIAQCLIQLLSTKGIPIVTEVIPASVFYPAENYHQNYYGKTGKTPYCHIYTKRF

SEQ ID NO: 17242 - protein, 309 aa, Brassica napus
  misc_feature (226)..(226): Xaa can be any naturally occurring amino acid
  misc_feature (267)..(267): Xaa can be any naturally occurring amino acid
MGKASRDKRDIYYRKAKEEGWRARSAFKLLQIDEEFNIFQGVKRVVDLCAAPGSWSQVLSRQLYLPAKYSAESKEEDLPLIVAIDLQPMAPIEGVIQVQGDITNARTAEVVIRHFDGCKADLVVCDGAPDVTGLHDMDEFVQSQLILAGLTIVTHILKEGGKFIAKIFRGKDTSLLYCQLKLFFPTVTFAKPKSSRNSSIEAFAVCENYSPPEGFNPRDLHLLLEXVGSPSGGSDLDCSSGWLEGPNKVYIPFLACGDLSGYDSDRXYPLPKEAHGSSYRSLDPIQPAIAPPYKRAIELKTASAQSFNS

SEQ ID NO: 17243 - protein, 681 aa, Cryptococcus neoformans
MPDTPPHKHHYTSLRSLMHSPDPGNPAKRDSLTPRQPRPSRNSSSSRSRERRLDPPRKADKDKGRLSTWKLMCLTVSMGGSQIAWTVELGYGTPYLLSLGLSEQLTSLVWLAGPISGLIAQPLIGAISDSSHSRYRRRYWIVTSTMLLVFSGLGLAFTEPIAKALVDLIGGGQGDWDPKTIRLVKNTAIGIAVFSFYCLDFALNALQASLRNLVLDITPGEQLATANAWHGRFNHVGNIVGFTMGFLNLSHVPIIRLVGGGQFRKVCIVALVLLVMTVWITCWTQEEKETDSIFGERRSKIRDVVGTIYEAVLHLPKPIRRVCIVQIAAFMGWFPYLFYSTTYVAEVMAKELHHKPDIDRATRAGSLALLIYSFVAIIAGTLLPYLAARDRRLLKPTSEKLRDGEIEIENEDEEDEEHVEMERIREMVQQWKAEAAREGRPLKLPTMPFMLRNIWTAGLVIFGCLMMSTFFITKVWQATVMIALVGICWAIACWVPFAIIMEFLKELDDKPPPRISDGRPRPTHARTTSTPLGWRSHPTSPAGRASPDERTPLARSYSTADLDGANEMEYTGQGPVAGGTIMGIHNLAIVFPQFIASLILSPFLRYQLIVVVLADTQPDIQPTSPEIGGPHGQDKNGVAWVLRFGGLMAFVGALVSRKVPPTKTEKAMRRRLADMREESAE

SEQ ID NO: 17244 - protein, 277 aa, Erwinia carotovora
MMTTQSILAKGQRRQPVLGGEIWLVGAGPGDAELLTLKALRAIQQADVVVYDRLVSAEIMDLVPELALCIDVGKTRGCHRLSQEKINQLLVELAQAGQRVIRLKGGDPFIFGRGGEEMDYAQQAGIVCHVAPGITAATGCAAAVGLPLTHRACAQSVRFVTGHSRDGEPQLDWPTLADSQQTLVFYMGLSHSSRLCQRLIEHGLSAQTPVAIIERGTQPDQRLLIATLATLPALLARYQPQSPSLLVVGDVVRFCRHPALHVEATPALLTMEKHEAA

SEQ ID NO: 17245 - protein, 99 aa, Glycine max
MPSLQTALPPELANNAIRLYRECLRRAKYIGHRKHNTELLVDMVRQQFKKHMHETDPEKIQKLKDGAARGLINHILYESEQMTGSKFSKSKQPNLLYPK

SEQ ID NO: 17246 - protein, 452 aa, Hydrogenophilus thermoluteolus
MTEELRNRIGLIRKAPENFLTPEEIEAIKKGRRDFIRKAFATATALAASGPVINAYGETVDPGKGDPNILNLPEWSTTLGMPVATRGYGMPSKYEAGLIRRQSPGLTQTAAASVSFSPLQGMFGIITASGLHFERHHQGWHDIDPTKHRFMINGLVKTPMVFTMDDLMRLPSVSRIHFIECGANTGMEWANVAVPTVQYTHGMLSCSEFTGVRLIDLLEMCGADLKKGRYLLAEGADGSSMTRTIPMELVESGEVLVAYGMNGEMIRPENGYPLRLVVPGVQGVSWVKWLRRVEVGDKPYGTKDEAVHYIDLMPDGMHRQYTSLQEVKSVITTPSGGQILLDKGFYNITGLAWSGRGKIVRVDVSTDGGVNWRQARLEQPVLPKALTRFNIDWVWDGKPAILQSRAVDETGHIQPSYGQLRKVRGTRSIYHNNAIQSWLVNENGEVSNVQVL

SEQ ID NO: 17247 - protein, 707 aa, Buchnera aphidicola
MLNPIVRKFQYGQHTITLETGVIARQANAAVMASMDETAVFVTVVGQKKIHTGQKFFPLTVNYQERTYAAGRIPGGFFRREGRPSENEILTARLIDRPLRPLFPKKFLNEIQIIATVVSVNPQINPDIISIIGASAALSLSGIPFYGPVGAARVGYINNQYILNPISDDMKNSSLDLVVSGTQNAILMVEAESKILSEEKILGAIIFGHQQQQVVINNIRSLSNEASKLPWVISYPETNKTLELKIINSFEKNISDAYVIFNKQDRIEKLNSIKENIIKLFLDENSNIDTLEIEDIFQKIEKKVVRKRILSNQTRIDGREKDMIRALDVRTGILPRTHGSALFTRGETQSLVSVTLGTSRDAQNLDELLGDRIDNFLFHYNFPPYSVGEIGMVGSPKRREIGHGRLAKRSLLAVMPTLENFPYTIRVVSEITESNGSSSMASVCGASLALMDAGVPIKSAVAGISMGLVKEGNQHVLLSDILGDEDHLGDMDFKVAGTEEGITALQMDMKIEGITNEIIHSALNEARLARLHILNVMNQALNESRSEISEFAPRIHIIKINPEKIKDVIGKGGSVIRMLTEETGTIIEIEDDGTVKISSTVKEKAKNAIRRIKEITAEIEVGRIYSGKVTRIVDFGAFVSIGLGKEGLVHISQISDKRVDKVSNHLKIDQIISVKVLEIDRQGRLRLSIKEIDSSILSNKSINNSII

SEQ ID NO: 17248 - protein, 902 aa, Erwinia carotovora
MNAHVCRTTCPYCGVGCGVLAEHDGQGEVKISGDPAHPANFGRLCVKGSALGETLDLKGRLLWPLVEGRRVSWDQALDAVAERLLATMQQHGPQSVAFYGSGQLLTEDYYVANKLMKGFIGVANMDTNSRLCMASAVIGYKRGLGADAVPCNYEDIEQADVVVLVGSNTAWAHPVVYQRLAQAKQQRPQMQVVVIDPRRTATCDIADLHLPLQPGSDAGLFNGLLQWIAQDPRINLTELAERFSGVEAALQSAQAWSVAQVADFCQLDDADIECFYHLFSTSEKVVTLYSQGVNQSSSGSDKCNAIINAHLLSGKIGVPGSGPFSITGQPNAMGGREVGGLANQLASHMGLTPQDIERVGRFWQSDNVATQPGLNAVDLFHAIERGDIKAVWIMGTNPVVSMPDADRVKQALECCPLVIVSEVMRHTDTAETADILLPALGWGEKDGTVTNSERRLSRQRAFLPAPGEAKADWWMLSQVAQRMGFAEAFAYQHPADIFREHAALSGFENNGSRAFDISGLATLSNQQWQQLEPIQWPVNAAFPNGRARLGDDGRFWHTDGKAHLVAVTPSLPQSPWSAAYPLVLNTGRIRDQWHTMTRTGKAARLMRHISEPYCELHPQDAQMHDIQAGDLVRLSSVHGWMLARARLDAGQARGSVFVPMHWNQQFSAQARADSLVAPITDPYSGQPESKHSRVRIQPWHTAWQATLFFADEPMSSPLALPDEHDVLPPPATYWSKIPHEGVTQYLFADRTPVDDWQAWLAEHYGLENMQCQIAQGKGIFHLIGWREGRVALACYVSAQALHIDSDTIRQAFITPPQLPHERNALLAGQAPQGQVTQGATICSCYSVGEAIIVGAIRKGCHSVAALGGALKCGTNCGSCIPELKALLSQHVPITVNELKKAG

SEQ ID NO: 17249 - protein, 477 aa, Escherichia coli
MNKKSLWKLILILAIPCIIGFMPAPAGLSELAWVLFGIYLAAIVGLVIKPFPEPVVLLIAVAASMVVVGNLSDGAFKTTAVLSGYSSGTTWLVFSAFTLSAAFVTTGLGKRIAYLLIGKIGNTTLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESSVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 17250 - protein, 1395 aa, Erwinia carotovora
MKPHLIVIGNGMASARFVDTLRQLAATCYRITVIGDEPRASYNRILLSPVLSGEKAFADTLLTPAAIDDDTALPVNTLLGERVTHIDRQAREVTTTQRQLHYDHLVLAMGSTPFMPPMPGIDLAGVCGFRTLDDVELMLATISQPVPAVVIGGGLLGIEAAAALRLRGADVTLLHRVPILMERQLDATASDLLCNSLRARGIACETDVQVAALHGDAHGVTAVELADGRTIPAGLVVVTAGVIPASQLARECGLPCNRGVLVDGQLQTADPHISAIGECCELNGETFGLVAPCFAHATLVAQRLAGHAPQDYQREQATTRLKVTGIGVVSGGEINVAPNDEVYTTFDPQTQHYRRLLLRDGRLSGVLLYGDTDDSPRLLAAMDNTTEGEMIPPATLLFGLSSPDSDSQPAAVRIPVMSKPILVVVGHGMVGHYFLEQLVERDLHQHYHIVVFGEERHEAYDRVHLSEYFSGRSAASLSLVKEGFFAESGIELRSASEIVAIDRERQCVCDAQGRETAYDKLVLATGSYAFVPPIPGNTRPGCLVYRTLDDLDAIAAQAKKATSGVVIGGGLLGLEAANALRQLGLDTHVVEFAPRLMAVQLDDGGASMLRRKIEALGVQIHVSKETREITDGEQALHRLCFADGSVLETDLVLFSAGIRPRDKLADSCDLEKGPRGGIVIDDCCQTSDDAIFAIGECALWKGQIFGLVAPGYQMARSVADTLAQRDTPFTGADMSTKLKLLGVDVASIGDAHGRTAGSQSYQWTDGPNEVYKKIVVSADGKHLLGAVLIGDSSDYSTLLQMMLNDMSLPTQPEGLILPARSGDAPKGLGVAALPASAQICSCHNVSKGDISAAVAGGCGELGALKTCTKAGTGCGGCVPLLKQVMEYELTQQGVEVKKDICEHFAYSRQELYHLIRVHEIRSFDGLLERYGHGLGCEVCKPLVGSMLASCWNDYLLQPQHLPLQDTNDRFFANIQKDGTYSVVPRVPAGEITPAGLIAIGQVAQRYNLYTKITGGQRVDLFGARLEQLPEIWRELIDAGFETGHAYGKSLRTVKSCVGSTWCRYGVQDSTGLAIQLEHRYKGLRSPHKVKMAVSGCTRECAEAQSKDIGVIATDKGWNLYVCGNGGMKPRHADLFASDLDTETLLRTIDRVLMFYIRTGDRLQRTSTWMDNLEGGIEYLRQVILEDSLNIGEELDKEMQRVVEAYQCEWQTTLESPERLALFRGFLNSDSPDEAVVMVPERGQIRPAQEHEKAISPEPVVLKPATHEAEWIQVATLGDIPRHAGMAARLGQQQIALFHLPGSEQQVYALENHEPGSGANVLSRGLIGDVAGEPVVISPLYKKRFKLRDGVSPDDRALYVRAWPVRVEDDEIWVCRQPLAVPESVGLADNDMAKAS

SEQ ID NO: 17251 - protein, 739 aa, Mangifera indica
MESCNCIEPQWPADELLMKYQYISDFFIALAYFSIPLELIYFVKKSAVFPYRWVLVQFGAFIVLCGATHLINLWTFSMHSRTVAIVMTTAKVFTAAVSCATALMLVHIIPDLLSVKTRELFLKNKAAELDREMGLIRTHEETGRHVRMLTHEIRSTLDRHTILKTTLVELGRTLALEECALWMPTQTGLELQLSYTLHQQNPVGYTVPIQLPVISQVFTSNHAVKISPNCPVARLRPLAGKYMPGEVVAVRVPLLHLLNFQINDWPELSTKRYALMVLMLPSDSARQWHVHELELVEVVADQVAVALSHAAILEESMRARDLLVVQNIALDRARREAETAICARNDFLSVMNHEMRTPMHAIIALSSLLQETELTPEQRLMVETILKSGNLLATLINDVLDLSRLEDGSLQLQLGTFNLHAVFKEVLNLIKPIASVKKLLVALNLAPDLPEYAVGDEKRFMQTLLNVVGNAVKFTKEGNILITAFVAKSESFLDSRTPEFFPVPSDNHFYLRVQVKDSGSGISPQDIPKLFTKFAQNQSIATRNSHGSGLGLAICKRFVNLMEGHIWIESEGLGKGCTAVFVVKLGIPESSNESKLSFMPKMSGPQTNFTGLKVLVLDDNGVSRSVTKGLLVHPGCDVMTVGSSEECLHVVSQEHKVVFMDVGIPGIDGYEVAVHIHQKFTRRHERPLIVALTGNTDKITKENCMSVGMDGVILKPISLEKMRSVLLGLLEHRVLFEAI

SEQ ID NO: 17252 - protein, 77 aa, Daucus carota
MKEQKWIHEGLITESLPNGMFRIRLDNQDMILGYVSGKIRRSFIRILPGDRVKIEVSRYDSTRGRIIYRLRNKDSKD

SEQ ID NO: 17253 - protein, 1007 aa, Unknown
  Azoarcus sp. EbN1
MKRMLFNATQAEELRVAIVDGQKLIDLDIESAAKEQRKSNIYKAVITRIEPSLEAAFVDYGGERHGFLPFKEISRTYFAPGADAGKVRIQEALKEGQELIVQVEKDERGNKGAALTTYISLAGRYLVLMPNNPRGGGVSRRVEGDERTELRDVMDQLEIPSGMSLIARTAAIGRNAEELQWDLNYLLQLWRAIDGAAQSQSGAFLIYQEGSLVIRAIRDYFQPEIGEILIDTDDVYEQARQFMSHVMPANVNRVKRYSDDVPLFSRFQIEHQIESAYSRQVTLPSGGAVVIDHTEALVSIDVNSGRSTKGADIEETAFRTNLEAAEEIARQLRLRDLGGLIVIDFIDMESQKNQREVEGLLRDALRHDRARVQTGKISRFGLLELSRQRLRPALAETSYIPCPRCNGTGHIRSTESSALHILRILEEEAMKENTGAVHLQVPVDVATFLLNEKRVDIAHIEVRHKIQLIIIPNRHLETPHHEIIRLRHDQLNQEEVALASYQMVGKPAEIDLRLPSKEDTKPPRAEAVVKGISPAQPAPIVEPKTEPVVAPGLAPKPAGLFQRLFGWLRSEKPAVTPQMAPEIAPKPESRPRAERSDTRRGNNRNRRDGQQRTERGERDESTSAAQTARGPVRGERAERPERSERTERSDTGVDRGDRPARPERDNGGRTRQGRGQRTQPKQGEAAVVDNVVESPASTITIAPAPLAQMEAAAIVPAAEDGTPEKRRRRSRGRRDRRGTEQQAEVAASGDETGDTWAETAVPSIETAPETTQATSAEPVAEVAAELPLAAAETTAPLPVAVTSPESIAVTAEAAPLPVSLHPATSIEAESPAEAEPVTLETAAEPVAEREAAIEPALEAKIAPEAAIEAAERARESLQAGLMEPLVHADTEPVQVSAGEELVEAEAEAEAEQAPTAAPAQNVVAPETEVAVTEAEVRTAESRLSSAPIDLGVNLAESGLVMIETSRDKVQELASTADETPARPLGRRPRPAPVIVNEPLQQVETHSK

SEQ ID NO: 17254 - protein, 432 aa, Rubrobacter xylanophilus
MADVTFDYRNLLEVEGGLTGRELEEISPRLRAAVGTLLEDPPGFMRLPRTREHLEASLEVAERVRSDGATDFVHVGIGGSALGPMVLHRALSHPFYNLLPDRGGPRLHFAENADPATLSGILDVIEPEGTWVNVVTKSGSTAETMANFLVIRGALAEALGDFGYQARTVVTTDPEKGFLKRIADREDLVTLQVPPEVGGRFSVLSPVGLLPAAVAGLDVEALLAGAARCVEELEEQGAEHPAVVGAAMHHLMDASRGRNIRVMMVYADALERLAAWFVQLWAESLGKDGKGSTPHGAVGTTDQHSQLQLYMEGPQDKVIEIVEVREHPRDVGIPGAYEDLEGVGYLSGHTVGELLNVECDATRRALTGAGRPNATIRLGSLSAENLGYLMQALEVQTAVAGALYGVNPYDQPGVEAGKRITYARMGRPGYRA

SEQ ID NO: 17255 - protein, 312 aa, Vibrio angustum
MDFFPVFLKLTHKKVLVVGGGEVACRKVDLLLKAQANITLVSPELHPHLVSLLDEGKFEYLKARYEKSLLTQFDQVWATTDSRELNHQVYHDANALKIWTNVVDDPAYCDFITPSMIDRSPMQVAISSGGASPVLVRYLRERFETQLPQNLSLLADYSGQQRTRIKQHYKTVDERRKFWETFFRLPAVETATTEQELEQAFSGLLTSYQDTGANLYLIETGNDPELLTLKALRLMQQSEFVLYPDGKNDIFVDLCRRDADRESYEHENVITRAKQLLDEGMRVCILASKHQHRPALKKLCVDRNGIFVPSHS

SEQ ID NO: 17256 - protein, 98 aa, Synechococcus sp.
ASYKVTLINEEMGLNETIEVPDDEYILDVAEEEGIDLPYSCRAGACSTCAGKIKEGEIDQSDQSFLDDDQIEAGYVLTCVAYPASDCTIITHQEEELY

SEQ ID NO: 17257 - protein, 597 aa, Arabidopsis thaliana
MQCLMADGALITLDSDDILATEHVLAVGKEFPDVETCRRTLKDLAIALHFDLRIVKSDRSRFIAKCSKEGCPWRIHAAKCPGVQTFTVRTLNSEHTCEGVRDLHHQQASVGWVARSVEARIRDNPQYKPKEILQDIRDEHGVAVSYMQAWRGKERSMAALHGTYEEGYRFLPAYCEQIKLVNPGSFASVSALGPENCFQRLFIAYRACISGFFSSCRPLLELDRAHLKGKYLGAILCAAAVDADDGLFPLAIAIVDNESDENWSWFLSELRKLLGMNTDSMPKLTILSERQSAVVEAVETHFPTAFHGFCLRYVSENFRDTFKNTKLVNIFWSAVYALTPAEFETKSNEMIEISQDVVQWFELYLPHLWAVAYFQGVRYGHFGLGITEVLYNWALECHELPIIQMMEHIRHQISSWFDNRRELSMGWNSILVPSAERRITEAVADARCYQVLRANEVEFEIVSTERTNIVDIRTRDCSCRRWQIYGLPCAHAAAALISCGRNVHLFAEPCFTVSSYQQTYSQMIGEIPDRSLWKDEGEEAGGGVESLRIRPPKTRRPPGRPKKKVVRVENLKRPKRIVQCGRCHLLGHSQKKCTQPI

SEQ ID NO: 17258 - protein, 177 aa, Arabidopsis thaliana
  misc_feature (21)..(21): Xaa can be any naturally occurring amino acid
  misc_feature (48)..(48): Xaa can be any naturally occurring amino acid
  misc_feature (107)..(107): Xaa can be any naturally occurring amino acid
  misc_feature (134)..(134): Xaa can be any naturally occurring amino acid
  misc_feature (138)..(138): Xaa can be any naturally occurring amino acid
  misc_feature (164)..(164): Xaa can be any naturally occurring amino acid
GFDPLGLGKDPAFFKWFKKAXLIHGPWAMATVFGIFFGQAWNGVAWFXIGAQPNAIAPFLLGSLFGTQLLFMGWGENKQWVDFFNPDFQSVEWATPWLKTPQNFPNXTGDQGYPGGRFFDPLGFPGKNPPGVFXRAFXKLERLKLAKIKPSRLPMGAMLIFFFXAGQGKTPPGAFGL

SEQ ID NO: 17259 - protein, 323 aa, Shigella flexneri
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQVLAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 17260 - protein, 435 aa, Unknown
  Synechococcus sp. WH 7805
MNEVPVPSPELLQRAGAVRLAAVDLGMADDGERMQALKAMAEALADRSDALVAANREDMERSAAEGLAPALMARLKLDAAKLGGAIDGVRKVASLRDPLGRRDLHRELDQGLALERVSVPLGVLGVIFEARPDAVIQIASLAIRSGNAALLKGGSEARCTNEAVMEALKAGLASSAISPDALALLTTRQDSLALLKLDGLVDLIIPRGSNELVRFIQDNTRIPVLGHADGICHLYVDAAADVDKAVRVALDSKTQYPAACNAIETLLVHRSVAASFLSAAIPEFRKAGVVLRGDAASVALGVSEPATDDDWRTEYLDLILAVKVVEDLAEAVEHVRRFGSRHTECIVTEDEAAADRFLSSIDSAGVYHNCSTRFADGFRYGFGAEVGISTQTLPPRGPVGLEGLVTYRYRLRGDGHVAADYATGASRFTHKDLPL

SEQ ID NO: 17261 - protein, 1225 aa, Cryptococcus gattii
MSGFTPALGLHHTHSSSVLPTISNDAEPNPPTSSQPHQLAAYSHLYTTSPNYASKITNESSYSSSTTHHGFKYVRPSTSPLLKPPKGNSFSAYLGDWGSQELFTFLDIHKCGQCLAIFQKNDINGKLLLDLDVAALKSMGIDKISERVRLISGIKDLRRRVTDESVRAPFTLCSCPPERTLLPILPSHSNVLLDRWDCSSSTSCLGKREITFRPPPLDLRGHMPPRLSNHSSQSIASIDTHDVHTTNPQIGAVQQYPLDQPQSVPTNRSDSLTLRAPPSRNIGRRSPSPRHFEGCESQTDRFTTLNVASDQQVLSSTVNSLTLREDCHLQREEGLPSFLQVPHFRNTFTSSHKTLLSRRSDLARDDTTSHQPFGPAIAEQDNHIRCRIPDTITNIRETSQGDPNHPFAVKSSKSQSGMLDGVCDMVHGPMADGTKPKGKASVPLTGMSSPNIFPVNANSAALSLADLRRQLVKFINTEDDTIRTVNVMHVTSGIEILERALKKFGKWGTGMHSGPDVYSDDDVNGTLEIDGWGVYTESNPDESSKPLSESSLLQKCTFHREGTAIPDKGLFLHKKKRSQKRKNIHDFFGETPPPLMSPTLPTLFTGPHLGLVQGKSQPASESAPFSSTRLSTSANKGPNRASMISVMSGLGVPITCTLPSPQGNGLRLTGQVNSHKKKSMYNFFGHRPPSELISNHLADYFPSAKKSDVEKARHSLLRLSGGNSAYQGSWIDQGDNAPDHRSKPGSSQPPSLPPFEPSRDTLSDSLQAYASTAIHLSRPKHSTALRRRRDSDSSSRSHMSELMQTRLNRDHSDTASLLTVDEITAEVENRRTSAVLKGNCIEEAEDPPSIERDMLPKYEESKGLLHAVCSDGNSNVDDGMSYRGNSDLDPEEEEEEEEEEEEEEEGEEEEDEENEQGKAFTSTGSKRIIKWIKGALIGAGSFGSVYLGMDAQSGLLMAVKQVELSAGSAKTEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADVWSVGCLVVEMLTGTHPWADLTQMQAIFRIGSLARPAPPSDISVQADEFLRKTFEIEHTKRPTAAQLLKHPFIGSPRVRATSSNFINGAIVSEKMQVQIVKEM

SEQ ID NO: 17262 - protein, 169 aa, Burkholderia vietnamiensis
MPATSRARTGCSTAAPIRARSEPPRRFPHDDNRTKKESQMSKPRIALIAHDAKKDEIVALAGQYRNTLAQCRLVATGTTGGRIAAAHGLEVERKLSGPLGGDLQIGAELADGRVDVVVFLRDPMTAQPHDPDITALVRACDVHDVPVATNVATARMLLDDLARNMQDVC

SEQ ID NO: 17263 - protein, 445 aa, Lactobacillus acidophilus
MSLIKFDSSKLTPFIHENELSEMQAMVNAANEELRDGTGAGSDFRGWLNLPVDYDKEEFDRIKKAAKKIQSDSDVLICIGIGGSYLGAQAAIEFLNSNFYGKEDNGMPTVVFCGNSLSGSYLYDLIEWVGDKDFSINVISKSGTTTEPSVAFRIFKDKLIKKYGKEEAAKRIYATTDRQKGALKTEADAEGYEEFVVPDDIGGRYSVLTAVGLLPIAASGADIDELMKGAADARADYTDTDLSKATPYQYAAIRNILYRKGYTTEIVENYEPSLRMFGEWCKQLMGESEGKDQKGIWPSSANFTTDLHSLGQYIQEGLRNLFETVIRVENPRHDVKIPGDEKNLDQLNFLEGKSLNYVNDRAYEGVVLAHTDGGVPVMTINIPDQTAHTLGYMIYFFELAIAISGYLNGINPFNQPGVEAYKRNMFGLLNKPGYENLHDDLAKRL

SEQ ID NO: 17264 - protein, 166 aa, Cryptococcus neoformans
MSTAASNPATYKFNHTMIRIKDPKVSLPFYEKVLGMKVFYESPGGDFTNYFLAFANGFDDADLNKENIRDKLFDREGVLELCHNWGTENDASFKGYASGNEEPGRGFGHICITVDNLEAACKRFDELGVKFKKRPEDGRMRHIAFIYDPDGYWVEIVARSLNASNI

SEQ ID NO: 17265 - protein, 508 aa, Saccharomyces cerevisiae
MKYLNLVFVLQLLISIKYASFGRAFSLFEDDTTFANLDKQLKLPQNTQQTLKLDRLNHDDPLFTTFISSVDTDYSLRLRTVDPSKLGIDTVKQWSGYMDYKDSKHFFYWFFESRNDPANDPIILWLNGGPGCSSFTGLLFELGPSSIGADMKPIHNPYSWNNNASMIFLEQPLGVGFSYGDEKVSSTKLAGKDAYIFLELFFEAFPHLRSNDFHIAGESYAGHYIPQIAHEIVVKNPERTFNLTSVMIGNGITDPLIQADYYEPMACGKGGYHPVLSSEECEKMSKAAGRCRRLNKLCYASKSSLPCIVATAYCDSALLEPYINTGLNVYDIRGPCEDNSTDGMCYTGLRYVDQYMNFPEVQETLGSDVHNYSGCDNDVFTGFLFTGDGSKPFQQYIAELLNHNIPVLIYAGDKDYICNWLGNHAWSNELEWINKRRYQRRMLRPWVSKETGEELGQVKNYGPFTFLRIYDAGHMVPYDQPEASLEMVNSWISGNRAFSDLSTLENAS

SEQ ID NO: 17266 - protein, 554 aa, Pseudomonas syringae
MAYYRNPSDVTAMPAWQALTKHRQAMQDFSMREAFTDDPKRFSQFTLSSAGLFLDYSKNLITAETRDLLVALAGEVGLKDAIKAQYYGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAARAWYLAQGGSEVELHRHFIAVSSNNAAAVAFGIREENIFPMWDWVGGRYSLWSAIGLPIALAIGMSNFKELLSGAYTMDQHFQSAPFDQNMPVLLALLGVWYGNFWNAQSHAILPYDHYLRNITKHLQQLDMESNGKSVRQDGTPALTDTGPVIWGGVGANGQHAYHQLLHQGTQMIPADFIVPIVSFNPVADHHQWLYANCLSQSQALMMGKTRAEAEAELRDKGMSEEEVQKLAPHKVIPGNRPSNTLVVERISPRRLGALVAMYEHKVFVQSVIWGTNAFDQWGVELGKEMGKAVYQRLTGGTEEPADDASTQGLINYFRGRHRG

SEQ ID NO: 17267 - protein, 372 aa, Cucurbita cv.
MAATALGSVAASSASSTTRFLSTATRATLPFSSRSSSLSSFKFLRSAPLISHLFLNQGRPSSCVSIRRFNAASHPKCLASDPEQLKSAREDIKELLKTTFCHPILVRLGWHDAGTYNKNIEEWPQRGGANGSLRFDVELGHGANAGLVNALKLIEPIKKKYSNVTYADLFQLASATAIEEAGGPKIPMKYGRVDVVGPEQCPEEGRLPDAGPPSPAAHLREVFYRMGLNDREIVALSGAHTLGRSRPERSGWGKPETKYTKDGPGAPGGQSWTVQWLKFNNSYFKDIKERRDEELLVLPTDAALFEDPSFKVYAEKYVEDQEAFFKDYAEAHAKLSNLGAKFDPPEGIVIDDASSKPAGEKFDAAKYSYGKD

SEQ ID NO: 17268 - protein, 458 aa, Prochlorococcus marinus
MPAENKELKTENLVIIGSGPAGYTAAIYAARANLQPLIITGFEKGGIPGGQLMTTTFVENFPGFPNGVQGPELMDLIKAQAVRWGTNLIEEDAISIDLSKRPFSIVTTTQKIKTNSLIISTGASANRLGLKNEKLFWSKGISACAICDGATPQFRDEELAVVGGGDSACEEAEYLTKYGSHVHLLVRSRKLRASAAMADRVEANPNITIHWETELLDVLGNDWLEKLKVKRRDTNQEEEILAKGLFYAIGHTPNTSLFTNQLSTDSKGYLLTQPGRPETSLEGVYAAGDVADSEWRQGVTAAGSGCKAALAAERWLTKNNLATLIKRVELEPSKADTTKILEVSNEANFDPEKTWQKGSYALRKLYHETEKPLFVVYTSSSCGPCHILKPQLHRVLNESKGKAIGVEIDIENDQDIAKQAEVSGTPTVHLFKNKELKKQWKGVKTRSEYKAALDELIN

SEQ ID NO: 17269 - protein, 129 aa, Brassica napus
MEPPKDQPPSSAYPPSGSCNNCGGPTISEPAPQASLPDMSPPPNYRPIRAPAINVPHNPQAIILSPVPHAEKVPVVTPPYQFQRPVKRIHSPDDIRRFQESASFKNFLGFVVSLSESIDGHKIADPCHV

SEQ ID NO: 17270 - protein, 486 aa, Oryza sativa
MGRRSGGRKLPFFASNASTSSSTKRTRSARRLPSLTRPRASSSPSPASPSPPPPSASHPAPPSPPLAVSPAGAGKVGKKKAGARLWMRLDRWGVSETLHLDKGSIIRRAGLPPRDLRILGPVFSDSSSILAREKAMVINLEFIRAIVTADEILLLDPLTIDVIPFVEQLTHHLPLKNLVCGNGQPGGDDHGEKHDDSPGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWGSNHPEAAVCLLCREIADESLNFMDNTE

SEQ ID NO: 17271 - protein, 554 aa, Vibrio parahaemolyticus
MCSVFGILDIKSDAAALRPIALEMSKKLRHRGPDWSGIYSSERAILAHERLAIVGLNSGAQPLYSPDKKLILAVNGEIYNHKEIRARYEGKYEFQTDSDCEVILALYQDMGADLLEELNGIFAFVLYDEEKDEYLVGRDHIGIIPLYQGYDEHGNYYVASEMKALVPVCKTVSEFPPGSHYSSKDAEPQRYYIRDWNEYAAVQGNSTSKEELTEALEAAVKRQLMTDVPYGVLLSGGLDSSITSAVAKRYAAMRIEDDEKSEAWWPQLHSFAVGLEGAPDLKAAREVAEKIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPADKMCGNGKMEKHILRECFEHYLPDSIAWRQKEQFSDGVGYSWIDTLKAVAEEKVTDQQMETAQYRFPYNTPTTKEGYVYREIFEELFPLPSAAECVPGGPSVACSSAKAIEWDESFKNCVDPSGRAVQTVHNDAY

SEQ ID NO: 17272 - protein, 733 aa, Bartonella henselae
MFKTHKIEIEWAGRPLTLETGKIARQADGAVIATYGETIVLATVVSAKSPKPDQDFFPLTVNYQEKSYAVGRIPGGYLKRESRPSENETLISRLIDRPIRPLFADGYKNDTQVIVSVIQHDLENNPDILAMIASSAALTLSGVPFMGPIAGARVGYCNGQYILNPHIDEMSESKLDLVVAGTENAVLMVESEAQELPEDIMLGAVMFGHKGLQPILDAIIKLAEVAAKDPRDFVPEDLSDLETAMLEMAEKDIRKAYTITDKQERYAALDALKTEIINKFMPETEEDCKFSVDQIATVFKQLQAKIVRSNILDTKKRIDGRDLSTVRPIQSEVGILPRTHGSALFTRGETQAIVVATLGTGEDEQYIDSLTGMYKETFLLHYNFPPFSVGETGRLGSPGRREIGHGKLAWRAIHPMLPSKESFPYTIRAVSEITESNGSSSMATVCGTSLALMDAGVPLARPVAGIAMGLIKEGERFAVLSDILGDEDHLGDMDFKVAGTANGITALQMDIKIDGITEEIMKIALEQAKGGRIHILNEMAKALTSARAELSEFSPRIEVMNIAVDKIRDVIGTGGKVIREIVEQTGAKINIEDDGTIRIASADAKTIEAAKRWIHSIVDEPEVGVIYQGTVVKTAEFGAFVNFFGSRDGLVHISQLTTERVTKTTDVVKEGDKVWVKLMGFDERGKVRLSMKIVDQKTGKEIIGEDSIKAEQEKYTEETHKSENKRRRKKKEE

SEQ ID NO: 17273 - protein, 371 aa, Mesorhizobium loti
MNPGEKDLARCIGLLRPIDADTLYDVAIVGAGPAGLAAAVYAASEGLSTIVLDCRAFGGQAGASSRIENYLGFPTGITGMALMARAYNQAQKFGVEMVIPDEAKLLSAAADNTGARYLLDVGDGETVRTRSVVIASGARYRRLEVANLSQFEGTSVHYWASPIEGRLCAGQEVALVGAGNSAGQAAVYLASHARKVALLARGGSLDASMSRYLVERIQAQPNIEVLTETEIEALEGEEGNLATVRWRNRVSGEVTTRPISHLFLFIGADPNTDWLAQCNVALDAKGFIRTGSELGPEHGLMETSRSGVFAIGDVRCGSVKRVAAAVGEGAQVVAALHAYLARDSSAAVTPQSMIPKSGDRFSEKDHASTKR

SEQ ID NO: 17274 - protein, 292 aa, Musa acuminata
RHEAVILPVKFPQFFTGKRRPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGNNDEKVLVLAATNTPYALDQAIRRRFDKRIYIPLPDLKARQHMFKVHLGDTPHNLTEKDFEYLARRTEGFSGSDISVCVKDVLFEPVRKAQDATFFCKTSDGMWVPCGPKQPGAVQTTLQELAAKGLGAKILPPPITRNDFEKVLARQRPTVSKADLEVHERFTKEFGEEG

SEQ ID NO: 17275 - protein, 236 aa, Arabidopsis thaliana
  misc_feature (134)..(134): Xaa can be any naturally occurring amino acid
  misc_feature (173)..(173): Xaa can be any naturally occurring amino acid
  misc_feature (186)..(186): Xaa can be any naturally occurring amino acid
MAMAVSGAVLSGLGSSFLTGGKRSATALGSGVGTGAQRVGRKTLIVAAAAAQPKKSWIPAVKGGGNFLDPEWLDGSLPGDFGFDPLGLGKDPAFLKWYREAELIHGRWAMAAVLGIFVGQAWSGVAWFEAGAQXPDAIAPFSFGSLLGTQLLLMGWVESKRWVDFFNPDSQSXVEWATPWSKTAEXNRDGVYEPDFEKLERLKLAEIKHSRLAMVAMLIFYFEAGQGKTPLGALGL

SEQ ID NO: 17276 - protein, 1832 aa, Podospora anserina
MYNPPGQRDATRPFHVPPPPPPMSPPPPTVGINNPMMTIPPPPPRHPNAPSTTGNVLLPPPPSGPPPNSGFPNSAIAPPSALGSTAPWHGAWGRAYDGRTAFNIPPPPPGGGAGGGGGGGSGGVLRAYDPKYHAQVLAAANNGATYTVPPPPPPQQQQQQQQQQQQQQQQQQQQQQQQQQQQQQQQQQQQQQQQQQQQQQQQQQQQQQQQQQQQSDQMGALTSATYIPQGDTYGEGVGIPGLGLEDSAIGWNMGAHLESATATPLDESSGRDRLYANAMAQRGSSTTSNATVSSVSVPPELAAQWPMEKVLGWLQANSFSSHWQETFKYLGLDGARFLELGSSHGGRGNFGMMHQQVYPRLLALSGPEWNQAREREEGKRMRRLVRSIVTGRPVEVKGGRLGGGQQQPQHARQNSTSAPPAVTGGQTGNRSAESPNVSVDDGFWDTGVTDADDGDKQTPNPIKIPEFGFSRRFSQSRATTMPTLSSTMPTDHRNMMKEIDTSRRHSPTLSESGEAGGTFRGGSTPLGGGGGGGGGGGRDSPSAGSPNPASGLFPSSTAGNLSASPHSSRFGHRSRNSTDSVSSSAAIYGSGVPADAAAMLKSGMNIADVVNAARNANDRRHAQDGGRPSPQESGGGDRSAGEPPGSAKGSGSFLSIFTRKKHGRKDDGFGGDEDSPTSPGLSFKPQSLGDNRPGSSAGTYGHHHAGNVRANRGGPRVFILATADCWNYRMLDVTDIETASDLRQLICINLGLPESEGAHLYPTELGKFEHDGEALDDSKLLAIKTQRADAIGTLKLFVRVGGPPQMRQTGAQIAMDEETYVKLNGRMRSSSSPPTSRQNTLTGKEGEDKMLTAEAIEYRTEQLRKQKEYLAKRKQVAENNHVADRSPSSSIVGRTVDFDQPRHSPFEDRKMDTLLPQRKPPAPPSDPSATLIKANSLKKTGHGLRLSGDSGYHPKRKTSSDLRSSGDVVFEKQKRWGPVADPSAGIGALLVGMSDGMASIARPRPGGGMMQQRQPSPHRVATEPITSQELQRGKKAMSTVNFGPAHQRERSGSGGGSPRPGGMPGSPGSYTWSSKNVPFLVPDYSPNGTPAPPTASRMPDGGGNSGDGCLDQNHNHQAQNGTIAKMRNVARAPSPGNVSPSSRRRPSDSFSSQAAVAKKRKSHGPDTDFTDNDVTFSASSTRASKKVDDSDSDDDSDDGLFAIPIAARNSGPDKGKTTAPAEGNSGDSDGASGTGTGKRPSLRLNTRSGSNSRAKKTLSVAFAVSPQSSSAGGKTPLEDDDSGRSSSQRRGTPGTPQSEGGWDSEEKDSKISRRKSFIEKDVWANRPPTDALVNNLEDFFPDLDVDQPVLEEGVDQEPPSPIAEGDENNQGSASVPPLPPLPPGLSTGKLHTFYNDNDTLGSDESTLKALESRPVSMQSLAHRSIRRSGGGGGLGRMKSIREVARGANEFGKRYTQGPGQIDAQSSAAAAGNRNTNLMRRKSTKMFNANIVQIQPDRGSLNLAMGGLTTIPQDSLPTRSTNSRESIPKRQTTFRWFKGQLIGKGTFGRVYLGMNATTGEFLAVKEVEVNPKAAQGDKKKMQELVAALDQEIDTMQHLDHVNIVQYLGCERKETSISIFLEYISGGSIGSCLRKHGKFEEPVVASLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGRRPWSKEEAVGAIYKIANGETPPIPEDIREVISPVAIAFMLDCFTVVSSERPTADVLLSQHPFCELDPTYSFLDTELYAKIAGRVNDLGRGQ

SEQ ID NO: 17277 - protein, 145 aa, Leptospira interrogans
MSFFIPPGGPPGPIPGLQLVFGSVGENSLRKLVSDFYDQIPSSSISFMFPENLEDSKIKSADFLIQVTGGPPLYSQNYGPPKMRARHLPFPIDEKARRVWLSCYRKVLDDWDAEVSAKEVLWIFFKDFSTWMVNLESKTEESNGI

SEQ ID NO: 17278 - protein, 512 aa, Arabidopsis thaliana
MCGILAVLGCSDDSQAKRVRVLELSRRLRHRGPDWSGLYQNGDNYLAHQRLAVIDPASGDQPLFNEDKTIVVTVNGEIYNHEELRKRLKNHKFRTGSDCEVIAHLYEEYGVDFVDMLDGIFSFVLLDTRDNSFMVARDAIGVTSLYIGWGLDGSVWISSEMKGLNDDCEHFETFPPGHFYSSKLGGFKQWYNPPWFNESVPSTPYEPLAIRRAFENAVIKRLMTDVPFGVLLSGGLDSSLVASITARHLAGTKAAKQWGPQLHSFCVGLEGSPDLKAGKEVAEYLGTVHHEFHFSVQDGIDAIEDVIYHVETYDVTTIRASTPMFLMSRKIKSLGVKMVLSGEGADEIFGGYLYFHKAPNKKEFHQETCRKIKALHKYDCLRANKSTSAFGLEARVPFLDKDFINTAMSLDPESKMIKPEEGRIEKWVLRRAFDDEERPYLPKHILYRQKEQFSDGVGYSWIDGLKDHAAQNVNDKMMSNAGHIFPHNTPNTKEAYYYRMIFERFFPQVRVL

SEQ ID NO: 17279 - protein, 199 aa, Zea mays
  misc_feature (139)..(139): Xaa can be any naturally occurring amino acid
  misc_feature (164)..(164): Xaa can be any naturally occurring amino acid
  misc_feature (171)..(171): Xaa can be any naturally occurring amino acid
MTTAPFVSPSLPRLHSARASPFPKPSVGSGGGVAFPARTYGSSLRLRSAVMSASGVGGNGSPMAPEESTVSSRLGEVKRVTKETNVHVKINLDGTGVANSSTGIPFLDHMLDQLASHGLFDVYVKATGDTHIDDHHSNXDIALAIGTALLQALGDRKEFTRFGXFTAPLDXAAVEVILDLSGRPSLSCGLASYRKSGHM

SEQ ID NO: 17280 - protein, 584 aa, Phaseolus vulgaris
MCGILAVLGCSDHSRAKRVRVLELSRRLKHRGPDWSGLHQHGDCFLAHQRLAIVDPASGDQPLFNEDKSVIVTVNGEIYNHEELRKQLPGHKFRTGSDCDVIAHLYEEHGEGFVDMLDGIFSFVLLDTRDNSFIVARDAIGVTSLYIGWGLDGSVWISSEMKGLNDDCEHFECFPPGHLYSSKDRGFRRWYNPPWFSEAIPSAPYDPLVLRRAFEQAVIKRLMTGVPFGVLLSGGLDSSLVASITSRYLANTKAAEQWGSKLHSFCVGLEGSPDLKAAKEVADYLGTVHHEFHFTVQDGIDAIEDVIYHVETYDVTTIRASTPMFLMSRKIKSLGVKWVISGEGSDEIFGGYLYFHKAPNKEEFHRETCRKIKALHQYDCLRANKSTFAWGLEARVPFLDKEFINAAMNIDPEHKMIKRDEGRIEKWILRRAFDDEDQPYLPKHILYRQKEQFSDGVGYSWIDGLKAHAAKHVTDKMMLNAGNIYPHNTPVTKEAYYYRMIFERFFPQNSARLTVPGGASVACSTAKAVEWDAAWSNNLDPSGRAALGVHISAYENQNNLANKGVEIEKIIPMDAAPLGVAIQS

SEQ ID NO: 17281 - protein, 206 aa, Buchnera aphidicola
MIVQKKKHRSNRWLLEHFQDQYVKAAKKNNIRSRAWFKLEQLDKNNKIFKIGMNVIDLGAAPGSWSQYASNRIGKKGRIIACDILPIRPITGVDIFQGDFRNKKTLNLMLNTFSNITFHLVMSDMAPNITGNFSIDMPRIIELCKLALKISEHVLSKNGIFLLKSFQGEGFNELYKEIKMLFKKIKICKPKTSRTRSREIFILATR

SEQ ID NO: 17282 - protein, 258 aa, Arabidopsis thaliana
MQVLVVSPPLIAAASLSKPLNSLSKAALSFSRAKPICPFPQTSRRPISVYKSPMNNLFNRLGFGSRPQAQADPSSAAIAQGPDDDVPSSGQQFAQFGAGCFWGVELAYQRVPGVTKTEVGYSHGIVHNPSYEDVCTGTTGHNEVVRVQYDPKECSFESLLDVFWNRHDPTTLNRQGGDVGTQYRSGIYYYTDEQERIAREAVEKQQKILNKKIVTEILPATKFYRAENYHQQYLAKGGRMGLRQSAEKGCKDPIRCYG

SEQ ID NO: 17283 - protein, 485 aa, Pseudomonas putida
MSEEILINITPMESRVAVVENGVLQEVHVERTQRRGIVGNIYKGKVVRVLPGMQAAFVDIGLERAAFIHASEISQREGSAVENITALVHEGQALVVQVTKDPIGTKGARLTTQLSIPSRYLVYMPRSSHVGISLKIEDEAERERLKQVVSDCMDSENIKDAGGFILRTAAEGARAEEILQDIRYLRRLWEQIGTQIKTCGAPTVIYEDLGLALRTLRDLVNPKIEKIRIDSRETFQKTTQFVGELMPEIADRLEHYPGERPIFDLYGVEDEIQRALERKVPLKSGGYLVVDPAEAMTTIDVNTGAFVGHRNLEETIFKTNLEAATAIARQLRLRNIGGIIIIDFIDMEDEEHQRQVLRTLEKQLERDHAKTNIIGITELGLVQMTRKRTRESLEQVLCEPCLACQGRGKLKTPETICYEIFREILREARAYQAEGYRVLANQKVVDRLLDEESGNVAELEAFIGRTIRFQVESMYSQEQYDVVLL

SEQ ID NO: 17284 - protein, 202 aa, Unknown
  Candidatus Tremblaya princeps
MGRTSEWYARHVGDSFVRTSKAWGYRARAACKLKRLDAKYGLMSRQCDVLELGSSPGVWSQYISYERRVSGMAWRTVSVDTRAMVRVRGVSFIHGDITEAETMAEVSSRLPSGVGLILSDICPHPSCERYLDSIATAKVAETLLMVSRRFLLDGGALLHKTFVIRAEHIASVMERHFSSVEVYRDASSRSFNSEAYLLCVGD

SEQ ID NO: 17285 - protein, 104 aa, Brassica rapa
YSSMFHPFNGSMDAEERRHISSTTEHSAIDNHCSANSSSVGRTQQSLQREAALNKFRMKRKDRCFDKKVRYESRKKLAEQRPRIKGQFVRQVQSTETSTQEAPQ

SEQ ID NO: 17286 - protein, 367 aa, Coxiella burnetii
MAKRDYYEVLGVNLNATEAEVKKAFRRLAMKYHPDRNPGDKDAEVKFKEAREAYEVLCDSRKRASYDQFGHAGVEQTFGGAGAGGFGFGDLGDIFGDIFGDIFGGARGGQAREQRGADLAYELVLSLEEAVHGLSRTIKVPTWINCKTCNGSGAKGSSPATCPRCNGSGQMRMQHGFLQVQQTCSVCRGRGQVIKDPCTDCHGQGRQQQTKTLSVKIPPGIDTGDRIRLAGEGEAGLFGAPPGDLYVQVRVKPHPLFHREGNDLHSEVPIDFTTAALGGEMEIPTLDGSVRLTIPPETQGGKQFRLRGKGVKALRSGAVGDLICHIVVETPVKLSPEQKDYLKQFAELLKKDEKNHSPRTRNWFGTV

SEQ ID NO: 17287 - protein, 321 aa, Ralstonia eutropha
MAKHAKVLILGSGPAGYTAAVYAARANLEPVLITGLAQGGQLMTTTDVENWPGDAKGVQGPELMQRLLAHAEEFKTEIIFDHIHTAKLVDESGNPARPFRLIGDAGEYTCDALIIATGASAQYLGLPSEESFMGRGVSACATCDGFFYKNQEVAVVGGGNTAVEEALYLSHIASKVTVIHRRDSFRAEPILVDRLLQREKEGRVEIRYDSVLDEVLGDDSGVTGLRIRGAKSGETQDLKLAGVFIAIGHKPNTDLFVGQLAMENGYLVTKSGLSGDATATSVPGVFAAGDVQDHVYRQAITSAGTGCMAALDAQRYIEALK

SEQ ID NO: 17288 - protein, 235 aa, Huperzia lucidula
MEPKYWNINLEEMMEAGVHSGHQARKWNPKMAPYIFAERKGIHIINLTRTARFSSEACDSVANVASEGKQFSMVGTKYQAADLTASAAIKARCHYVNKKWLGGMLTNWSTMEKRLQKLRDLENKEKTGGFDRLPEKEAAISKGQLAKLKKYLGGIEYMASLPDVVTIVDQREESIAIKECITLNIPTICLVDTDCDPDLADIPIPANDDARASIRWISDKLASAICEGRKSYMKD

SEQ ID NO: 17289 - protein, 420 aa, Alkalilimnicola ehrlichei
MTEDIRAYMQTLGRQAREAAREMARADTGHKNAALHAMADALEEHAGDLKRANADDLENGRANNLDPALLDRLELNDERIHGMAEGLRQIAALPDPVGAIRDLAFRPSGIQVGRMRVPLGVIGIIYESRPNVTADAAALCLKSGNAAILRGGSEARHSNAAIAACVRAGLKRAGLPGEAVQVVETTDRAAVGELIRMDEYVDVLVPRGGKGLIERITAEATVPVIKHLDGICHVYIDDSADPAKAISVAYNAKTQRLGTCNTMETLLVAEAIAERVLPELARRYRESEVELRGCEATRRLIPDAVPATKEDWSTEYLDAIVSIRIVPGLDEAIEHIARHSSGHTESILTEDWSRARRFLREVDSSSVMVNASTRFADGFEYGLGAEIGISTDKLHARGPVGLEGLTTEKFIVLGDGHIRE

SEQ ID NO: 17290 - protein, 112 aa, Ralstonia eutropha
MKQITAIIKPFKLDEVRESLADVGVTGLTVTEVKGFGRQKGHTELYRGAEYVVDFLPKIKIEVVVAENQLDTVLDAVVKAAHTGKIGDGKIFVTEIERVIRIRTGEQDEAAV

SEQ ID NO: 17291 - protein, 1030 aa, Vibrio angustum
MNNWENFQHLHENRIAPRAYFFSYDSVKHATTFQRELSSRFMLLSGQWQFEYFSNPLLVPEEFYSQLMTQWGQITVPNMWQMEGHGDLQYTDEGFPFPIDVPFVPSDNPTGAYQRTFTLGADWNNKQTLIKFDGVETYFEVYVNGQYVGFSKGSRLTAEFDISAFVQQGNNLLSVRVMQWADSTYIEDQDMWWTAGIFRDVYLVGKEQLHVRDFTVRTDFDIAYQNATLSCDVELENLTASAQTALVEYQLMDGTTLIAEGAVADLHVSDSAKAQFAIDVTAPVQWNAENPYLYQLLLTLKDRQGNVLEVIPQRVGFRDIKVRNGLFYINNKYVMLHGVNRHDNDHLKGRAVGMDRVEKDLVLMKQHNINSVRTAHYPNDPRFYELCDIYGLFVMAETDVETHGFANVGDLSRITDDAEWETVFVDRAVRHVHAQKNHPSIIMWSMGNESGYGCNIRAMYTATKAIDDTRLVHYEEDRDAEVVDVISTMYSRAQLMNHFGEFPHAKPRIICEYAHAMGNGPGGLTEYQNVFYKHDHIQGHYVWEWCDHGILARDEHGTKFYKYGGDYNDYPNNYNFCMDGLIYPDQTPGPGLKEYKQVIAPVKIREVDAKQGQFIVENKLWFSNIDDYTITAEVRAEGETLLVKQIKLTDLAENSEQMITLAWPELDEREVFVNFTVRKDSRTRYSAANHDIAVYQFELKTNTAQLESFVNHNATELAIEETRLDYVVKGYNFALNFSKVNGKLTSWLVDGKELIQSSPKLNFFKPMIDNHKQEYEGLWHPAHLQIMQEHFRSLNVEMNDGQCEITVTSIISPPVFDFGMRCHYRYQVNAQGQLNVELSGERYGDYPHVIPVIGLDLGINGEFDQVQYYGRGPEENYQDSRQANMIDVYSTTVSDMFENYPFPQNNGNRQHVRWAALADKHGTGVLVKPQQEINFSAWFYTNQHLHQAQHTHALEKSGYITLNLDHQVMGLGSNSWGSEVLDSYRVYMDSFRYGLTVLPFTAGDCRPQALANHDFDSAFFTTTAPQTNKA

SEQ ID NO: 17292 - protein, 484 aa, Unknown
  Candidatus Protochlamydia amoebophila UWE25
MHMTQADIGLIGLAVMGQNLVLNMNDHGYTVAVYNRTTSKVDEFLDGPAKGTKVIGAHSLKDLISQLKRPRRVMLMVKAGEPVDNFIEQCLPYLEKGDILIDGGNSLFTDTNRRCNSLKEKGIIFIGTGISGGEEGARHGPSIMPGGNPEGWPHIKEIFQSISAKVEGEPCCDWVGDQGAGHYVKMVHNGIEYGDMQLISEAYYLLKEALHLNQNELYQVFADWNKGDLDSYLIEITSKIFKVNDEDGKPLVDKILDVAGQKGTGKWTVINALDLGMPLTLIGEAVFARCLSALKDERVAASELLKGPDAKFEGNREEFIQAIREALYSSKIISYTQGFMLMQQAAAEYKWQLNYGAIALMWRGGCIIRSQFLGKIKEAFKLNPNLKSLLLDEYFLQEIQKRQKGWRKVVSKSVELGIATPCFNTALVFYDGYRTAKLPANLLQAQRDFFGAHTYERGDRARGQYFHTDWSGTGGKVSSGSYNA

SEQ ID NO: 17293 - protein, 386 aa, Unknown
  Synechococcus sp. WH 7805
MRVSSAASNTYNERVFTLVVVGLQASKQRRSEQTFKVSYDQLQSTVQRINSCGGRILSVTAGSSRTTAHTSVSTASATSTVTETPSKPAHKAVPVNLYKPKSPFIGTVTENYSLLKEGAIGRVQHITFDLSGGDPHLAYVEGQSIGIIPEGEDAKGKPHKLRLYSIASTRHGDNLADNTVSLCVRQLEYKNDAGEEIKGVCSTYLCDIEPGTKVKITGPVGKEMLLPDDEEANVIMLATGTGIAPMRTYLRRMFEPSEREKNGWTFRGKAWLFMGAPKTPNLLYDEDFEHYEREYPDNFRYTKAISREQQNSKGGRMYIQDRVLEYADEIFAMIENPKTHVYMCGLRGMEPGIDEAMSAAAAAKGLDWSELRPQLKKAERWHVETY

SEQ ID NO: 17294 - protein, 439 aa, Myxococcus xanthus
MFYAFVRAVVALCLRLFYRVKVNAPALEPDGPVLFVGNHPNGLIDPALVFILTRRKVTFLAKAPLFRMPVIGWLLKGLDALPVYRKQDDPAKMGGNEGTLEAAKGALVQGRAITIFPEGKSHSEPGLAELKTGAARIAVSAAKAGAPVRIVPVGLTYAEKHVFRSEVLIDVGPAIDVQDFLPADAAAEPDAVRALTERIASGLRAVTLNLEQWADLPLAQLAEQLFAFKQGGALDAERLRLWARGVQMFRAQEPERFESLRAQLAGFRHRMALVQATGLEDLALVYRPGNVVPFVVKNVLALALGLPLFALGLGLFWLPYQLPRLASRNAELDVQATVKFLTAFVVALVWWGVLTAAAAVWGSALLSVAVFLAVPPLALFTLYFAERWESLQRDIRVFFTLGNRARLKRLLLADGERLALEMERLADEYRPRLDAAAQP

SEQ ID NO: 17295 - protein, 375 aa, Myxococcus xanthus
MSAAAGQKRDYYEVLGVQKSVSAQELKSAFRKVALQYHPDRNPGNSDAEEKFKEASEAYEVLSDPERRAKYDRFGHAGNPFDGFGGAGGGFQGVNINDIFGEIFGDIFGGGRGGRRTSSRGADLRYNLEITFEEAAFGCRPKVTIPRPKKCDTCSGSGSKSNTGPRPCSACGGSGELRYTQGFFAVSRPCGDCGGTGAVVPDPCTRCKGSGKVPSEEVIEVAIPGGVDNGTRVRLSGMGEPGDRGGPPGDLYVTVIVKEHPLFQREEYEVFCEVPISFTQAALGAKIDVPTLDGKVKMTVPNGTQSGKVFRLKGKGIPHLHSQQRGDQHVRVVVETPTELSSKQRELLEKFAEASGEESHPQSKSFIAKVKELFG

SEQ ID NO: 17296 - protein, 310 aa, Candida glabrata
MKMYVAQSNENVTKAGVPEFTNDKKVVVGELVFGKFNQDQQAILRDDSNAANNNYGDTLMDPTNAIPTDFFGSTIDQHFTNDNNDIDAAVVDAFFSSSTDSTPMFDYDDNQLAGNTVSGSSDNPENWTSLFDDDVEIKVEDVFGADAAGASITQFEQQKPEPVIAIKQEENSMGHNLIIPKTSFLPTPVIEDGKLDSSIKKANRVTKKSTVGSPVSPCLSSVKKDEKVDHLGVVVYNRKKRSQALTPVIPESDDPASLKRAKNTEAARRSRARKLQRMNQLETKVEELLKKNNELENEVRRLRGLLGESA

SEQ ID NO: 17297 - protein, 165 aa, Staphylococcus aureus
MNNRNVYDIEVSDYKGLTYKLEAFRGKVILVVNTATECIYSEQLKKLETLFQKYKDRGFVVLSFPNNNFDNRQPGSNEEILKISREKFGVTFPVLAKISVNGNDEHPLFTHLKNEQPGIFGSPIKWNFTKFIIDRQGNVVNRFLPMEDPLDISTNIEILLQESSS

SEQ ID NO: 17298 - protein, 715 aa, Escherichia coli; identical to SEQ ID NO: 14186
  misc_feature (140)..(140): Xaa can be any naturally occurring amino acid

SEQ ID NO: 17299 - protein, 456 aa, Arabidopsis thaliana
MCGILAVLGCSDDSQAKRVRVLELSRRLRHRGPDWSGLYQNGDNYLAHQRLAVIDPASGDQPLFNEDKTIVVTVNGEIYNHEELRKRLKNHKFRTGSDCEVIAHLYEEYGVDFVDMLDGIFSFVLLDTRDNSFMVARDAIGVTSLYIGWGLDGSVWISSEMKGLNDDCEHFETFPPGHFYSSKLGGFKQWYNPPWFNESVPSTPYEPLAIRRAFENAVIKRLMTDVPFGVLLSGGLDSSLVASITARHLAGTKAAKQWGPQLHSFCVGLEGSPDLKAGKEVAEYLGTVHHEFHFSVQDGIDAIEDVIYHVETYDVTTIRASTPMFLMSRKIKSLGVKMVLSGEGADEIFGGYLYFHKAPNKKEFHQETCRKIKALHKYDCLRANKSTSAFGLEARVPFLDKDFINTAMSLDPESKMVTTKLTSQTQYLPSQVNVEQIFYMGFSRSSQRKEGSRNGF

SEQ ID NO: 17300 - protein, 263 aa, Triticum aestivum
MAAAGVSREQRWSLAGATALVTGGSRGIGHAIVEELVGLGARVHTCSENAAELEESRRRWEEMKLPVTVSVCDVSVRAEREKLIETATQTFDGKLDILVNNVGRNLAKASVECTAEEYSHLMSTNLEAAFHLSQLAHPFLRDASVAGGGSIVNISSVASSLGYSTLAVYCISKGGVNQLTRSLAAEWAQDKIRVNSVAPGGINTELQKSVDPEIVENTLSRTPMHRLGEPVEVASMVSFLCMPAASYVTGQVIYVDGGRTISG

SEQ ID NO: 17301 - protein, 227 aa, Gibberella zeae
MASSQPTRWAALARDTNETKIQLALNLDGGDFPPDTDSRLLDNDDSHASQASKSQKIAVNTGIGFLDHMLHALAKHAGWSLALNCKGDLHIDDHHTAEDVCIALGYAFAQALGTPAGLARFGYAYAPLDEALSRAVIDLSNRPYAVVDLGLKREWLGQLSTEMVPHCLQSFAQGARVTLHVHCLHGDNDHHRAESAFKALAIAVKAATTRIPGKEGEVPSTKGTLSA

SEQ ID NO: 17302 - protein, 255 aa, Humulus lupulus
MASAGPATALRTISSSSPKLHNTRSPFSSSLSPPKSSLSFTKVLSPALISTPKLQITSNPSSKTYITCRSQASPSESEKPIKVHELRVYEINERDRSSPAYLRLSQKEVNSLGDLVPFSNKLYTGCLQKRIGITAGICTLIQNKAEKKGDRYEAIYSFYFGDYGHLSVQGSYMTYEDTYLVVTGGSGIFEGAYGQVKLQQLIFPFKLFYTFYLKGIKEDLPEELLGVHVEPSPSVEPSPAAKACEAHAVIQSFTD

SEQ ID NO: 17303 - protein, 424 aa, Unknown
  Mycobacterium sp. HXN-1500
MIHTGVTEAVVVVGAGQAGAQTVTSLRQRGFEGQITLLGDEPALPYQRPPLSKAFLAGTLPLDRLYLRPAAFYQQAHVDVMVDTGVSELDTENRRIRLTDGRAISFDHLVLATGGRPRPLACPGADHPRVHYLRTVTDVDRIRSQFHPGTRLVLVGGGYIGLEIAAVAAELGLTVTVLEAQTTVLARVTCPTVARFFEHTHRRAGVTIRCATTVTRIHDSSSTARIELDSGEYIDADLVIVGIGLLPNVDLASAAGLTCESGIVVDSRCQTSAPGIYAAGDCTQYPSPIYGRPLHLESVHNAIEQAKTAAAAILGRDEPFRQVPWFWSDQYNIKLQTAGVNEGYDDVIIRGDPASASFAAFYLRAGKLLAVDAINRPREFMASKTLIAERAEVDPTQLADESLPPTALAAAVNGPTRATSPTSL

SEQ ID NO: 17304 - protein, 298 aa, Unknown
  Nocardioides sp. JS614
MITNSEAGTSDEESLAAALAVLRERASVEVAATANPGELDGVLHRAGSRRIVVAGGDGSLHAVISALHRRQELGGATLGLLPLGTGNDFARGTGIPLDIEDAARVVLRDRPRPMDLVVDEVGEIVVNSVHVGAGAEASRKGASWKNRLGSIGIGRLNLGRLGYPIGAALTAIDPPSVRVRVEVDGEPICDLNDPVLMVAIGNGPSVGGGTHLTPEASPLDGKVDVMISRAVGPVSRLLYGARLGLGTHHRQDDSTYLRGSTVSVSGGPFWCSADGEVYGPERQRTWRVEPGAYSMLLP

SEQ ID NO: 17305 - protein, 358 aa, Xanthomonas campestris
MSQSKPLFPLNAWYAVAWDHEIKHVLSPRKLCNLDVVVYRTTAGAVVALEDACWHRLVPLSMGKLRGDDVVCGYHGLVYNTQGRCVHMPSQDTINPSACVRSFPVAEKHRYVWIWPGDPAKADTRLIPDLHWSHDPAWAGDGRTIHAKCDYRLVLDNLMDLTHETFVHGSSIGQDEVAEAPFDVVHGDRGVIVSRWMRNIDPPPFWASQIARHLDYRGKVDRWQIIRFEAPSTIAIDVGVAIAGTGAPEGDRSQGVNGYVLNTITPETDTTCHYFWAFMRNYALHDQSLTTLTRDGVTGVFGEDEAVLEAQQRAIDAHPDHTFYNLNVDAGGMWARRVIDRLIAQEQRAQDLSLRMVG

SEQ ID NO: 17306 - protein, 342 aa, Unknown
  Oceanospirillum sp. MED92
MTVLKKVAVLGGGSFGTVIANLIAENGYDVQLWMRDQQRADQLNYEHENKRYLPGYSLSEKVVATSDLQSVVQDAELVFVSIPSQSFRDVIKQAKPFINEGQMFVSTTKGIEAKTFSLMSEILSEELPGAQVGVLSGPNLAKEVVAKQLTATVVASESQLLRSSVQTILHSSYFRVYASSDTYGVELGGTLKNIYAIAAGLSAALGMGENTRAMLMTRSLAEMSRFAVCMGANPMTFIGLAGVGDLIVTCMSPLSRNYRVGHALGEGKTLEEAVEALGQVAEGVNTIKQVKEKASEMQVYMPLVTGLYEVVFNHAPVAEVVKMLMMNEQSTDVEFVLPRGDI

SEQ ID NO: 17307 - protein, 562 aa, Zea mays
  misc_feature (436)..(436): Xaa can be any naturally occurring amino acid
MMANRLAGHLNAMVSPNQTAFIKKRFILDNFILVQRTARYLHQQRQARILFKLDISKAFDSVSWPFLIEVLRKMGFGQIWLSLYADDAVVFLRPVASDINLVLEILRLFGEASGLKTNIPRVNILPLSLGKLSKAQLQALVDKAANVLPGWKADLMTKAGRAVYVQFVLTAKMIYAAMALDLPNWTIKAIDKVRRGFLWKGRKQANGGHCLVAWGKVTRPKDLGGLGITDLRLLSVALRARWPWLQRTDHSKPWSVLPAQACGAVEALINVAVVSQFGDGHDILFWKDRWLNGRCIGEVAPVVLEHVPKRVASKRLGTSQVLCPSTGDDCFDSWWEKSAEVVGKPLSDGFNSLVILVEKEKPSQLFGTYDFDSSPFDWGDNYKLPNLPETDLVIYEMNVRAFTADESSKLGPAIRGSYLGVIDKIPHLLELGVNAXELLPVFEFDELEFKRFPNPRDHMVNTWGYSTINFFAPMSRYASAGGGPVAASKEFKQMVKAFHNAGIEVILDVVYNHTNEADDANPYMTSFRGLDNKVYYILDLNNSAQLLNFSGCGKTMVLSFSF

SEQ ID NO: 17308 - protein, 492 aa, Alkalilimnicola ehrlichei
MAQEILINVTPRETRVALVENGVLQELHLERARRRGLVGNLYKGRVVRVLPGMQAAFIEAGLERTAFLHASDIARAEPAPVGDEPNGRPPPLPIDELLTEGQEVVVQVLKDPIGSKGARLTTHITIPSRYLVLAPGSRALGVSARVEDPAERERLRAIGESLLADRGDMGIIVRTAAEQVAEEALRADFDFLLRLWQSISERAAHASAGQRVHEDLPLTVRAMRDLAGSEVERVRVDSRENYLNVVSFCRRFLPEMAPRVEYYPGERPLFDLYNIEDEILRALNRRVPLKSGGHLVIDQTEAMTTVDVNTGAYVGHRTLEETIFKTNLEAAQAIARQLRLRNLGGIIIVDFIDMVEEEHKRQVLRALEKALQKDHAKTQISGVSALGLVEMTRKRTRESLEHQLCESCPTCGGRGSVKSAETVSYEIFREILREARQFESRRLVVLAATEVVDLLLEDESTSLAQLEEFIGRPIELQAESLYTQEQFDVVLM

SEQ ID NO: 17309 - protein, 455 aa, Oryza sativa
MAAAGASALRPHLALLPAGGGGGGGGGTRSYALQALSFVSPLLPHCGRRRRCVLRSKASSSPSPPPSPGKEAVAVPTAESCVNLGLELFSKGRVKDALEQFENALELNPNPVEAQAALYNKACCHAFREESNKAADCLRTALRDYNLKFGTILNDPDLAPFRASPEFKELQEEALRGGEDIGSGFRRDLKLISEVQAPFRGVRRFFYVALTAAAGISTFFTIPRLILAVQGGDGAPDLLETVGNAAINIGGIVVLVALYFWENKKEEQQITQISRNETLSRLPVRLSTNRIIELVQLRDITRPVILAGSKASITRAMQRAERYRTELLKRGVLLIPVIFGASQKAQSKPRGFGSSRSAASAPSVGDDFEKRTESIAAKSRLKAEERFKADIVSPEQWESWIRDQQESEGVTPGEDVYIILRLDGRVRRSGRGMPNWNDILQELPRLEELLSKLER

SEQ ID NO: 17310 - protein, 452 aa, Pseudomonas putida
MQDQSTPERLQRGLKNRHIQLIALGGAIGTGLFLGIAQTIQLAGPSVLLGYAIAGLMAFLIMRQLGEMVVEEPVAGSFSHFAHQYWSEFAGFVSGWNYWVVYVLVGMAELTAVGIYVQYWWPEFPTWATAAIFFVAINLINLTQVKVYGEMEFWFALVKVVAIVSMIGFGAWLLSSGHGGPDASVANLWQYGGFFPNGVSGLVMALAVIMFSFGGLELVGITAAEADNPRQSIPKATNQVVYRILIFYIGALAVLLSLYPWQKVVQGGSPFVMIFHELDSDLVATILNIVVLTAALSVYNSCVYANSRMLFGLASQGDAPRQLLKVSRSGVPLTALGVSAFATGLCVLINYLMPGEAFGLLMALAVSALVINWASISITHLKFRKAKLAAGIIPFYKSLGHPLTNYLCLAFIVLILVVMYLTPPIRISVMLIPAWIAVLWVAFKLKKARQAK

SEQ ID NO: 17311 - protein, 563 aa, Erwinia carotovora
MSTSLPWWQNGVIYQIYPKSFQDSTGNGIGDIAGVTARLDYLQQLGIDAIWLTPVYLSPQVDNGYDVADYCAIDPAYGTMADMETLIAEAHRRRIRIVMDMVFNHTSTQHHWFQNAQDRRSPYRHFYIWRDGNDGAPPNNWRSKFGGPAWLWHAESKQYYLHLFATEQADLNWEHPRVRDELKQVCGFWADKGVDGLRLDVINLVSKQQDFPSDTQGDGRRFYTDGPLIHDYLQEFSQDVFQPRGLMTVGEMSSTSLEHCRRYAALDGSELSMTFNFHHLKVDYPNGEKWTLAEPDFIQLKLIFNHWQQGMHNHAWNALFWCNHDQPRIVSRFGDEGEFRVQSAKMLAMVLHGMQGTPYIYQGEELGMTNPGYTQIEQYRDIESLNQFAEQRDRGQVDEQILAILASKSRDNGRTPMQWDESDHAGFTTGTPWITPSQNFPHINAEQSLADKESVFYTYQQLIAMRKALPLLTHGDYKDLLPDHPNVWCYQRTWEGQRLLVLANLSKQPLRWQPPMETHDRRWRLLFSNYSDAQPQPAILELRPFEAIYWIQGMQEKEDKIQE

SEQ ID NO: 17312 - protein, 196 aa, Cenarchaeum symbiosum
MRPLDAKKDHYRKMAREQGYRSRAAYKLKELNKAYRIIGAGFTVLDLGCAPGSWMQVAASAAGNRGTVLGVDLEYAEELNHAESMRGDVEDESLAETVAERLGRADAVICDLSPQVSGNWSVDHARQISLNYAAARIMGRVLAPKGNAVFKVFDGEYAAEFREHMGHMFSKTKSTKPQASRKQSSELYLVCLGFRG

SEQ ID NO: 17313 - protein, 489 aa, Vibrio angustum
MTNKTVTEQHVVIWFRSDLRVVDNTALNHAIDSGLPIIALFIATPMQWHQHNMAAVQVDFIHRRLQVLKQQLAKRNIPLQVIEVNDFAESVHVIDQICFDYNAVHVFANKQYPINEQQRDNSAGELIAKKGIKFSIFDDNYILQPETVLTRDGELFKVFTPFRNAWIKRFTLSPCYPVTKDGYIVTSDAVIKLLSVSNPIKAFNYPIIDSVLWPVDEETIAQRLETFFETKAETYHQNRDFPAIDGTSCLSPYLAIGALSARQCLYQLLQHFPNALEINKDDGAFTWLNEIVWREFYGHLLHRYPELSQYQPFQKFTRFVQWKDDAVLLKAWQEGKTGFPIVDAAMRQLRSTGWMHNRLRMITASFLTKDLLCDWRVGEQWFMQHLIDGDFASNNGGWQWAASTGTDAQPYFRVFNPTLQGQRFDPKGDFIRTWVKELEHVPDKYIHTPHQWASAESLNYPLPIVDHKEARLIAIESFKQAKAYMDIHQ

SEQ ID NO: 17314 - protein, 510 aa, Oryza sativa
MATFFRSANLASRVFDRQFLSPRPGATVNTVRQFYENLVPSYTICDIDCPDYSFRKFTDDGNYLVAFSRNHQDLIVYRPIWPTFSCNEPCDSHDLPPKAKKFDSFFKQLYSISLASSNEYICKDFFLYMECHQFGLFATSTAQSNDSSATEGAIHGVPSIEKITFYLVRLDDGAILDEKAFRNDFINLAHSIGAYLYEDLLCIVSLRYQTIHVLQIRDSGNLVEVRKIGAFCQEDDELFLHSHGQFFTFSDLDFKDCKYQLDAARGVSFLPGIKQRLLSFIFRKTWNEESDQTLRVQHLKKKFYFHFQDYVDLIIWKVSRSTEQNSAFFAVYNMETTDIVSLYQNSSEELYSLFEYFYDHFHTNPQNSSHGNFISSHSNNVHALDQLRTIKNKANSTSQQFVKKMMASLPYTCQSQSPSPYFDLSLFRYDEKLISAIDRHRHCTEHPIKFISVKQPNVVKFKIKPGSDSGASDSRAKRISSFLFHPFFPLALSIQQTYMQPTVVNLHFRR

SEQ ID NO: 17315 - protein, 623 aa, Cryptococcus neoformans
MSDNEQVAFFTYILERLKQCGVKQIFGVPGDFNLTALDYIEKDPELQWVGNANELNAAYASDGYARVKGTLAVVITTFGVGELSALCGIAGCLSERVPVLHIVGAPSTSLQAKQSLLHHTLNLPESFSTFSSMSAPLSCSQALINNIEPKTPTSWTEAFDKTLKAVLEQCRPGYVEVPTDAVHAKVSAEGLKQPLPPPHSAPPPESMGTSLSNTSASAASRGAAQVSLSTAPTNVPSAPSSDDVTAHVVEDITKRFGEAKKPIILVDACAGRFGMAIEVRKLVDACGIRFFETPMGKSLMDERHPLYGGCYAGANSLPTVQKEVESADFVLYVGALKSDFNSGSFSVNIDPKVIVELHSFTTTIGYASYPTTDIRTILPLLRPAFEKLGRGKQSEGQSVEQKVEDKSVDSPVVPDPKGDEIKHEWLWPRVGKWFQDTDIIITETGTSSFGLTNVVLPSNSTYIAQILWGAIGWSVGACLGAAMAAKENGNNRRTVLFVGDGSLQLTLQEIGTMLRRGVHPYIFVLNNDGYEIERQIHGWTAEYNDIQLYDHQLLLPFLAGKKTKTPYQSYAVHTPQEFSKLLDDEEFNKPDRLRLIEVFMPRGDAPAGLIRQAKLTAEANDRI

SEQ ID NO: 17316 - protein, 831 aa, Vibrio vulnificus
MHFDSGLLALLFVIIALFIGALVRHLLKGSQVPYTVALLILGIAIGLAHRGNIFADNYTFIGETLSLASEIDPHLFLFLFLPTLIFESAFAMEVHLFRRMFTQIVILAVPGLMLAIWLTAELVAWVLPEHWQWSWALCLMFGALISATDPVAVVALLKEVSSRKRLETLIEGESLLNDGTAIVFFSLFYGWVLMEFSNPGEAITAPPWQAVAQFFVVVFVGLAVGLILGGLCILWIDRVFNDPMIEISLTIAAAYSAFFISENFHVSGVVAVVTLAIMFASVGRTRISPEVAGFLHHFWEMMAHMANTLIFLLVGILVAIRVPLDDKEAWLALFVLYLGIMAIRACSITVFMPILKRIGIGITYEKAVVLCWGGLRGAVSLALAMTVASSDIIPKQIGDHVLFLCAGIVVLTILFNGSTMGHVLKWLNLSSLPPGKQATVDKAQHEINRVLHDMLPKMMTSDFLKGADWETVKQGAKLQVLKECNSPTEITQDELHTAYLRRLLETERKHYWTQFSQGLIGKQATNKLVEAVEHALDGDPIIGPRNELFTTWRLPDWVEPLRQYNSWNKLLLKVYFRRLALGYDVARGFIQAQEALESHIDTLAPDAEIAVMVRQQVELNKRLTFERIESLRMSFPEIIQALQSQAATRLLLNRERAVINDQLKQAVLDKPEAQKLLNMVEERMAALQKESIFDKSQEQKLINDIPWARELKSKTREELTSWIEHTVYDAGQLICENQRPLNRIGIVSRGSITELYETRSDDNLEKVRTTIGPGETFALISLLTGKTNAQYVSDTPTDIMWLPVDKLKLLMNQDPNLTAVVCQLFKQLKSV

SEQ ID NO: 17317 - protein, 466 aa, Photobacterium profundum
MTYAPVTDVLSGKLAVDSEVTVRGWIRSRRDSKAGISFLAIYDGSCFDPIQAVVPNELNNYQEEVLKLTTGCSVEVTGKIVESPAKGQDFELAATEVKVVGLVEDPDTYPMAKTRHSIEYLREVAHLRPRTNIIGAVARVRNCLSQAIHRFYHEQGFFWMSAPLITASDCEGAGEMFRVSTLDMANVPMTDAGEVDYDKDFFGKETFLTVSGQLNAETYACALSKVYTFGPTFRAENSNTSRHLAEFWMVEPEVAFADLDDAAKLAEDMLKYVFKAVLEERRDDLEFFAQRINKEAITRLEQFVTSDFAQVDYTDAIQILQDSGRKFEFDVEWGIDMSSEHERYLAEEHFKAPVVVKNYPKDIKAFYMRMNDDGKTVAAMDVLAPGIGEIIGGSQREERLEHLDKRIAEMGIDASHIEWYRDLRRYGTVPHSGFGLGFERLVTYVTGMQNIRDVIPFPRAPRSANF

SEQ ID NO: 17318 - protein, 177 aa, Medicago truncatula
MGMAAENQFHVLAVDDSIIDRMLIERLLKTSSFNVTTVDSASKALKFLGLVEDEMRTYDTHVASEINQDVDVNLIITDYCMPGMTGYDLLRKIKESKSFKDIPVVIMSSENVPSRINRCLEEGAEEFFLKPVQLSDVSKLKPHLLKSKVKEENEQPIKRKGMEETQSPDKTRPKVSI

SEQ ID NO: 17319 - protein, 176 aa, Perilla frutescens
MAADEEPNTSLNKGAWTADEDGILAQYVAQHGPKRWKSLAIDAGLNRCGKSCRLRWLNYLRPDIKRGNFSDAEDDLILRFHRLLGNRWSLIAKRIPGRTDNEIKNYWNTHLRKKARLMEKLPAISVTAAMELNIWHDESSSSGTEIRDDDESFDFTAQGTSGLDWVKTFLELEEDA

SEQ ID NO: 17320 - protein, 545 aa, Mycoplasma penetrans
MRKITIGNYLLERLSEIGIKDIFGVPGDFNLGFLDDIIKNEDLNWIGCTNELNASYSVDGYARVNGIGAILTTYGVGELSAVNGIAGSYSEDVPVIHIVGTPKREYFKRHMILHHSLGTSDSFGAYKKIYENITSLTVWLDAKNAINQINNAIKYAVFYKKPVYIMIPQDVASFEIMADSDLLSFASGFDLEEHKEIIEDVKNKINNSNQAVIISGHKVIRYGLKSDLEKFVNRNGINVVTTGFGKGSVDETNELYLGVYSGLKTPDAAIAKIIDTADLVLIIGNKFTDLTSSFFQLNFNKDNVVEISDTHVKYDNKIFTNHSFGFLVKMLANDTNINYKGLSVLENRVAVEFNPTEEKITYNRLQVALNNYFVEKDILVSDVGTCTFLSQYIQLKKDMKFIMQPLWASIGFSFPASIGAQIASNSKVVNILGDGAFNMVFNELITVINKQIPITTILLNNNGYTIEKVIHGDGKPYNELPKVNYSQLIKAFDPEGEKSISLRVTNEIELQEALVISRSSDKFVFIEVCLEQNDIPEALKGFFNK

SEQ ID NO: 17321 - protein, 468 aa, Photobacterium profundum
MELLREREMEKPRLSFWQIWNMSFGFMGIQFGFGLQNANVSRIFETLGASIDQIPILWIAAPLTGLLVQPIIGYFSDRTWTPLGRRRPYFLFGAIASSLALVVMPYSPYLWVAAGMLWILDASINVSMEPFRALVADNLPSDQRTEGFAVQTFFIGVGSVIASAMPYVLSNVFNVANTAPVGEVPPSVKISFICGAVVFLGSILWTVYRTKEYSPKELAVFNGEDISDVKMASEPEEKASMKEILTDLRAMPKTMMQLAMVQFFSWFALFAMWIYTTSAVTSQIFGATDSSSALYNEGADWVGLCFAAYNGISALAAFALPWLARRTSRKFVHSLSLIIGGISLATVSLVESPNMLMLNMVGIGLAWASILCMPYAILAGALPAKKMGFYMGVFNFFIVLPQILAAGILGFFTRWAFNGDTMMAIVLGGVSMVFAGMLVVFVKDEDEPNKIPSATQRSSTLKSQVTTA

SEQ ID NO: 17322 - protein, 406 aa, Listeria monocytogenes
MFQSKSRTSLTNKKTLLFGLISVFLCGMGFSIIMPVVPFLVTPYVTNASDQALMVTLLTSVYAFCVFFAAPGLGALSDRFGRRPVLLICFIGSAIGYFIFGLGGALWVLFLGRIIEGITGGSISTLFAFFADITPQEERTKYFGWVSAAAGAGAALGPAFGGLLAHFGYAMPFFFGATITFINFLFGYFYMPESLDDANRLKRIPLMRLNPFSQLLNILTIKNLGRLLIAAFFIWVPNGSLQAVMSQFAIDSFSWKPALIGMMFSIMGIQDILSQAFVMPKLLLKLTDKQIAILGMIAEIIGYLLIAASSIFTLAPLLVIGMFVFGFGDSIFGPSFNGMVSKAASASEQGRIQGGSQAIQSLARIIGPIIGGQIYITLGHAAPAIMGVLLITVAIFILYKKTSLAK

SEQ ID NO: 17323 - protein, 422 aa, Alkalilimnicola ehrlichei
MSSSPSPRFVSRLTRNTLVLILAGGRGSRLMDLTTWRAKPAVPFGGKFRIIDFTLSNCINSGIRRIGVLTQYKAHSLIRHLRLGWGSLRGDFGEFVEILPAQQRTEGSWYRGTADAVYQSLDIVRMHDPDYVLILAGDHVYKMDYGPMLARHVETGADVTVGCLEVPVEEASAFGVMAVDGDNRVVRFQEKPADPPSIPGQSDRALASMGIYIFNRAFLFNQLIADARKESDHDFGKDIIPSLIDQARVIAFPFRDAATGGQAYWRDVGTIDAFWRTNLELVGVNPQLNLYDKEWPIWTHQEQLPPAKFVFDDDDRRGMAVDSMVSGGCIISGAYLRRSLLFSSVVVEDGSRVEDAVILPEAHIEPGCRIRKAVIDKHCRLAAGTVIGEDPEEDARRFHLSPGGVVLVTPDMLGQEIHNVYT

SEQ ID NO: 17324 - protein, 181 aa, Rumex palustris
FDGDGMVHSVKLSGESNSATYSCRFTETQRLVQERELGRPVFPKAIGELHGHSGVARLLLFYSRSLFGLVDAGHGMGVANAGLVYFNNRLLAMSEDDIPYHVRLTPSGDLSTAGRYNFSGQLNSSMIAHPKIDPVTKEMFALSYDVIRKPYLKFFRFSPDGIKSPDVEIPVESPTMIHDFA

SEQ ID NO: 17325 - protein, 458 aa, Listeria monocytogenes
MAQTSTIQNDTKAAEEYAARVFETIKLRNPGETEFHQAVEEFLNSVIPALAKEPKYEANGILEQLTEPERLISFRVPWVDDSGTVHVNRGYRVQFNSAIGPYKGGLRFHPSVTGSIVKFLGFEQIFKNSLTGLPIGGGKGGSDFDPKGKSDSEVMRFCQSFMTELQKHIGPDTDVPAGDIGVGGREIGYLFGQYKRLRGAYDAGTITGKGLSYGGSLARTEATGYGLVYFTVEMLEAAGETIRGKKIVVSGSGNVAIYAIEKAHELGAKVVACSDSAGFVYDKEGIKVETVKQLKEVERKRISEYTTIHPSAEYYAGGDVWSVPCDIALPCATQNEINADQARALVKNGVIAVAEGANMPSTLDAVDIYHENKVLFGPAKAANAGGVAVSALEMAQNSTRMSWTFQTVDEHLQNIMKDIYKNSSNAASEYGAPGNLVIGANIAGFLKVADTMISQGII

SEQ ID NO: 17326 - protein, 303 aa, Oryza sativa
MCWFNRKGPSGFSGASTAEEVTAGIDARGLVAVITGASSGIGLETARVMALRGVRVVMAVRNVAAGHRASEAIRAEIPGAGIHVLEMDLSSMDSVRRFATEFEALNLPLNILINNAGIMTRNCTRSIDGLELQFATNHIGHFLLTNLLLENMKRTSSETGVEGRIVNVSSSAHFVTYPKGICFDKVKEPSRFISLIAYGQSKLANILHSTELSRVLKNNRETVEYEQEDGVNISANAVHPGVVTTNLFRHRTIINALVKSIGRFVHKTVEQVWNILCVSNLMVLLYRVLQRHVMWHYILNSPG

SEQ ID NO: 17327 - protein, 402 aa, Phaseolus acutifolius
MDEALGSSCSLPPFLAKTYEMVDDLSTNSIVSWSVSSKSFIVWNPPEFARDLLPRFFKHNNFSSFIRQLNTYGFKKIDPEQWEFANDDFVRGQPHLMKNIHRRKPVHSHSLQNLQAQGPLGDSERQGFTDGIEKLKRDKERLLVELQKFQHEWQTYEIQIHCSNDRLEKLEQKQHKMVSSISHVLQKPVLAVNILPLTETMDRKRRLPRSGHYYDESSIEDAIETSQMLPRENAENTTVLTLNVERLDQLESSVAFWEAIAHDIGDNFAQIQSNMDFDESTSCADSPSISCAQLDVDVRPKSSGIDMNSEPTAAAVPDPLASKDQPAGITVAATGVNDVFWEQFLTEDPGASETQEVQSERKDCDGRKNEGKPNDHSKFWWNIRNANNLSEPMGHVGQAEKT

SEQ ID NO: 17328 - protein, 392 aa, Oryza sativa
MTATTGLASSTSGVKKLLSLCVDLLQEMLEEEEEVVAPTTSRVHDCDLLGRAHVELDVVADILLSRKPAPIGLVPVCSAVSASQVANPISQSSTPPMWFFNFNRNGPSGFSGASTAEEVTAGVDARGLAAVVTGASSGIGLETTRVLALRGVRVVMAVRNVAAGHKAREAIRAEIHGAIVHVLEMDLSSMDSVRRFASEFDSLNLPLNILINNAGILSKDCIRSIDGLELHFATNHIGHFLLTNLLLENMKSTSRTTGVEGRIINVSSSGHILTYPEGICFDSVKDLSRHKEGDGVNISANAIHPGFVGTNLFKNWTMANAVVNTIGRIVCKTVEQGAATTCYVALHPQVTGISGKYFSNCNLETPSSQASNAELAKKLWEFSSNIVSAAKL

SEQ ID NO: 17329 - protein, 233 aa, Thujopsis dolabrata
APFMVNAYPYFAYRDNPKEVSLDYVLFGQSPGVKDPKGFTYNNMLDAQIDSVYSAMAALGHNDSIPVSVSETGWPSKGDPADIGVTPENARNYNTRVIKHVTSNAGTPMRPNRVIDTYIFALFNENQKPGPTTERNFGLLQPDGSKVYDIDLSCGYCGAAAPAPAPPPPAPLPMQWSRPANAGRQPGAIWCIAKPNADPSVLQESLDFSCGQGGADCAAIREGAPCYSPNTVH

SEQ ID NO: 17330 - protein, 356 aa, Streptocarpus dunnii
GSAGNVNMTSSFKGANSYMGFGDNVNGLCPMMMMMPANDPNGDCSQPLFLPLPAANQQGINRNSSSAAACGGSMMPEHQSNTSTGYYFMEGDGVAGGGSVKSKIMAHPHYPRLLAAYVNCQKIGAPPEVVAKLEEACASTITIGGRNERSCVGEDPALDQFMEAYCEMLTKYEQELSKPFKEAMLFLSRIECQFKALTLSHSSDSGACGEAVMERNGSSEEEFDVNNSFIDPQAEDRELKGQLLRRYSGYLGNLKQEFMKKRKKGKLPKEARQQLLDWWSRHYKWPYPSESQKLALAESTGLDQKQINNWFINQRKRHWKPSEDMQFVVMDATHPHYYMDNFIGTPFPMDISPSFL

SEQ ID NO: 17331 - protein, 94 aa, Cucumis sativus
SLVEDGEFNYQNLFDAILDTVYSALEKNGGGSLEVVVSETGWPTEGGEAATVDNARTYNNNLIQHVKQGTPKRQGRAIETYVFAMSDENEKTTP

SEQ ID NO: 17332 - protein, 358 aa, Streptocarpus rexii
MEGSAGNMNMTSSFKGANSYLGFGDNVNGFCPMMMMMPANNPNGDCSQPIFQPLPAANQQGINRNSSSAAACGGSMMPEHQSNTSTGYYFMEGDGDAGGGSVKSKIMAHPHYPRLLAAYVNCQKIGAPPEVVAKLEEACASTITIGGRNERSCVGEDPALDQFMEAYCEMLTKYEQELSKPFKEAMLFLSRIECQFKALTLSHSSDSGACGEAVLERNGSSEEEFDVNNSFIDPQAEDRELKGQLLRRYSGYLGNLKQEFMKKRKKGKLPKEARQQLLDWWSRHYKWPYPSESQKLALAESTGLDQKQINNWFINQRKRHWKPSEDMQFVVMDATHPHYYMDNFMGTPFPMDISPSFL

SEQ ID NO: 17333 - protein, 185 aa, Candida glabrata
MSKVIAKSIKYNPETEKLITLGAGCFWGTEHIYRKHLGDKIHDSKVGYANGDESSKDLLNRVSYKRVCKGDTNFCEVLQISYDPKKVSLKELIDFFFRIHDPTTVNAQGPDVGTQYRSAIFTHSPEDLKEVQKLKEEWQPKWNNKIVTEVGPIETFYEAEEYHQIYLDRNPNGYACPTHFVRNLK

SEQ ID NO: 17334 - protein, 928 aa, Campylobacter upsaliensis
  misc_feature (174)..(174): Xaa can be any naturally occurring amino acid
MKLNRRSFLKMAALSSLATPLLGRSEVLREAKESELSEAFEGSKKVRSVCTACSVGCGIIAEVQNGVWLRQEIAQDHPVSFGGHCCKGSDMIDMVRSHVRLKYPMKKENGEWKRISYEQALSEIGEKLAGYRKENPESVMFIGSAKLSNEQAYYIRKFAAFFGTNNIDHQARIXHSATVAGVANTFGYGAMTNHLGDIQKSKCIFIIGANPAVNHPVGFRHFLKAKEKGAKLIVVDPRFTKSAAKADIYAQIRPGTDIAFMYGMLKIIFDEGLEDIKYLDERVFGIDKIREEAAKWDAKEVENVTGIPEAKLREITFEVAKNKPTTLIWAMGLTQHTVGTSNTRLAPIVQMVLGNIGKFGGGVNILRGHDNVQGASDVACLSENLPGYYPLNEASWRYYAQIWGVDYEWLLGNFVSKEWMHKTGLSLARWWAAALNGKDDNDKIDNAGTALKALIVMGNGITSTAQQAKVKEGLEALELLVLADPFVNEAGIISERKDGIYLLPAATQFETSGSVTATNRSGQWRFKVVEPLYESKEDQEILFELAKKLGFYEDFTKTLRDENGKIVWPENATKEFAGAIRSIGLNGWSAERLKKHTLNWDKFDEITLEGKEGEVKGEYFGLPWPCWSEKHPGSPVLYNTDIEVAKGGMGFRNNFGLEYEGESLLAKNAPLNSPINTGYPQITKENIEKVLNITLSKEEKAKMGPTWALDASNIIATKCMQKGIVPYGNAKARAVVWTFKDQIPLHREPLHSPRNDLVQKYPSFEDQKALYRVDTKFISVQQAKDYSKEFPLNLVTARLVNLNGAGMENRASMYLTRLTPEMFCEINEALAKRENIKKGDMIWVHSPEGTKIKVRVKINNGVAKDMIFLPFHFTGVMQGVDLTHNFPEGTKPYASGESANTVTNYGYDIMCQIPETKGGLCRISKDGV

SEQ ID NO: 17335 - protein, 331 aa, Camellia sinensis
MEVERVQALSHVTLHELPAKFIRPVHEQPENSKAIEGVTVPVISLSQPHDVVVDALSKACSEWGFFLITDHGVEPSLIGRLKEVGEEFFNLPQKEKESYANDPSSGSFEGYGTKMTKNFDEKVEWIDYYFHVMHPPKKLNLDMWPKNPSSYRGVTEEYNVEIMRTTNKLFELLSEGLGLDGKVLSSSLGGDEIEFEMKINMYPPCPQPQLALGVEPHTDMSALTLLVPNDVPGLQVWKDGNWVAVNYLPNALFVHVGDQLEVLSNGKYKSVLHRSLVNKERTRMSWAVFVVPPHEAVIGPLPELIDEKNPAKYSTKTYAEYRHRKFNKIPQ

SEQ ID NO: 17336 - protein, 385 aa, Populus alba
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 17337 - protein, 565 aa, Leptospira interrogans
MRLLLIQPPVEDFYDTDIRLQPIGLCYLKGAIQKFLPNVEVIIRDFHRGLGNKLAGRRTIPIPNELKYLKEYYPVPDRSPFSTFFEYFHFGASYEDISKEVKYLNPDLVGISSLFSPYYREALKTAEEIKKVLNVPVLMGGSHVSACPELMLSNPYVDFIIRGEGEKAICDFLNEFQNEKRYALVGSLGWKESGKIYLNPIGENFPIQDLPPPDLSYLSKIHYLFEGKPMRFIITSRSCPHRCSFCSVHTTFGTKYRRNTVERVLSEIKKSYELGYRVFDFEDDNLTFFRPEMKQLCEELIDAFPKKDVRFVAMNGISYISLDPELLRLMKEAGFTNLNLALVSSDKLVRETTKRPHTVEKYIQIVQEGFKLGFQITSYQILGLPMETLESMIQTLQFNAGQPVLMGASLFYLTPNSPIASNFPERNESDIFLARLTSMAIPSEHFDREDIYSLFIVTRMLNFLKSAQIPKDNLASLNDTFRILENYDSRSFLGVKLFKKLLEEKKLYASAPQGLIFLDKFRYKVFEMVFSGLDKITTLSGGNIDLKDLNSFMSLKEPNLELNSY

SEQ ID NO: 17338 - protein, 233 aa, Chamaecyparis formosensis
APFMVNAYPYFAYRDNPKEVSLDYVLFGQSPGVKDPKGFTYNNMLDAQIDSVYSAMAALGHNDSIPVSISETGWPSKGDPADIGVTPENAKNYNTRVIKHVTSNAGTPMRPNRVIDTYIFALFNENQKPGPNTERNFGLLQPDGSKVYDIDLSCGYCGAAAPAPAPPPPAPLPMQWSRPANAGRQPGAIWCIAKPSADPSVLQESLDFSCGQGGADCAAIRQGGPCYSPNTVH

SEQ ID NO: 17339 - protein, 353 aa, Streptocarpus saxorum
MEGSAGNLNLNSYRGANSFMGFGDNVNGFSPMMMMMHANDPNGDCSQPIFLPLPAANHQGINRNTGGGGGLTPEHHSNMSTGYYFMEGDGDAGGSSVKSKIIAHPHYPRLLAAYVSCQKIGAPPEVVAKLEEVCASATSTGCRNERSCVGEDPALDQFMEAYCGMLTKYEQELSKPFKDAMLFFSRFECQFKALTLSHSADSGACDEAVLEQNGSSEEEFDVNNSFIDPQAEDHELKGQLLRKYSGYLGNLKQEFMKKRKKGKLPKEARQQLLDWWSRHYKWPYPSESQKLALAESTGLEQKQINNWFINQRKRHWKPSEDMQFVVMDAAHPHYYMDNIMATPFPMDISSSFL

SEQ ID NO: 17340 - protein, 470 aa, Listeria monocytogenes
MNNLKLSEEIKRAINELGYTEATPVQKAVIPVALTGEDIVAKSQTGSGKTAAFAIPIAEQIEWEENKPQALIIVPTRELAMQVKTECTNIGRFKRVKAAAIYGQSPFAKQKLELSQKNHIVVGTPGRLLDHIEKGSLNVDKVAHLVLDEVDEMLSMGFIDQVEDILSRLPKQRQNLFFSATMPEEMQDLIKRYQDDPMVIEMASEKTNPIFHVEMQTDNKEKTLKDVLITENPDSAIIFCNTKNQVDELTDLLDVKVSKIHGGLRQEDRFRAMDDFKSGKSRFLIATDVAGRGIDVDNVSLVINYDLPIEKENYVHRIGRTGRAGKSGKAISFVKTNENPLLRDIEEMLDVTIEKKRKPTVIEVKANEEAFRKKQQKRPTIKKARGEKLNKNIMKLYFNGGKKKKIRAVDFVGTISKLEGITAEDIGIITIEDHVSFVEILNGKGPAVLEMMRSRKVKGRRLKVNEARKR

SEQ ID NO: 17341 - protein, 233 aa, Chamaecyparis pisifera
APFMVNAYPYFAYRDNPKEVSLDYVLFGQSPGVKDPKGFTYNNMLDAQIDSVYSAMAALGHNDSIPVSISETGWPSKGDPADIGVTPENAKNYNTRVIKHVTSNAGTPMRPNRVIDTYIFALFNENQKPGPNTERNFGLLQPDGSKVYDIDLSCGYCGGVAPAPAPPPPAPLPMQWSRPANAGRQPGAIWCIAKPSADPSVLQESLDFSCGQGGADCAAIRQGGPCYSPNTVH

SEQ ID NO: 17342 - protein, 385 aa, Populus alba
MAIDCIKTMPSITTPHHHPKDQDQCKDDGKSFVFDAQVLRHQTNIPQQFIWPDHEKPNTNAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEESSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYRSCLHRAVVNSQTPRKSLAFFLCPKNDKMVTPPHELVDTCNPRIYPDFTWPMLLEFTQKHYRADMKTLEVFTNWLHQRSLS

SEQ ID NO: 17343 - protein, 346 aa, Unknown
  Fragaria x ananassa
MYFSYTTLKNTFMAPILLLLVLFMPALQITGGQSAGVCYGRNGDNLPSDTEVIDLYKSNGIGRMRIYEPNQATLEALRGSNIELMVTILNNNLQALTDAAAATDWVQKNVQPYSADVKFKYIAVGNEVHPDAAEAQYLLPAIQNIQNAVKAANLQSQIKVSTAIDTTLLDPSFPPSDGAFSSAANSFITPIITFLGNNGAPLLVNIYPYFAYIGDPANIKLEYALFTSPGVVVQDGSNGYQNIFDAILDTHYSALEKAGAPNMVIVVSESGWPSEGSDAATNGNAGTYYSNLINHVKTGTPKRPNGAIETYLFAMFDENLKDGAEVEKHFGIFSPNKQPKYQLTFG

SEQ ID NO: 17344 - protein, 233 aa, Chamaecyparis obtusa
APFMVNAYPYFAYRDNPKEVSLDYVLFGQSPGVKDPKGFTYNNMLDAQIDSVYSAMAALGHKDSIPVSISETGWPSKGDPADIGVTPENAKNYNTRVIKHVTSNAGTPMRPNRVIDTYIFALFNENQKPGPNTERNFGLLQPDGSKVYDIDLSCGYCGAAAPAPAPPPPAPLPMQWSRPANAGRQPGAIWCIAKPSADPSVLQESLDFSCGQGGADCAAIRQGGPCYSPNTVH

SEQ ID NO: 17345 - protein, 346 aa, Unknown
  Fragaria x ananassa
MYFSYTTLKNTFMTPILLLLVLFMPALQITGGQSAGVCYGRNGDNLPSDTEVIDLYKSNGIGRMRIYEPNQATLEALRGSNIELMVTILNNNLQALTDAAAATDWVQKNVQPYSADVKFKYIAVGNEVHPDAAEAQYLLPAIQNIQNAVKAANLQSQIKVSTAIDTTLLDPSFPPSDGAFSSAANSFITPIITFLGNNGAPLLVNIYPYFAYIGDPANIKLEYALFTSPGVVVQDGSNGYQNIFDAILDTHYSALEKAGAPNMVIVVSESGWPSEGSDAATNGNAGTYYSNLINHVKTGTPKRPNGAIETYLFAMFDENLKDGAEVEKHFGIFSPNKQPKYQLTFG

SEQ ID NO: 17346 - protein, 951 aa, Vibrio parahaemolyticus
MKLVKRSDSVSKETNQLGVSRRAFMKNTSLAAGGAVVGASLFAPGMMKKAQAKSVDPEAKTEVKRTICSHCSVGCGIYAEVQNGVWTGQEPAFDHPFNAGGHCAKGAALREHGHGERRLKYPMKLENGKWKKLSWDQAIEEIGNKVMDIRKESGPDSVYFLGSAKHSNEQAYLFRKMASLWGTNNVDHQARICHSTTVAGVANTWGYGAMTNSFNDMHNCKSMLFIGSNPAEAHPVAMQHILIAKEKNNCKIVVADPRRTRTAAKSDHYVSLRPGSDVAFIWGVLWHIFENQWEDKEFIRQRVFGMDEIRAEVAKWTPAEVERVTGVSEEDVYQTAKLLSENRPGCIVWCMGGTQHTTGNNNTRAYCVLELALGNIGKSGGGANIFRGHDNVQGATDLGVLSDTLPGYYGLSEGAWRHWSKVWEIDYEWIKGRFDDNAYGGQKPMNSAGIPVSRWVDGVLENKDNIRQRENIRAMFYWGHAVNSQTRGVEMKKAMQKLDMMVIVDPYPTVAAVMNDRTDGVYLLPATTQFETYGSVTASNRSLQWRDQVIEPLFESKPDHEIMYLLSKKLGYSDLLFKNIRVENNQPVIEDLTREFNKGMWTIGYTGQSPERLKAHQQNWHTFHKTTLEAEGGPVNGETYGLPWPCWGTPEMKHPGTHILYDTSKTVAEGGGNFRTRFGVEFEGKSLLAEDSYSKGCEIKDGYPEFTDKLLKQLGWWDDLTAEEKAAAEGKNWKTDLSGGIQRVAIKHGCIPFGNAKARAIVWTFPDRVPLHREPLYTPRRDLVTDYPTWDDKDAIFRVPTLYKSIQEQDKSGEYPIVLTSGRLVEYEGGGEETRSNPWLAELQQEMFVEVNPKDANDLGFRDGDDVWVEGAEKGRIKVKAMVTRRVKPGLAFIPFHFGGKFEGEDLRPKYPEGTQPYVVGEAANTATTYGYDPVTLMQETKVTLCNIRKA

SEQ ID NO: 17347 - protein, 54 aa, Glycine max
AGYSRPQEYVSLLKSNDPVGFNNVDVLAWGSIGQGVALYILAPPSKGYDPAFFG

SEQ ID NO: 17348 - protein, 202 aa, Nymphaea alba
MSQLLDLTEQLCYVQCSFCDTILLVSVPCSSLLKVVPVRCGHCSNLFSVNMLKASFLPLQLLASINNEAKQDSFENAPVKIGDTTFMESLYEEERRPAFTVNKPPEKRHRAPSAYNRFIKEEIQRLKTSEPNISHREAFSTAAKNWAHMPRIQHKPDAESGSQRQSNKGKDKHVDREDKEGNQIFQQRKVSRQCFLTKVPQQ

SEQ ID NO: 17349 - protein, 377 aa, Cryptococcus neoformans
MSFRAPNLIRSTVGRRAGQTLNLRSQVIRRRFATEGGPEITKPSAPRSSNTGYIFAGLGVAAVGAAYYFYGTGRTEHDSTNKADTVVREAVATVEAKTGLRRGKDEYQKVYNRIAETLDKEGYDDGSLAPVLLRLAWHASGTYSKADGTGGSNFATMRFKPEAEHSANNGLHVAREHMEKIKQEFPWISYGDLWTLGGVCAIQESGGPTIPWRPGRIDGYAAQVTPDGRLPDATQAQDHLRFIFNRMGFNDQEIVALSGAHAMGRCHPNRSGFDGPWTFSPVTFSNQYFALLRDEPWQWKKWTGPAQFEDKKTKTLMMLPTDMALVKDKSFKKYVDIYADNEEKFFSDFAKAFSKLIELGVPERQWAGEPWTMATSD

SEQ ID NO: 17350 - protein, 800 aa, Glycine max
FGSRIPPSYGKMWQLNFLSLAGNDLRGFIPSELGNLTNLTHLYLGYYNQFDGGIPPQFGKLTNLVHLDIANCGLTGPIPIELGNLYKLDTLFLQTNQLSGSIPPQLGNLTMLKALDLSFNMLTGGIPYEFSALHELTLLNLFINKLHGEIPHFIAELPKLETLKLWQNNFTGVIPSNLGQNGRLIELDLSTNKLTGLVPKSLCVGKRLKILILLKNFLFGSLPDDLGQCHTLQRVRLGQNYLTGPLPHEFLYLPELLLVELQNNYLSGGFPQSTSNTSSKLAQLNLSNNRFSGTLPASISNFPNLQILLLSGNRFTGEIPPDIGRLKSILKLDISANSFSGTIPPGIGNCVLLTYLDLSQNQLSGPIPVQVAQIHILNYLNVSWNHLNQSLPKELRAMKGLTSADFSYNNFSGSIPEGGQFSLFNSTSFVGNPQLCGYDSKPCNLSSTAVLESQQKSSAKPGVPGKFKFLFALALLGCSLIFATLAIIKSRKTRRHSNSWKLTAFQKLEYGSEDITGCIKESNVIGRGGSGVVYRGTMPKGEEVAVKKLLGINKGSSHDNGLSAEIKTLGRIRHRYIVRLLAFCSNRETNLLVYDYMPNGSLGEVLHGKRGEFLKWDTRLKIAIEAAKGLCYLHHDCSPLIIHRDVKSNNILLNSDFEAHVADFGLAKFMQDNGGSECMSSIAGSYGYIAPEYAYTLKVDEKSDVYSFGVVLLELITGRRPVGDFGEEGLDIVQWTKMQTNWNKEMVMKILDERLDHIPLAEAMQVFFVAMLCVHEHSVERPTMREVVEMLAQAKQPNTF

SEQ ID NO: 17351 - protein, 472 aa, Glycine max
MEEPTLLFPDTDLDLSFTSTTTDRTTTTTTTSARTSLARTSSLTLSFNDRLSTFSSSETTTASLISRRPHRSGDPNWSAIQAAVNLSSDGRLHLRHLKLLRHLGSGNLGRVFLCRLRDYDGAHFALKVVDKDLLTPKKLSHAQTEAEILHALDHPFLPTLYARIDVSHYTCLLMDFCPGGDLHSLLRKQPQFRLPLAAARFFAAEVLVALEYLHALGIVYRDLKPENVLLRDDGHVMLSDFDLCFKSDVAPNVNFRSHTSPPRVGPTSGCFSCNNNNRHREKLVAEFVAEPVTAFSRSCVGTHEYLAPELVSVNGHGNGVDWWAFGVFVYELLYGTTPFKGCSKEGTLRNIASSKDVRFVHVAEREEAGMAEARDLIEKLLVKDPRKRLGCAKGATEIKLHPFFYGIKWPLIRTYRPPEVKGFIRRNKSNVTCKRNTCWWKRLGLLVRNKGGKYNLFSNYSNNYYYHGYKVR

SEQ ID NO: 17352 - protein, 702 aa, Treponema pallidum
MKHSITGTIGDHPLLLESGYLARQANGSVYLQCEGTAILATVCSSAQRQEGLDYVPLTVDFNEKYYAVGKMPGGFIKREGRPKDREILISRLIDRPMRPLFEKEFGRDIHVVPTCISSDMVHPHDVLAIVASSAAVTLSDIPFHGPVAAVRVAYLNGSYVINPTFSQIDAASMEVVVAGTRQGITMVEGGAREVSEDLMLGALEQAQEHIKALCDMQERLRGLCGKEKQTVIPSSAQLVGRDRIYELAYPRLAQALYAQGKGERRSACDAVKRDVAQQYAAQLENDVQRRLFDALFHEMEYEILRLNILDRGLRIDGRAIDAIRPIACEVGVLPRPHGSAVFTRGETQSLAVVTLGAMSDGQVYDDIEGDRRENFILHYNFPPFSVGEIGRMGVGRREIGHGCLAHRSLSAVIPDPEQFPYTVRVVSEILESNGSSSMATVCSGTLSLLHAGVPIKKPVAGIAMGLITDGVRYAILSDILGEEDHLGDMDFKVAGTCDGITGFQMDVKVEAVSASLMKEALQQARVGRLHILSVMNQTISAPSVHISRYAPHIESFKIAVEKIGALIGPGGKTVKSLSDQYRVTINTDSDGTVTVSGRDAQSVFDAKVAVVGLTEDPRVGRVYQGVVKRIVEFGAFVEIFPGKEGLCHVSKLSRSRVSKVSDVLQEGQRICVKLIDIDRMGRLNLSYIDALEGKSGGLDTTK

SEQ ID NO: 17353 - protein, 289 aa, Unknown
  Oceanospirillum sp. MED92
MGVNFMTTNYKETLHKGYGQAFDVEEVLFEQQTDSWHLIIFRNPVYGTVMALDGIIQTTERDEFVYHEMLTHVPILAHGKAKRVLIIGGGDGGILREVCRHKSVEHVTQVEIDQAVIDMCKEYLPNHSAGAFDDPRANIVIADGVEYVNSTDEKFDVIISDCTDPVGPGEVLFSSRFYEGCKSLLNEGGVFVAQNGVPFLQQDEVITTRRRLSPYFKDQSFYAVAVPTYIGGVMTLAWGSDNESLRQLDLSELQKRFADSGITTRYYNPQTHLGCFGLPQYLLDALDKA

SEQ ID NO: 17354 - protein, 127 aa, Unknown
  Azoarcus sp. EbN1
MRILHTMLRVGDLDRSIAFYTEVLGMRLLRRQDYPEGKFTLAFVGYGDEADNAVIELTYNWEVSSYDLGNGFGHIALAVPDARRACDDIRARGGKVVREAGPMKHGNTVIAFVEDPDGYKIELIERS

SEQ ID NO: 17355 - protein, 253 aa, Brassica napus
MASDGGVSCLRRSEMMSVGIGGIDSPPLDVDEVHVLAVDDSLVDRIVIERLLRITSCKVTAVDSGWRALEFLGIDNEKASAELDRLKVDLIITDYCMPGMTGYELLKKIKESSSFRQVPVVIMSSENVITRIDRCLEEGAEDFLLKPVKLADVKRLRNYLTRDVQVSNGNKRKLPEDSPPLTLSHDSSDSSPPPSTLSPDSSDSSSPPLSPVEIFSSPLLSPLDDEDDDVLTSSPESTPSPVRRQKMRSPGLD

SEQ ID NO: 17356 - protein, 495 aa, Pseudomonas stutzeri
MRVSTLFEWKRPEVRALHLTWIAFYICFFVWFGMAPLASSMLKSVNWLFPEDLKLFAIANVALTIPARILVGMALDHWGPRRVFSVLLVVMAAPALFFAFGDSRTQLLVSRLILSSIGASFVVGIHMTAMWFKPKDIGFAEGFYAGWGNFGSAAAAMSLPAIAMPSFGGPEGWRWAIASSAIIMALYGVYYWFALTDGPAGTIHRKPHKASALEVSTWADMFKLIAWTIPMVGVLGILVWRIEGLGYLGSTGAMICYAAIVLVVVFQVVQILRVNVPILKKGVPEDDKYPFNTVAALNSTYFANFGAELAVVSMLPMFFEQTWGLTPTTAGIIAASFAFVNLVARPMGGLVSDRFGNRRFVMLAYMLGISVGFLLMGLMNSKWPLIVAVAITVLCSVFVQGAEGATFGIIPSIKRRVTGQISGMAGAYGNVGAVCYLTLYTFVTPSQFFMVIAAGAFVSFGLCLLWLKEPEGAFSDEYYVSSVDRELEARQKLAS

SEQ ID NO: 17357 - protein, 180 aa, Rumex palustris
FDGDGMVHAVNFGSDGSASYACRFTETSRFKQERALGRPIFPKAIGELHGHSGIARLLLFFSRGLFRLLNSNDGLGVANAGVVYHNGRLLAMSEDDVPYHVSVTPSGDLKTVGRYDFKGQLKSTMIAHPKVDPVSGELFALSYDVVKKPYLKYFHFSQTGEKSPDVEIPLNEPTMIHDFA

SEQ ID NO: 17358 - protein, 180 aa, Rumex palustris
FDGDGMVHAVKFETDGSASYACRFTETSRLRQERELGRPVFPKAIGELHGHSGVARLALFLSRGACGLLDSSDGIGVANAGVVYFNGRLLAMSEDDLPYHVRITPSGDLKTEGRFDFNGELNSSMIAHPKVDPVSGELFGLSYDVVKKPYLKYFHVSKTGEKSPDVEIPLNEPTMMHDFA

SEQ ID NO: 17359 - protein, 338 aa, Unknown
  Pseudomonas sp. 6G5
MNLNRFERYPLTFGPSPITPLKRLSQHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTAELVELGREITEEDVVLDTRFAYPEYGLPNEGTLEAIRLCGSLEGVLTDPVYEGKSMHGMIEMVRRGEFPEGSKVLYAHLGGAPALNAYSFLFRNG

SEQ ID NO: 17360 - protein, 176 aa, Rumex palustris
FDGDGMVHAVKFQTDGSASYACRFTETSRLRQERELGRPVFPKAIGELHGHSGVARLALFLSRGACGILDSSDGIGVANAGVVYFNGRLLAMSEDDLPYHVRITPSGDLKTEGRFDFNGELDSSMIAHPKVDPVSGDLFGLSYDVVKKPYLKYFHVSKTGEKSPDVEIPLNEPTMI

SEQ ID NO: 17361 - protein, 694 aa, Chlamydophila pneumoniae
MNFQTISINLTEGKILVFETGKIARQANGAVLVRSGETCVFASACAVDLDDKVDFLPLRVDYQEKFSSTGKTLGGFIKREGRPSEKEILVSRLIDRSLRPSFPYRLMQDVQVLSYVWSYDGQVLPDPLAICAASAALAISDIPQSNIVAGVRIGCIDNQWVINPTKTELASSTLDLVLAGTENAILMIEGHCDFFTEEQVLDAIEFGHKHIVTICKRLQLWQEEIGKSKNLSAVYPLPAEVLTAVKECAQDKFTELFNIKDKKVHAATAHEIEENILEKLQREDDDLFSSFNIKAACKTLKSDTMRALIRDREIRADGRSLTTVRPITIETSYLPRTHGSCLFTRGETQTLAVCTLGSEAMAQRYEDLNGEGLSKFYLQYFFPPFSVGEVGRIGSPGRREIGHGKLAEKALSHALPDSATFPYTIRIESNITESNGSSSMASVCGGCLALMDAGVPISSPIAGIAMGLILDDQGAIILSDISGLEDHLGDMDFKIAGSGKGITAFQMDIKVEGITPAIMKKALSQAKQGCNDILNIMNEALSAPKADLSQYAPRIETMQIKPTKIASVIGPGGKQIRQIIEETGVQIDVNDLGVVSISASSASAINKAKEIIEGLVGEVEVGKTYRGRVTSVVAFGAFVEVLPGKEGLCHISECSRQRIENISDVVKEGDIIDVKLLSINEKGQLKLSHKATLE

SEQ ID NO: 17362 - protein, 499 aa, Hordeum vulgare
MGEGAWWAVAAVVAALAVVALDAAVRAAHAWYWTASLGAGRRGRLPPGDMGWPLVGGMWAFLRAFKSGRPDSFIDSFARRFGRAGLYRAFMFSSPTIMATTPEACKQVLMDDDAFVTGWPKATVALIGPKSFVNMGYDEHRRLRKLTAAPINGFDALTSYLGFIDDTVVTTLRGWSERGGDGHFEFLTELRRMTFRIIVQIFMGGADERTAAELERTYTELNYGMRAMAIDLPGFAYHKAIRARRRLVAALQRVLDERRARGGKTAAGAAAPVDMMDRLIAVEDEGGRRLQDDEIIDVLVMYLNAGHESSGHITMWATVFLQENPEILAKAKAEQEAIMRSIPPGQKGLTLRDFRKMAYLSQVVDETLRFVNISFVSFRQATRDVFVNGYLIPKGWKVQLWYRSVHMDPQVYPDPKKFDPSRWEGPPPRAGTFLPFGLGTRLCPGNDLAKLEISVFLHHFLLGYKLTRKNPNCRVRYLPHPRPVDNCLAKITRLSSSHG

SEQ ID NO: 17363 - protein, 284 aa, Ostreococcus tauri
  misc_feature (1)..(1): Xaa can be any naturally occurring amino acid
XEIPDGEFRTSKRLVPALGVVNTGMWPGTKVCLKQLHKHLNADEVAQAEFRLELKIMQQLHHPHIVQFLGTTTSTEGLTSIVSEFMGGGSLEQVFRNEELLSLKLATQMALDCARGMAYLHGRSPLPVIHRDLKPGNLMLTTNRTLKIGDFGLSKTLSVRNKLPQEMSQAFNMTGETGSYRYMAPEVFRHEFYGPAVDVYAASMIYYQLFSFQQPFSGRNPVDACRAARLHAPRSRRLVTRMWDPIVKKRPDFTEIIQILTPVAARYAAQPDASAAGPACCVVQ

SEQ ID NO: 17364 - protein, 194 aa, Listeria monocytogenes
MRTATKTRITAETSIELSINLDSQAESIISTGVGFLDHMLTLFAKHSRITLNVKADGDTYIDAHHTVEDIGITLGLCLKEALADKASINRYGSAYVPMDESLGFCALDLSGRSYLVFDAELTNPKLGDFDTELVEEFFQAVAFNTEMNLHLRVLYGKNTHHKIEALFKAFGRALREAITINPEIKGVNSTKGVL

SEQ ID NO: 17365 - protein, 416 aa, Pyrococcus horikoshii
MNKMKAVILAGGFGTRLRPISSTRPKPMVPVLGKPNLQYILEALEKVKEIDEIILSVHYMRGEIREFIQEKMRDYPKDIRFVNDPMPLETGGALKNVEEYVSDDFLVIYGDVFTNFDYSELIEAHKKNDGLITVALTKVYDPERFGVVITDEEGKIVEFEEKPRKPKTNLVDAGIYMVNKDVLKEIPKNKEIYFEREILPKFVNQGLVYGYKMPKQYYWVDLGTPEDFFYAHQIALDELSKENGYMILGENVEIPDDVEVQGPVYIDDNAKIGHGVKIKAYTYIGPNTIIEDKAYFKRSILLGNDIIKERAELKDAILGEGVVVGKDVIIKENAVIGDYAKIYDNLVIYGAKVLPWKKVEEYEAYIKIKLDPTKVRPGQYPDHCPLGLPECIYKKFKAIAGEKPPCDECIENQWLF

SEQ ID NO: 17366 - protein, 180 aa, Rumex palustris
FDGDGMVHAVKFETDGSASYACRFTETSRFRQERELGRSVFPKAIGELHGHSGVARLALFLSRGMCGLLDSSDGIGVANAGVVYFNGRLLAMSEDDLPYHVRITPSGDLKTEGRFDFNGELDSSMIAHPKVDPVSGELFGHSYDVVKKPYLKYFHVSKTGEKSPDVEIPLNEPTMMHDFA

SEQ ID NO: 17367 - protein, 487 aa, Oryza sativa
MAKDVEMAVRNGDGGGGGGYYATHPHGGAGGEDVDDDGKQRRTGNVWTASAHIITAVIGSGVLSLAWATAQLGWVVGPVTLMLFALITYYTSGLLADCYRTGDPVSGKRNYTYMDAVAAYLGGWQVWSCGVFQYVNLVGTAIGYTITASISAAAVHKANCYHKNGHDADCGVYDTTYMIVFGVVQIFFSMLPNFSDLSWLSILAAVMSFSYSTIAVGLSLARTISGATGKTTLTGVEVGVDVTSAQKIWLAFQALGDIAFAYSYSMILIEIQDTVKSPPAENKTMKKATLLGVSTTTAFYMLCGCLGYAAFGNAAPGNMLTGFGFYEPYWLIDFANVCIVVHLVGAYQVFCQPIFAAVETFAARRWPGSEFITRERPVVAGRSFSVNMFRLTWRTAFVVVSTVLAIVMPFFNDILGFLGAVGFWPLTVYYPVEMYIRQRRIQRYTSRWVALQTLSLLCFLVSLASAVASIEGVSESLKHYVPFKTKS

SEQ ID NO: 17368 - protein, 180 aa, Rumex palustris
FDGDGMVHAVNFASDGSASYACRFTETSRLKQERALDRPIFPKAIGELHGHSGIARLLLFFSRGLFRLLNSSDGLGVANAGVVYHNGRLLAMSEDDVPYHVSVTPSGDLKTVGRYDFKGQLKSTMIAHPKVDPVSGELFALSYDVVKKPYLKYFHFSQTGEKSPDVEIPLNEPTMIHDFA

SEQ ID NO: 17369 - protein, 140 aa, Clostridium thermocellum
MLVEVGKIVEGRVSGITSFGAFVELSNGQTGLVHISEVADEYVKDIKSHLKENQTVKVKIISVDKNGKISLSIKRASDPKKSVSKSTKPEEVDWGSRNSANLTFEERLAKFMKDSDERLHDLKKNFESKRGGGGYRKFVQ

SEQ ID NO: 17370 - protein, 444 aa, Vibrio cholerae
MSVYYTLCFLSAAAMLIAFINSKISRMQTTIAITAGSMMLSLLILIAGQNDWFHLNQIATETVTSINFENFLLKGILGFLLFAGGLGIKLPNLKDQKWEITVLALGATLFSTFFIGFTLYGFCQLIGIQFDLVYCLLFGALISPTDPIAVLAIVKKLKAPKRISTQIEGESLFNDGFGLVIFVTIFTIAFGHETPTVGSVTLLFIQEAIGGIVYGFLLGLLFHYLISATDDHSMELLLTIGIPTAGYAFADVIHVSGPLAMVVSGIMIGNWTRFIGFSKESEEHLDHFWELVDEFLNGVLFLLIGMSMLLFEFHQEDWILMAFAVPLVLCGRYLSVFVSYIGFKRYRSYNPWSIRILTWGGLRGGLALAMALSIPSGIMVIPEKLIDVKELILVMTYAVVVFSILVQGSTITPMIEKAKKAEKALQAERNTDNQSPMPQQEQQH

SEQ ID NO: 17371 - protein, 467 aa, Legionella pneumophila
MTEVFTIKQCLDGEISIDETVTVRGWVKTRRDSKAGLSFISLHDGSCFSPIQIVATDQLSNYHKEVTKLTAGCSMIATGKLVASQGKGQFFEIQAESIEVVGWVENPDTYPIQAKRHTLEFLREVAHLRPRTNTISAVTRVRHSLAQAIHRFYHEQGFFWVHTPIITASDCEGAGEMFRVSTLDLLNIPKNDKGQIDFSKDFFGRETFLTVSGQLNVEAYCMAMSKVYTFGPTFRAENSNTSRHLAEFWMIEPEIAFANLEDICKLSQSMLRYLCKTVLEERADDMDFFNQFVAPGCIERMEHIADSEFEIMTYTDAVKALEASDQKFEFPVSWGLDLQSEHERYLAEVLCKKPVIVTNYPQEIKGFYMRLNDDGKTVAAMDVLAPGIGEIIGGSQREERLEILDRRMDECNLNKEHYQWYRDLRRYGTVPHAGFGLGFERLISYVTGVSNVRDVIPFPRTPGHADY

SEQ ID NO: 17372 - protein, 223 aa, Triticum aestivum
  misc_feature (116)..(116): Xaa can be any naturally occurring amino acid
MAAPTSAIGFEGYEKRLDITFSEASIFADPHGRGLRALSRAQIDSVLDLARCTIVSELSNKDFDSYVLSESSLFIYSQKIVIKTCGTTMLLLTIPRILELAEELCMSLAAVKYSRXGMFIFPGAQPAPHRSFSEEVDVLNRYFGHLKSGGNAYVIGDPAKPGQKWHIYYATEQPEQPMVTLEMCMTGLDSGRTYESKSLLESSDTMVHRARSRTESIWALERA

SEQ ID NO: 17373 - protein, 529 aa, Unknown
  Nocardioides sp. JS614
MSALRTPSPVERPGEHHVEHHVEHLVVGAGFAGLCTAIRLQEDGEADFLVVEKAGDVGGTWRDNTYPGAACDVPSQLYSFSFAPNPDWTMSFSPQPEIWAYLRRVARESGTLDRFAFHTRLEHATWDEVAQRWRSRLVGPDGERTVTSTTLVVGAGGLSEPRLPEIDGIETFEGELFHSARWNHDVDLSGKRVAVVGTGASAIQIVPELQRTLEATGGHLDVYQRTAPWVIPRHDRRYPAWERAALRHVPGLQRLYRTAVYWARETYVPAFTIEPKIATPAKRAALANIERGIADPELRAQVTPHYEIGCKRILISNTYYPALDADNVELVTDPIVKVTGSAVVTADGVERPVDVLVVATGFYTTELPITEHVTGREGRTLADVWRSSGMAAYKGTTVPGFPNFFMLVGPNTGLGHSSMVFVIESQVEYLRGAVRTIRRGGYAAVEPRQEAHDAWNGDLQRRMRRTVWSTGGCSSWYLDEHGRNTTLWPKSTVTLRRQLARFDTDAYHLRAAAPTTIPQPSPQGEEAHA

SEQ ID NO: 17374 - protein, 307 aa, Methanosarcina mazei
MRYLNKLLKQSTQTQYLNKVLKYLVDLHLQLKGREVTSIITACIQMNISPCSKHENLDHALSLAEEAVSKEAELLVFPEVFSTGFCYERIEEVAETVSGPTIEALSDFSREYGCILAGSMIEKREIKDKGAISPEKRAPYQYNLGFCIESGKLAGIRRKVQLYGPEKKYFASGDSIAPIRLQKYSLSLGLIVCNELRYPEVARKMTLDGADLLVSAAEIPDFYIYPWRIMSISRAIENQLPHIACNRVGKDRYSTYPGSSFITDGWGRILAKAGKEECVILGEIDLDEARKIRQTGSILEDRRPDLY

SEQ ID NO: 17375 - protein, 488 aa, Oryza sativa
MAVTRLAVAAALSAKALRASAAPAVDEEAPASPPPSDLGKGVENLVIIGSGPAGYTAAIYAARANLKPVVFEGYQVGGVPGGQLMTTTEVENFPGFPDGVTGPDLMDKMRKQAERWGAELHQEDVEFVNVKSRPFVIRSSDREVKCHSVIIATGAAAKRLRLPREDEFWSRGISACAICDGASPLFKGQVLAVVGGGDTATEEAIYLTKYARHVHLLVRKDQLRASKAMQDRVLNNPNITVHFNTEAVDVVSNPKGQMSGIQLKRTDTGEESVLEVKGLFYGIGHTPNSQLLQGQIDLDDAGYILVEEGTAKTSVDGVFAAGDVQDHEWRQAVTAAGSGCVAALSVERYLVANDLLVEFHQPVREEKEKEITDRDVEMGFDISHTKHRGQYALRKVYHESPRLVCVLYTSPTCGPCRTLKPILSKVIDEYNEHVHFVEIDIEEDPEIAEAAGIMGTPCVQFFKNKEMLRTVSGVKMKKEYREFIESNK

SEQ ID NO: 17376 - protein, 233 aa, Chamaecyparis obtusa
APFMVNAYPYFAYRDNPKEVSLDYVLFGQSPGVKDPKGFTYNNMLDAQIDSVYSAMAALGHNDSIPVSISETGWPSKGDPADIGVTPENAKNYNTRVIKHVSSNAGTPMRPNRVIDTYIFALFNENQKPGPNTERNFGLLQPDGSKVYDIDLSCGYCGAAAPAPAPPPPAPLPMQWSRPANAGRQPGAIWCIAKPSADPSVLQESLDFSCGQGGADCAAIRQGGPCYSPNTVH

SEQ ID NO: 17377 - protein, 569 aa, Xylella fastidiosa
MAVLVFNRVNQMTESFAELFEASQANLAKLKPGAIVTGTVVDVRGDVVVINAGLKSEGIVPIEQFRNDAGEIDVGVGDQVKVALDAIENGFGETILSREKAKRSMVWDELEEALEKNETISGRINGKVKGGFTVDIKDVRAFLPASLVDVRPVRDPAYLEGKELEFKLIKLDRKRNNVVVSRRAVVESEHSEEREQLLDKLQEGAVLTGTVKNMTDYGAFVDLGGVDGLLHITDMAWKRVRHPCEVVNIGDEVEVRVLKFDRERNRVSLGLKQLGEDPWDNISRRYPANCRVFGKVSNVTDYGAFVEIEAGVEGLVHVSEMDWTNKNVNPSKVVQVGDEVEVMILDVDEERRRISLGMKQVAANPWETFALTHKKGDKVSGQVKSITDFGIFIGLDGGIDGLLHLSDISWNTTGEDIVRNFKKGDTLETVVLAVDPERERISLGVKQLEQDPFGQYMATHPKGSKVIGTVKEVDAKGALIELDEGIEGYVSARDIANERVDDATQYLKVGDSVEAKFIGMDRKGRTLQLSIKAKDDAEMREVLEEYQSSSGGTTKLGTLLREQLGNKPE

SEQ ID NO: 17378 - protein, 396 aa, Unknown
  Nocardioides sp. JS614
MSTTDGFRADWAQKDFYAELGVTKNASAEEIKKAYRKLARANHPDSNPGDSADSKAKHDKFKAVAEAYDVIGDPEKRKKYDEMRELYGSGAFRGGFGGGGQGGGFNLDDLLRDRASGGGGGFGDMFGDLFGGGFGRGRQHQRPRAQKGQDVETTATISFTDAIDGVTISLRLTSDAPCPDCHGTGGKPGTKPHVCPECDGAGFVVSSAGGAFSINETCPRCGGRQLVYDEACPTCHGSGRGTSARSIQARIPAGVRDGQRIRLRGKGGAGENGGPAGDLFVTVKVSPHRLFGRKGDNLTLDVPVSFDELALGADLKIPTLGGAPVTLKVPAGTPNGRTFRVRGRGAPKSDGSRGDLLATVEVQVPAVLDTAAREAVQAYRDASAGKPLRSKLFEEA

SEQ ID NO: 17379 - protein, 311 aa, Campylobacter upsaliensis
MLDLAIIGGGPAGLSAGLYATRGGLKNVVMFEKGMPGGQITSSSEIENYPGVAQVMDGISFMAPWGEQCMRFGLKHEMVGVEKISKNEDATFTITLEGGKSEVAKAVIVCTGSAPRKAGFKGEEEFFGRGVSTCATCDGFFYKNKEVAVLGGGDTALEEALYLANICSKIYLIHRRDTFRAAPNTVEKVKKNEKIELITNASINEVYGDASGVLGVKLELKNGERDLKVPGIFTFVGLDVRNEILKQDDGSFLCKMEQGGQVSVNLKMQTNIPGLFAAGDLRQDAPKQVICAAGDGAVAALSALAYIESLH

SEQ ID NO: 17380 - protein, 483 aa, Caulobacter crescentus
MQVRNDSGDSKANLDAVIVWFRKDLRIADNPALRHAAQSGRPVIPLYILDETPGIRPMGGASLWWLDKSLKSLAASLETLGTKLVLRKGVAAEVLDQLIAQSGARSVVWNRLYDKPSTDRDAAIKAALRDRGVDCQSFNAGLLNEPWTVKNGSDQPYKVFTPYWRAAREHLTDVAVTAAPGHLVAPARFPASESLASWNLHPTKPDWSKGFDLWTPGEAGAHARLDAFLKGPIKGYGDQRDIPGVEATSKLSPHLHFGEIGPRQVWLATRSAADQGDIPLAEADKFLSEIGWREFNHSILYNWPHMPSANFKPEFDGFPWVKDEGALEAWKRGQTGYPIVDAGMRELWTTGFMHNRVRMIVASFLIKHLMIDWREGEAWFWDTLLDADLANNVGNWQWTAGSGADAAPYFRIFNPIAQGEKFDPKGDYVRRWVPELRNVSDDVIHKPWTKPLHLPAGAKRLYSRPIVDHAMARARALEAYHGL

SEQ ID NO: 17381 - protein, 540 aa, Oryza sativa
MGMRGVGLGFLVRWCLWLIGAEWKCYRWRIWGDLEELDLIATLMAVGETGGWSAISPGSGSGAGLGDPRISGSTYDLFWDGHCFKSKHTLFYIPATLVAFNQVPHFKKSICYYDRTDGGSLSADKWNGYVNKDDRALLKVINTLVNLRFFIMKVVFPKMLGETLAYMSMTRPRKEIYYEPAEVKAAIVTCGGLCPGLNDVIRQIVFTLEIYGVKNIVGIQFGYRGFFEKGLKEMPLSRKVVENINLSGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGIGLVKLMGRSSGFIAMQASLSSGQIDVCLIPEVSFTLDGEHGVMRHLEHLLEKKGFCVVCVAEGAGQDLLQKSNATDASGNVILSDFGVHMQQKIKSHFKDIGVPADVKYIDPTYMVRACRANASDAILCTVLGQNAVHGAFAGFSGITSGICNTHYAFLPITEVITKPKRVNPNSRMWHRCLTSTGQPDFH

SEQ ID NO: 17382 - protein, 127 aa, Oryza sativa
MRGVILLRYEEDAMAGHRSTAAATGGRLYGQVGVKRRVVEETAAAVEVGGGGGGYLGVEAAVLLGVVTATLLVLPLLLPPLPPPPPMLLLVPVAIFAVLLLLVLLPSDAKSIAAAGRPSSSSSSSYL

SEQ ID NO: 17383 - protein, 201 aa, Nymphaea colorata
MSQLLDLTEQLCYVQCSFCDTILLVSVPCSSLLKVVPVRCGHCSNLFSVNMLKASFLPLQLLASINNETKQENFQNAPAKIGDTSFMESFCEEERKPAFTVNKPPEKRHRAPSAYNRFIKEEIQRLKTSEPSISHREALSTAAKNWAHLPRIQHKPDAESGSQRQSNKGKDKHVDREDKEGNQNFQQRKVSQSFFTEIPSQ

SEQ ID NO: 17384 - protein, 1230 aa, Cryptococcus neoformans
MSSFTPAFRLHHTHSSSVSPTASNDVAPSSPTPNQPHQLAARSPLYANSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIGGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 17385 - protein, 411 aa, Rubrobacter xylanophilus
MTETSNRVSHEQSMRDFFREENGEIVPVDESVLIDFQDGDIVEGEVVRIDKDEVLVDIGYKSEGLIPANELTIRKGADPKDVVELGQRIEALVLQKEDADGRLILSAKRAAFERAWNKIEEAYREQRNVEGPVIEVVKGGLILDIGLRGFLPASLVDIRRVRNLEEYLGRRLECKVIELNRSRNNVVLSRRAVLEEERKEERERILNSLNEGDIVKGTVSNLVDFGAFVDLDGIDGLIHISELSWNHVDHPSEVVQVGEEVEVKVLEVDRERERISLGLKQTRKDPWQEVVERVNVGDVIHGRVTKLVSFGAFVEVAEGVEGLIHISELAEHHVETPDEIVRSGDEVDARVIDVDPRRRRLSLSLRPKREEREERRREERRREEREERRPRESGLRTGAFDALKDLDLEER

SEQ ID NO: 17386 - protein, 374 aa, Zea mays
MAIPLVLVVLPLGLLFLLSGLIVNAIQAVLFVTIRPFSKSFYRRINRFLAELLWLQLVWVVDWWAGVKVQLHADEETYRSMGKEHALIISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDEDVSKWCKDIFVAKDALLDKHLATGTFDEEIRPIGRPVKSLLVTLFWSCLLLFGAIEFFKWTQLLSTWRGVAFTAAGMALVTGVMHVFIMFSQAERSSSARAARNRVKKE

SEQ ID NO: 17387 - protein, 513 aa, Unknown
  Synechocystis sp. PCC 6803
MVKIFFSGLVRFLSGLLGIASCVGIGYPRIGSVPWFNSGTHCPSLSSSLGFMNKRRIIEVLRHGQADDQVMVQGWLRTKRTLKDFSFVEVNDGSSLANLQVVLDGSLADYDRLLSQLQTGAALVVEGKLAPSPGKGQRVELKATKLELLGGADPGSYPLQKKRHSFEFLRTIGHLRPRTNTIGAVMRVRNACATAIHQFFQERGFLWVHTPIITASDCEGAGDLFKVTTLDLQRVPKNGEGIDYSQDFFGKQAYLTVSGQLEAEVMALAFQNVYTFGPTFRAENSNTSRHLAEFWMVEPEMAFCDLEGDRQWAEEFLKYIFKFVLEKCPEDMEFFDQRIDNTVLATADNIINNEFAWLTYSEAIKLLEKADQKFEYPVAWGVDLQSEHERYLAETVFKRPTIVTDYPKDIKAFYMRLNDDGKTVAAMDILAPKIGEIIGGSQREERLDILTQRMQEQGVPEEDLWWYLDLRRYGSVPHAGFGLGFERIVQFMTGMANIRDVIPFPRTPMNAEF

SEQ ID NO: 17388 - protein, 441 aa, Gibberella zeae
MKFSSIIAAAFAGSPALAVPAGFVTTDGTKFSLDGKDFFFAGSNAYYLPFNIWGTDHYKDVKLGLEAAKDAGLKVIRTWAFHDNNRTFSSGGLPQYNTGAEDTVFQWFEADGTVKIDLSKLDVVVEAAEATNMKLILALTNNWADYGGMDVYTVNLGGRYHDDASSTIFYRLPAIKKAFKNYIKAVVNRYKDSPAVMAWEIANEPRCGADGVRNLPRGPDCTPKTITSWVDEMSTYIKSLDADHLVTTGSEGGFNRKSDDWTYNGADGTDFDAELKLPNIDFNTFHSYPQYWSKTVDWVVQWIKDHAAAGEAVGKPVLHEEYGWTDKSTRIPTISKWQKASLDLEMSDLYWQFGYSGYSYGKNHDDGNTIYLEDDEAQPLVYEHAAAVNGEGTAPSPTTTGTTPPKPTVTDGPKVGRYGQCGGASWTGATLYTARSIAFFH

SEQ ID NO: 17389 - protein, 109 aa, Physcomitrella patens
HEPVSGLPALRMPKIVCSAEKKESQTEELSGFPQLAAAVTSAATLAYAHPVFALVDERLSTEGTGLGLGISNTKLTWILVGVTALIWALYFFVLLDVGQRVTMTSGLDL

SEQ ID NO: 17390 - protein, 69 aa, Physcomitrella patens
HEAATLAYAHPVFALVDERLSTEGTGLGLGISNTKLTWILVGVTALIWALYFSYSSTLPEGDDDSGLDL

SEQ ID NO: 17391 - protein, 96 aa, Oryza sativa
YVIFHVSQEEREMAHLYERRMFPYPGDEEAVEEFIKSGGALGTTIGPKGFADSNMDSDNMQKQLQSKKFDQEAQKLWFRMRNEVVQELQEKGFDVE

SEQ ID NO: 17392 - protein, 259 aa, Novosphingobium aromaticivorans
MNDFPAGMVWLVGAGPGDPELLTRKAERLIGRASVVFFDALVGREVLDLASPGARLVDVGKRSGRHSKDQRTIDALIVEAALSGERVVRLKGGDPSIFGRATEELEACRSAGVVVAVCPGVTAASAAAAGLSRSLTLRGLARKLVFVTAHARAGDTLDLDWAALADPGATLAIYMGKSAAGAIARGLQGTGMAGETPVALVENASLPDERRIVTRLDLLELAARTLGDGPALLLIGEAMRTPGRRAVAAAAQAMERETP

SEQ ID NO: 17393 - protein, 158 aa, Physcomitrella patens
GTRSPPTAMAAIASASCATAATRLATTSLASSSSGFAATLKPVAGLPALRMPKVVCAAERSESKAERVNGVAQLAAAVTSAATLAYSHPVLALVDERLSTEGTGLGLGISNTKLTWILVGVTALIWTLYLLTPRRCQRVTDDSVWTCRSRKQEFCVPF

SEQ ID NO: 17394 - protein, 861 aa, Novosphingobium aromaticivorans
MTMKDIRTTCAYCGVGCGIRATVTGDRAVSIKGDPEHPANFGRLCSKGTHLGETVGLEGRLLHPMVDAERATWNEALDLAAARMRECIERHGPDSVAFYVSGQLLTEDYYVANKLMKGFIGSGNIDTNSRLCMASAVAAHNRAFGEDLVPCTYDDLEAADLVLLVGSNTAWCHPVIWQRIEAARSARGTRLVVIDPRRTETAEQADLHVALAPDGDIALFNALLAEMRDRDLLDEAFMAERCAVPEGYVAGLDPRGHGIDPATFRALADLVAASPRMVTLFSQGANQSRCGTDKGNAIINLHLALGRISQTGAGPFSITGQPNAMGGREVGGLANMLACHLGFSSEERADAAIFWNAPNICAGPGLKAVDLFRAVHDGRVKFVWVMATNPAVSMPDAGFVREALARCETLVVSDVIADTDTARLAHIRLPALAWGEKDGTVTNSERRISRQRALFEAPGQARADWAILCDFAERMGWGRAFAFPTAAAIFREYAAMTALAGARGKALDLSHLAGLGDAAYEALEPTLWGGVHPTARTFSHPDGKARLVAVEAPVAAPADPEFPFRLNTGRYRDQWHTMTRTGLSPTLSQHRREPLLEIHPEDAALAGIEDGGLARLATRVGATVFRVLHSTAQRRGDLFVPMHWTDAMAGEGRANRLPLQETDPLSGQPGFKDTPARVEPVVPEWRAFLATRDEAALPSLLWWSRAKVANGWLCELAGNGAPDLEVILPKGTWLEAADMVRGMRRIIVLDKAGGLLAALYLTRNGELPPRDWVAAQIGNAEASALELLAGRPAVALPDRGPIVCVCHGVGVNEIAAAACAGAMTLEAIAGCTRAGSNCGSCRPAIARMLDEMNLDTQEAAE

SEQ ID NO: 17395 - protein, 142 aa, Unknown
  uncultured bacterium 582
MGLKYLHTMVRVKNLETSLAFYTLLGLKETRRKESENGRFTLIFMAPDGQEDRPIELTYNWDGDDGLPNDSRHFGHLAFGVDNIYETCAHLQANGVTINRPPRDGHMAFIRSPDNISIELLQNGPPLEGAEPWLSMGNTGHW

SEQ ID NO: 17396 - protein, 246 aa, Rumex palustris
FDGDGMVHAVNFASDGSASYACRFTETSRLKQERALGRPIFPKAIGELHGHSGIARLLLFFSRGLFRLLNSSDGLGVANAGVVYHNGRLLAMSEDDVPYHVSVTPSGDLKTVGRYDFKGQLKSTMIAHPKVDPVSGELFALSYDVVKKPYLKYFHFSQTGEKSPDVEIPLNEPTMMHDFAITENFVVIPDSQMVFKLQEMITGGSPVVYKKDKISRFGVLDKYAKDGKGIKWVEVPDCFCFHLWNA

SEQ ID NO: 17397 - protein, 306 aa, Myxococcus xanthus
MKVNNILETIGNTPHVRINRLFPSRVTVHMKLERANPGGSIKDRIALSMIEDAEQRGLLKKDSVIIEPTSGNTGIGLAMVAAVKGYKLVLVMPESMSVERRRLMAAYGATFELTPRAQGMKGAIARANELLSQVPNSWMPQQFENEANIEVHRRTTVQEILKDFPEGLDYLITGVGTGGHITACAEELKKVWPKLKVFAVEPTKSPVISGGQPGPHPIQGIGAGFIPKNLHKDALDGAIQVTEEDAFEFTRRAAREEGIFVGISTGAALSAVNQKLGEMTDGSRVLAFNYDTGERYLSIEPLFPAQ

SEQ ID NO: 17398 - protein, 180 aa, Rumex palustris
FDGDGMVHAVKFETDGSASYACRFTETSRLRQERELGRPVFPKAIGELHGHSGVARLALFLSRGACGLLDSSDGIGVANAGVVYFNGRLLAMSEDDLPYHVRITPSGDLKTEGRFDFNGELNSSMIAHPKVDPVSGELFGLSYDVVKKPYLKYFHVSKTGEKSPDVEIPLNEPTMIHDFA

SEQ ID NO: 17399 - protein, 417 aa, Legionella pneumophila
MNTDIANQLRVAKKATTDLNLIQSDTRTIILKTLAANLEKHIENIIQENQKDLSLMLEQDPRYDRLLLNKERILSLANDVRKVASLPNPLGVNLLEKSMPNGLSIKKITVPLGVIAVIYESRPNVTIDIFSLCFKSGNVCILKGGKEAHFTNSYLLLLIKNTLKNFNINTDIVCLLPPERALITPLLNATGLVDLCIPRGSQNLINFVRDNAKIPVIETGAGIVHTYFDKSGDLEKGKKIINNAKTRRVSVCNALDTLIIHADRLKDLPELVETLSQKNVIIYADQDAYQVLDKNYPEQLLMKAKPQDFGHEFLDYKLAIKTVPNIKAAIDHIQQFSSYHSEAVIAEDESAIDKFLTEVDAAAVYANASTAFTDGGEFGLGAEIGISTQKVHARGPMGLEALTSYKWVIRGTGQIRD

SEQ ID NO: 17400 - protein, 93 aa, Unknown
  Synechococcus sp. WH 7805
MASFTITLEGGKSFSCADDQYILDAAEEQGVDLPYSCRAGACSTCAGKVLSGSVDQSDQSFLDDEQMGNGYALLCVSYPMADCTIKAEVEDEL

SEQ ID NO: 17401 - protein, 528 aa, Arabidopsis thaliana
  misc_feature (184)..(184): Xaa can be any naturally occurring amino acid
MAASPKIGIGIASVSSPHRVSAASSALSPPPHLFFLTTTTTTRHGGSYLLRQPTRTRSSDSLRLRVSATANSPSSSSSGGEIIENVVIIGSGPAGYTAAIYAARANLKPVVFEGYQMGGVPGGQLMTTTEVENFPGFPDGITGPDLMEKMRKQAERWGAELYPEDVESLSVTTAPFTVQTSERXKCHSIIYATGATARRLRLPREEEFWSRGISACAICDGASPLFKGQVLAVVGGGDTATEEALYLTKYARHVHLLVRRDQLRASKAMQDRVINNPNITVHYNTETVDVLSNTKGQMSGILLRRLDTGEETELEAKGMFYGIGHSPNSQLLEGQVELDSSGYVLVREGTSNTSVEGVFAAGDVQDHEWRQAVTAAGSGCIAALSAERYLTSNNLLVEFHQPQTEEAKKEFTQRDVQEKFDITLTKHKGQYALRKLYHESPRVILVLYTSPTCGPCRTLKPILNKVVDEYNHDVHFVEIDIEEDQEIAEAAGIMGTPCVQFFKNKEMLRTISGVKMKKEYREFIEANK

SEQ ID NO: 17402 - protein, 356 aa, Legionella pneumophila
MKIIIKVGTQSILSVDGSPIYSVLNNLVNQIIYLKNLGHQVILVSSGAVGSGRKIAKNSLGKTYGDTVGEKQLLASIGQPELMNLYSSLFKNENILVSQLLLTKQDFHTRQHYLNIARLLTELLKHQNIIPIVNENDSVAIEELMFTDNDELAGLIAAQINADYLILLTNVDGVFTSHPNDSESKLINTIDPSSGWPNVSAVKSKLGRGGMVSKLDTARKMAGLGINTVIANVNVESIVPKILNREAVGTIILASKRKSSIKRWIAFSHRTSLPSIVINDNLITLLRNGNRVMSILPIGIEDFRGECKKGDLIDILNSNNEKIGVGIARYDFLRLKDYLRLQNKPAFIHYDQSHIL

SEQ ID NO: 17403 - protein, 180 aa, Rumex palustris
FDGDGMVHAVKFQTDGSASYACRFTETSRLRQERELGRPVFPKAIGELHGHSGVARLALFLSRGACGILDSSDGIGVANAGVVYFNGRLLAMSEDDLPYHVRITPSGGLKTEGRFDFNGELDSSMIAHPKVDPVSGDLFGLSYDVVKKPYLKYFHVSKTGEKSPDVEIPLNEPTMIHDFA

SEQ ID NO: 17404 - protein, 238 aa, Prochlorococcus marinus
MTEEKSHPSKESIEEFLGAFKMASERKRLGLLNRLEERVEELLGLGSTLMSGFDPGVCDWTPGFILQVIHKTDKDFIRNTLNCDNLSWFDSPSDVGFDYSPLQRFLLNESYEDADRFTSSKLRELAGEKAVKRGYVYFSEVDSIPSIDLSTLDKLWVVYSRGKFGFTVQAKILDSLGGRYDKLWPRIGWKKDGIWTRYPKAFNWSIEAPNGHMPLVNQLRGVRLMDALLNHQGFKAKS

SEQ ID NO: 17405 - protein, 321 aa, Vibrio vulnificus
MQMSDMKHSKLLILGSGPAGYTAAVYAARANLNPVLITGMQQGGQLTTTTEVENWPGDPEGLTGPGLMNRMKEHAERFETEIIFDHINEVDFSTRPFVLKGDAASYSCDALIISTGASAKYLGLESEEAFKGRGVSACATCDGFFYRNQKVAVVGGGNTAVEEALYLSNIAAEVHLIHRRDSFRAEKILINRLMDKVQNGNIVLHTDRVLDEVLGDEMGVTGVRLKDVKTGGTEELDVMGAFIAIGHSPNTQIFQGQLDMKDGYILVKSGLEGNATQTSVEGIFAAGDVMDHNYRQAITSAGTGCMAALDAERYLDSLNDK

SEQ ID NO: 17406 - protein, 392 aa, Haemophilus somnus
MNDTVIQNQEHQSARKEWLKKIGIPLALIVLLVLMFMPTPDGLTVQGQKAIAIFCSALILWVCGSIPIYLTSLLVIILLPLTQTVAKDKVVFATLGYDVIWLMVSAFVLTSAMIKSNIARRFALWMITHFGQTPRKAMFVLILINFILVFFVPSTTARASLIVPICLILLEIYRAVPGESNFGKLMMLQGVQADAIATSGVMTGTAGNIIAVGFINNQAGGDIGYLDWLLASFPIAFVTMIISFLIGFKLFSMKKETHFFEALSRLQAEYKKLGSLTLDEKKAMAIFLLTVLLWATESYQKAWFGFKISVYMTAVIAAVLCLMPRIGLLTWSEAKIKWDLMLFAAGAYAAGNTLESTKGAQWIMDKVVHGLGLETMSHTAVYVVVIFVCMYV

SEQ ID NO: 17407 - protein, 180 aa, Rumex palustris
FDGDGMVHAVKFQTDGSASYACRFTETSRLRQERELGRPVFPKAVGELHGHSGVARLALFLSRGACGILDSSDGIGVANAGVVYFNGRLLAMSEDDLPYHVRITPSGDLKTEGRFDFNGELDSSMIAHPKVDPVSGDLFGLSYDVVKKPYLKYFHVSKTGEKSPDVEIPLNEPTMIHDFA

SEQ ID NO: 17408 - protein, 160 aa, Photobacterium profundum
MKTEQSSSPQISETKDSTQEESVAQTQKTTPVYGMGDATLLAAGGEEGVKKLVDAFYDYMDTLPEAEVVRAMHKPDLTDSREKLTTFLTGWMGGPSRYAEKYGSMNIPGAHRHLSIGIAEKEAWLLCMQKALDDQGYDDVFKRYVMVQLSFPAEMCRNRS

SEQ ID NO: 17409 - protein, 663 aa, Legionella pneumophila
MEKMLINAMQTEEIRVALIKNNQLFDLDIECPGEIKKKGNIYKAIVTRREPSLDAVFVEYGSKRQGFLPLKEIAPEYLSKNPEEFGDEKPPITSLIREGQELLIQVDKEERGNKGAALTTFITLAGCYLVLMPNNPHSGGISRRIEGDERDELRETLNALTLPEDMGLIIRTAGVGKSLEELQDDLNMLCNQWQSIKEAYNSELAPCLIHQEGDVIIRSIRDNLRKSISEIIIDDQISYIKAKQYIERVKPEFLPNLKLYNSSIPLFNFYQIESQIETAYQRQVMLPSGGALVIDRTEALVSIDINSAKATGGADIEATALNTNLEAADEIARQLRLRDLGGLVVIDFIDMSSSKNQREVENRLKEALQADRARIQVGRISRFGLLEMSRQRLRLSLGETAQEICPRCEGRGTVRSIQSHGLSITRLIEEEALKEKTAEIQVQLPPEMATFIMNEKRNFIRDIEKRHGVSVVVIANPYMHPPQYTITRLKEDNVGKSKKPSYSLIQQPEIHVPSSDKEPVSHDEPAVKSFAEHRVIKHPQTSFIKRLWTSLFGGHSVAHTVTQEPGKKHHRAQNQGKHPSSKSSGGDKRQQGSNANRRRRSGGGQQRSSSGNTNAATSAHQQRKKSNPNQQSHGGQQSNRSIPAKNEGNKKREAILAKEPEEK

SEQ ID NO: 17410 - protein, 180 aa, Rumex palustris
FDGDGMVHAVKFETDGSASYACRFTETSRFRQERELGRSVFPKAIGELHGHSGVARLALFLSRGMCGLLDSSDGIGVANAGVVYFNGRLLAMSEDDLPYHVRITPSGDLKTEGRFDFNGELDSSMIAHPKVDPVSGELFGLSYDVVKKPYLKYFHVSKTGEKSPDVEIPLNEPTMIHDFA

SEQ ID NO: 17411 - protein, 72 aa, Myxococcus xanthus
MPKDDSIEVEGTVMEPLPNAMFRVVLDNGHKVLAHISGKMRMHFIRILPGDKVKVELSPYDLTRGRITYRAK

SEQ ID NO: 17412 - protein, 72 aa, Bdellovibrio bacteriovorus
MAKDDLVQIDGKVIDALAGGLYKIELDNKVIINAKLCGKMRRFNIRVVVGDRVSVGVSPYDPSHGLIQFRHK

SEQ ID NO: 17413 - protein, 295 aa, Xylella fastidiosa
MTPHLLPVALIQERNHGTAEANLSIIEARVTEAAAQGAQLVLLHELHNSAYFCQHESVNEFDLAEPIPGPSTERLSALAKQHRVVIIGSLFEKRAAGLYHNTAVVLEKDGRLVGKYRKMHIPDDPGFYEKFYFTPGDIGFKPIDTSVGRLGVLVCWDQWYPEAARLMALAGAELLLYPTAIGWDPNDEHDEQTRQRDAWLLSHRGHAIANSLPVLSCNRTGHEPSPLGTSGIHFWGNSHVLGPQGEFLAEANSNGPEILTCEINLQRSEHVRRIWPFLRDRRIDAYGDLLKRYID

SEQ ID NO: 17414 - protein, 688 aa, Triticum aestivum
MDASAGSSPPRHSQGDAPRRGGPHRGKGPAVEIRQGEDDFMFAQDTFPALPDFPCLSSPSSSTFSSSSSSNSSSAFAAPAGAGGRGAEGARGEPSEPAAAGDGMDDLSDIDHLLDFASINDDVPWDDEPLFPDVGMMLEDVISEQQLQQPPAGHGTAGRTASHAASGGGEDAFMGGGGTGSAADDLPLFFMEWLKNNRDCISAEDLRSIRLRRSTIEAAAARLGGGRQGTMQLLKLILTWVQNHHLQKKRPRVGAMDQEAPPAGGQLPSPGANPGYEFPAETGAAAATSWMPYQAFSPTGSYGGEAIYPFQQGCSTSSVAVSSQPFSPPAAPDMHAGAWPLQYAAFVPAGATSAGTQTYPMPPPGAVPQPFAAPGFAGQFPQRMEPAATREARKKRMARQRRLSCLQQQRSQQLNLSQIQTGGFPQEQSPRAAHSAPVTPPSSGWGGLWTQQAVQGQLMVQVPNPLSTKSNSSRQKQQKPSPDAAARPPSGGAATPHRPGQASASNKQRQQGARTPAAAPAAGDKNLRFLLQKVLKQSDVGTLGRIVLPKKEAETHLPELKTGDGISIPIEDIGTSQVWSMRYRFWPNNKSRMYLLENTGDFVRSNELQEGDFIVLYSDVKSGKYLIRGVKVRAQQDLAKHKNASPEKGGASDVKAGGEDGGCKEKSPHGVRRSRQEASSMNQMAVSI

SEQ ID NO: 17415 - protein, 624 aa, Aspergillus oryzae
MKGALSVIGLSRVAFLYSFPLSSRARSTLTPTIIRNMPQKRKPSQNGTRENGTNSTSDTNKRGKSDLSSPHPNSRQAEEFGIVLRQFYPPEMSNERCQAYNDGTLERPMETLNRVCEETVDARLSIRPNAAVVHWFKSDLRLHDNRALRKAYEVAREHSIPLIALYILSPEDLTAHLSSPARVDLTLRTLEQLKLDLGELDIPLHMETQESRRDIPQRIIHLCQEWGANHLFANIEYEVDELRREAKLVRLCVENGIAFDVLHDTCVVPPGLLSSQQGKQYAVYSPWFRSWQMFLMDNPEHLEVSEEPGSNPGNARKVFKDLFASEVPGAPNNKRLSDEEREHFRQLYPAGEHEGLDRLESFLEEKATAYDDMRNSLSKQTTSVLSPYFASGSLSARTAVAKAKKANKNQLDRNELGFVSWISEVAWRDFYKHVLVRWPFICMNKCFKPEFTDLEWEYNMDYFNAWCEGRTGFPIVDAAMRQMKSSAWMHNRSRMIVASFLSKDLLIDWRRGERYFMEHLIDGDFASNHGGWGFGSSTGVDPQPYFRIFSPLRQSERFDPDGDYIRRWVPELREIEGSAIHDPYDRGAGDLAEKNGYPRPIVDHATRRALALDRYKKAAGGKSR

SEQ ID NO: 17416 - protein, 178 aa, Bacillus cereus
MSEKTYELATFAGGCFWCMVKPFDELPGIHKVLSGYAGGHVENPTYEQVKAGTSGHLEVVQITFDPSIFPYEKLLNLYWPQIDPTDDGGQFFDRGPSYRTAIFYHNEMQKELAEKSKQTLAESGMFKEPIVTEIRPAAPFYEAEEYHQHFYKKNPEKYATEQKESGRADFIKENWQKK

SEQ ID NO: 17417 - protein, 484 aa, Haemophilus somnus
MSQKGDIGVIGLAVMGQNLILNMNDNGFKVVAYNRTTSKVDEFLAGATKGTNIIGAYSLEELAGKLEKPRKVMLMVRAGEVVDQFIEALLPHLEQGDIIIDGGNSNYPDTNRRVKALAEKGIRFIGSGVSGGEEGARHGPSIMPGGNEEAWQYVKPILQAISAKTDKGEPCCDWVGKEGSGHFVKMVHNGIEYGDMQLICEAYQFLKDGLGLSYDEMQQIFAEWKKTELDSYLIDITTDILGYKDADGEPLVEKILDTAGQKGTGKWTGINALDFGIPLTLITESVFARCVSSFKDQRVAASKLFNKTIGKVEGDKNVWIEAVRKALLASKIISYAQGFMLIREASENFGWNINYGATALLWREGCIIRSRFLGNIRDAYEANPDLIFLGSDPYFKGILENALSDWRKVVAKSIEVGIPMPCMASAVTFLDGYTSERVPANLLQAQRDYFGAHTYERTDKPRGEFFHTNWTGRGGNTASTTYDV

SEQ ID NO: 17418 - protein, 144 aa, Arabidopsis thaliana
  misc_feature (57)..(57): Xaa can be any naturally occurring amino acid
  misc_feature (94)..(94): Xaa can be any naturally occurring amino acid
  misc_feature (116)..(116): Xaa can be any naturally occurring amino acid
MVFCTAHATVRDPFIGLKYSSAFPATRKALKDITSITSNGSRVNCMQVWPPIGKKKXETLCYLSDLTDSKLAKEVDYLIRARWIRCDELELKHXVVFREHGHSPGYYDGRYWTMCXLTLFGCSESPVLLKEVVECRKEYPTAFI

SEQ ID NO: 17419 - protein, 357 aa, Pisum sativum
MSSLSDLINFNLSDSTEKIIAEYIWVGGSGIDIRSKARTLPGPVSDPAKLPKWNYDGSSTNQAPGKDSEVILYPQAIFKDPFRRGNNILVICDVYTPAGEPLPTNKRYNAAKIFSHPDVAAEVPWYGIEQEYTLLQKDINWPLGWPIGGYPGKQGPYYCGIGADKAYGRDIVDAHYKACLFAGINISGINGEVMPGQWEFQVGPSVGISAGDEIWAARYILERITEIAGVVVSFDPKPIPGDWNGAGAHANFSTKSMRENGGYEVIKKAIEKLGLRHKEHIAAYGEGNERRLTGKHETADINVFSWGVANRGSSIRVGRDTEKDGKGYFEDRRPASNMDPYVVTSMIAETTILWKKP

SEQ ID NO: 17420 - protein, 367 aa, Unknown
  Torenia hybrid cultivar
MARAGPLTLTSLALEKSLHEKFIRDEDERPNLAYDQFSSQIPLISLSGIDDECNKRKELCKRIAQACEDWGIFQVIDHGIDLKLVNDMTRLAREFFDLPDEEKLRFDMSGGRKGGFIVSSHLQGEVVQDWREIVTYFTYPIKGRDYSLWPDKPEAWRAVTETYSSQLMCLGCKLLGILSEAMGLEREALTKACLNMDQKVVVNFYPKCPQPNLTLGLKRHSDPGLITLLFQDNVGGLQATRDGGKSWITVQPVEGAFVVNLGDFAHYLSNGRFKNADHRAVVNSNTNRMSIATFQNPSPEAIVYPLKIGDDGKPIIEKPITYGEMYKRKMAKDIELAKLKKLAKEQKLQEEVVNNVEDHHLNNGKTK

SEQ ID NO: 17421 - protein, 356 aa, Phaseolus vulgaris
MSLLSDLINLNLSDTTEKVIAEYIWIGGSGLDLRSKARTLPGPVKNPSELPKWNYDGSSTGQAPGQDSEVIIYPQAIFKDPFRRGNNILVICDAYTPAGEPIPTNKRHNAAKIFSNPDVVAEEPWYGIEQEYTLLQKEVNWPVGWPVGGFPGPQGPYYCGVGADKAFGRDIVDAHYKACVYAGINISGINGEVMPGQWEFQVGPAVGISAGDELWVARYILERITEVAGVVLSFDPKPIKGDWNGAGAHTNYSTKTMRNDGGYEEIKSAIQKLGKRHKEHIAAYGEGNERRLTGRHETADINTFLWGVANRGASIRVGRDTEKAGKGYFEDRRPASNMDPYVVTSMIADTTILWKP

SEQ ID NO: 17422 - protein, 428 aa, Hyphomonas neptunium
MTVQTSPPSAALAETMLDMGRRARAASRELGLLTAQDRTRGLKAIAAAIRAAAPDVLRANAEDMAAARAKGLAPAMLDRLALDEKRLEGVAAGVETVAALPDPLGRELARWTPPNGLDIARIAVPLGVIGIIYESRPNVTVDAGVLCLRSGNAAILRGGSESAKSSAALANAMRGALKSEELPVDAIQLVATTNREAVGHMLGGLEGALDVIVPRGGRSLVERVQAEARVPVIGHLEGLCHTYVHAAADPKKAVDIVLNAKMRRTGVCGSTETLLIDVAVAATLLPQIAKALTDAGCELRGDGRTRAILGDITPATEADWATEYLDAILSIAVVDGLPGALAHLARWSSGHTDAIITEDTAAAETFIANVDSAIVLHNASTQFADGGEFGFGAEIGIATGRIHARGPVGAEQLTTYKYAVRGTGQVRP

SEQ ID NO: 17423 - protein, 415 aa, Listeria monocytogenes
MTELIKKGSGAKEASQFLAQATTKHKNAALLNLSNDLLIHTATLLQENEKDILRAQQKGTPETMIDRLRLTEERIKEISEAVKQVVALKDPIGEVTNMWKNEAELTIGKTRVPLGVIGIIYESRPNVTVDASVLCFKTGNAVILRGGSDAIDSNKALMSVIQDSLEASGFPRSSVQLIEDTSRETARDMMRLNRFLDVLIPRGGARLIQTVLENATVPVIETGTGNCHIYVDKAAEKQMAIDILVNAKCSRPSVCNAAETLLIHRDVAEDYLPAMETALKEYDVELRADERAKGILQEAKAATESDWEDEFLDFILAIKVVDSAEEAIDHINKYGTKHSEAIISNDYATGQAFHQKVDAAAVYINASTRFTDGFAMGFGAEIGISTQKLHARGPMGLTELTSTKYIIFGDGQIRN

SEQ ID NO: 17424 - protein, 355 aa, Glycine max
MSLLSDLINLNLSDTTEKVIAEYIWIGGSGMDLRSKARTLPGPVSDPSELPKWNYDGSSTGQAPGEDSEAIYTHKPFQDPFRRGNNILVICDAYTPAGEPIPTNKRHAAAKVFSHPDVVAEVPWYGIEQEYTLLQKDIQWPLGWPVGGFPGPQGPYYCGVGADKAFGRDIVDAHYKACIYAGINISGINGEVMPGQWEFQVGPSVGISAGDEIWAARYILERITEIAGVVVSFDPKPIPGDWNGAGAHTNYSTKSMREDGGYEVIKAAIDKLGKKHKEHIAAYGEGNERRLTGRHETADINTFLWGVANRGASVRVGRDTEKAGKGYFEDRRPASNMDPYVVTSMIADTTILWKP

SEQ ID NO: 17425 - protein, 751 aa, Psophocarpus tetragonolobus
MDCEVELQGGDLHAGVITEANPVGFGTMEDSHALAVSERDMWLNSDQDEFLGVNDASMFYADFPPLPDFPCMSSSSSSSSAPPLPAKTMACSTTTTTTSSSSSSSSWVMLRSDVEEDAEKNHCNHYMHDQLDATALSSTASMEISQQHNPDPALGGTVGECMEDVMDTFGYMELLESNDFFDPASIFQEDNEDPLVEFGTLEEQVPLHDEQHAMVHQKGKADEEDHQVPVCEEIHGEEEGGDGVGVVDDEMSNVFLEWLKSNKDSVSANDLRNVKLKKATIESAARRLGGGKEAMKQLLKLILEWVQTSHLQNKRRKENSGSISTVLQGQFQDPSVQNTHTGSFAPEPNSCFNNQTPWLSPQPFGTDQNPLMVPSQQFPQPMVGYVGDPYTSGAASNNITATHNHNNNPYQPGAEQYHMLESAHSWPHSQFNVASHYGQSFGENGLFPHGGFGGYGNNQYPYQFFHGPGDRLMRLGPSATKEARKKRMARQRRFLSHHRNHNGNHQQNQGNDPHATLGGDNCTNVVAAPHANHAANWMYWQAMTAGVAGTLGPVVPAEPPAGQPVVDRSTIHTQNCHQSRVASDRRQGWKPEKNLRFLLQKVLKQSDVGSLGRIVLPKKEAETHLPELEARDGISITMEDIGTSRVWNMRYRYWPNNKSRMYLLENTGDFVRANGLQEGDFIVIYSDVKCGKYMIRGVKVRQQGVKPETKKGGKSQKNQHGTNASTTAGTAANNGTQSSTKPKAEKSSKLI

SEQ ID NO: 17426 - protein, 592 aa, Oryza sativa
MITGADFYHVMTAMVPLYVAMILAYGSVKWWRIFTPDQCSGINRFVALFAVPLLSFHFISTNNPYTMNLRFIAADTLQKLIVLALLTLWSHLSRRGSLEWTITLFSLSTLPNTLVMGIPLLKGMYGEFSGSLMVQIVVLQCIIWYTLMLFMFEYRGARILITEQFPDTAGAIASIVVDADVVSLDGRRDMIETEAEVKEDGKIHVTVRRSNASRSDVYSRRSMGFSSTTPRPSNLTNAEIYSLQSSRNPTPRGSSFNHTDFYSMVGRSSNFAAGDAFGVRTGATPRPSNYEEDAAAPNKAGSKYGQYPAPNPAMAAPPKPKKAANGQAKGEDGKDLHMFVWSSSASPVSDVFGNGAEYNDAAAVKEVRMAVASPRKADGVERDDFSFGNRGVAERDAEAGDEKSVAAAVSGEHGKPGLTPAPTAMPPTSVMTRLILIMVWRKLIRNPNTYSSLIGLIWSLVCFRWNFEMPAIILKSISILSDAGLGMAMFSLGLFMALQPRIIACGNKVATFAMAVRFLTGPAVMAAASIAVGLRGTLLHVAIVQAALPQGIVPFVFAKEYSVHPDILSTAVIFGMLIALPITLVYYILLGL

SEQ ID NO: 17427 - protein, 276 aa, Listeria monocytogenes
MRESLKNSKRLVIKVGTSTLMYGNGHINLRTIEKLAMVLSDLRNEGKEVILVSSGAIGVGCHKLQLSVRPTSIPDLQAVASVGQSELMHIYSKFFGEYGQVVGQVLLTRDVTDFPISRENVMNTLDSLLSRGIIPIVNENDTVAVEELEHVTKYGDNDLLSAIVAKLVQADLLIMLSDIDGFYGSNPATDPEAVMFSEINQITPEIEALAGGRGSKFGTGGMLTKLSAASYCMDSNQKMILTNGKNPTVIFNIMQGEQIGTLFASKKEELSHDRTH

SEQ ID NO: 17428 - protein, 447 aa, Alkaliphilus metalliredigenes
MFPYIPATEESKKKMLEDVGLNSVEDLFKDISHKVRLKGELNIPKHKSELEVSSYIKKLGKMNETTEDYTCFLGCGAYDHYIPSVVDAVISRSEYYTAYTPYQAEIAQGTLQTIFEFQSMMAGLTGMDVCNASVYDGSTAVYEAAYVAVASNRRKEVLISKSVHPEYRKVLKASLGAANIKYIEIEIKEGTTDLDDLKEKLTKDVSAVIVQSPNFFGLIEEVEEVVKESHENKSLVVMSTDPISLGLLKTPGEMGVDIAIGEAQALGIPLSFGGPYLGFITTTKALLRKVPGRLVGMTKDVDGKRGFVLTLQTREQHIRREKSISNICTNQALNATAATVYLSLMGKEGMKEVAKQNYDKAHYAHEQLISTGMFEDSWEKPFFKEFTLKYKGNLKALKEKLEENKILGGFHPKEDYQALENHLIIAVTEKRSKEEVDQLCTIVKEVE

SEQ ID NO: 17429 - protein, 352 aa, Frankia alni
MSYQAEYIWIDGTEPEPLMRSKTRIIKDGKEPEIWGFDGSSTNQAPGSNSDCVLRPVFETPDPIRGGDNRLVLCEVQLTDFTPPTNTRAAALGVAERYADMSPMFGIEQEYTFFKDGRPYGWPEVGYPAPQGPYYCGVGGSKMPGRQIVERHTQACLDAGLAIEGTNAEVMMGQWEFQIGVLPAPAIGDQIWLGRWLLHRIAEDYGVEVSFAAKPIPGDWNGAGAHTNFSTKQTMEGWDAIVTCCEALGTRVTEHVTHYGKGIEDRLTGKHETAPWNKYSWGASDRGASVRIPWAVEKAKKGWLEDRRPNANMDPYLVTALMIDTCCSALAGDKPTLFVPSQTTPAPAEASV

SEQ ID NO: 17430 - protein, 481 aa, Alkaliphilus metalliredigenes
MYEKVIYEISSKGKKGYMLPPQDVPQYEVPEKYLRKTDNHLPEVSEREVMSHFVNISSKNYHIDKGFYPLGSCTMKYNPKINEAMARLDGLANIHPYQDEKMVQGALRLMYELQGSLGEITGMDAFTLQPAAGAHGEKTGLMLMHQYHRGRNDLKRDKIIVPDSSHGTNPASAAMTGFKIIEVPSNERGGVDIEALKNVVGDDTAGLMLTNPSTLGLFEENITEIAGIIHGAGGLLYYDGANMNAIMGYARPGDMGFDIIHLNLHKTFTTPHGGGGPGAGPVGVKEFLKEFLPVPMIDKKDETYTLRYDMENSIGKVKSFYGNFGMLIRAYTYILTMGSDGLKHVSEMAVLNANYLKENLKEYYQLPYDILCKHEFVLSGKSMKKKYGVSTMDIAKRLIDYGYHPPSVYFPLIVEEAIMIEPTETESKETLDEFIKVMITIAKEAAENPDLLHEAPHHSPVRRLDDSGAARNPILKWQDIE

SEQ ID NO: 17431 - protein, 958 aa, Bordetella bronchiseptica
MLETVIKRDRDLGTPARESAQLVTLTIDGQPVSVPAGTSVMRAAAEAGINIPKLCATDSLEPFGSCRLCLVQIEGRRGYPASCTTPVEAGMVVQTENARLRDLRRGVMELYISDHPLDCLTCPANGDCELQDMAGVVGLREVRYGYDGENHLAEAKDESNPYFTYDPSKCIVCNRCVRACEETQGTFALTISGKGFASRVSPGQDQPFMDSECVSCGACVQACPTSTLQEKSIIMLGQAEHSVITTCAYCGVGCGFKAEMKGEEVVRMVPWKDGQANRGHSCVKGRFAWGYTTHKERVLKPMIRQRITDPWREVSWEEAIGHAASEFRRIQAAHGRDAIGGITSSRCTNEETWLVQKLVRAAFGTNNVDTCARVCHSPTGYGLKQTLGESAGTQTFDSVMHTDVVIVMGANPSSAHPVFASRLKRRLREGARLIVIDPRRIELVSAPHVKADFHLQVRPGTNVALLTAMAHVIVTEGLVAESFVAERCEAPSFDMWREFVARAENSPEAMQEVTGVPAQLVRGAARLYATGGNGSIYYGLGVTEHSQGSTTVMAIANLAMATGNIGREGVGVNPLRGQNNVQGSCDMGSFPHELPGYRHISDDAVRGEFERDWGVTLQPEPGLRIPNMFEAALGGSFLGLYCQGEDIVQSDPNTQHVAAALSAMECIVVQDLFLNETAKYAHVFLPGSSFLEKDGTFTNAERRISRVRKVMRPRNGMADWEITMALSNALDYPMHYAHPSEIMDEIARLTPTFAGVTYEKLDRLGSIQWPCNEDAPEGTPTMHIDEFVRGRGRFMLTKYVATDERSTRRYPLLLTTGRILSQYNVGAQTRRTPNVMWHGEDVLEIHPHDAQERGVADGDWVGIQSRAGETVLRATLTDRVQPGVVYTTFHFPESGANVVTTDNSDWATNCPEYKVTAVQVTRVSQPSEWQRQWSRFADVQQKLLHERARETEPALANK

SEQ ID NO: 17432 - protein, 415 aa, Unknown
  Nocardioides sp. JS614
MARISRKNVLVICLAGGEGKRLMPLTADRAKPAVPFAGIYRLIDFALSNVVNSGFLKVVVLTQYKSHSLDRHVTQTWRMSTMLGNYVTPVPAQQRVGKHWYLGSADAIYQSLNLMRDERPDYVVVVGADHVYRMDFYQMVKAHAESGAACTVAAIRQPIELADQFGVIDVHPDDPSRIREFLEKPTDPVGLPDSPGEVLASMGNYVFDADALVEAVTRDATEIGSKHDMGGDIVPAFVRRQQAAVYDYKDNDVAGSTDRDRGYWRDVGTLGSYYAAHMDVVSPLPVFNLYNFDWPIYTSYGPQPPAKLVQGASGDLPGVDEAVLSPGVVVTGGQVQRSVLSPSVRVDTGAEVTGAVLMNGVYVGAGAVVRNAILDKNVVVPPGAQIGVDPEADRARGFVVEDGLTILGKDQAFPT

SEQ ID NO: 17433 - protein, 93 aa, Glycine max
MSSRRSRSRQSGVSTEITDAQITDLISKLQQLIPELRARRSDKVSASKVLQETCNYIKSLHREVDDLSDRLSQLLATTDSNSAQAAIIRSLLM

SEQ ID NO: 17434 - protein, 831 aa, Novosphingobium aromaticivorans
MNAPTSFSQKDQPAQARERLVVIGNGMAGCRAVEEILARDPARFDVTIFGAEPRVNYNRIMLSPVLAGEKAFDDIVINDASWYADNGITLVSGDPVVSIDRETQTVVARSGRVEPYDRLLIATGSDPFIIPVPGHDLPGVVTFRDLDDVERMLAASERGGSAVVIGGGLLGLEAAHGLALRGMKVTVVHLMPTLMERQLDEAAGYLLRSELERRGQTIVTGGDTAEILGRDGHVSGVKLKDGREFAADIVVMAVGIRPATGLARAAGLDVERGILVDDHMMTSDPAVMAVGECVQHRGQCYGLVAPLWDMCRALADCVTGNPSGYEGSVTSTKLKVSGIDLFSAGDFSGGEGAEDIVMRDASRGIYKRVIVREDRVVGAVLYGDTGDGSWYFDLLKKGEDISEIREALIFGQAFAAGGALADPNAAVAALSDDAEICGCNGVSKGKVVETIKGGACSLDAVRSQCKASASCGSCTGLVESLLRLTLGGEVEAGPKTMCKCTSFTHSDVRRLIVEKNLRLIPQVMQELGWSTPDGCASCRPALNYYLLCAWPGEYEDDQQSRFVNERMHANIQKDGTYSVVPRMWGGLTNPRELRAIADVVEKYNAPMVKVTGGQRLDIFGIRKEDLPAVWADLNAAGMVSGHAYGKSLRTVKTCVGSEWCRFGTQDSTGLGVKLEQMTWGSWMPHKFKIAVSGCPRNCAEATIKDFGVVCVDSGYELHVGGNGGIKVRATDLLCRVATEAEAMEVCAAFIQLYREQAWYLERTAPWIERVGLEHVKAALFDDPEAVATLAARFRHSQQFMQDDPWAKRARGADAELHQHLAEVRPFQMENA

SEQ ID NO: 17435 - protein, 198 aa, Unknown
  Magnetococcus sp. MC-1
MARIATESRTTGETKIQVTLNLDGSGKAQVDTGVGFLDHMLDQIARHGGMDLEIEACGDQHIDDHHTVEDVGITMGQAFRQAIGDRRGITRFGHAYVPLDEALSRVVVDLSNRPSLSWRVKFPTQKVGNFDTELFKEWFAAFAQQGGITMHVESLYGENSHHIAESCFKALARALRSACAVDATLGGVAPSTKGTLSD

SEQ ID NO: 17436 - protein, 109 aa, Glycine max
  misc_feature (63)..(63): Xaa can be any naturally occurring amino acid
  misc_feature (96)..(96): Xaa can be any naturally occurring amino acid
ASSMISSPAVTTVNRAGAGMVAPFTGLKSMAGYTTIKTNNDITFIAINGGRVQCMQEWPPIGXTKYEILYYLSDLDDAQLAMEIEYLLTKGWILYXEFNWEHCFMYREH

SEQ ID NO: 17437 - protein, 425 aa, Unknown
  Azoarcus sp. EbN1
MDIHDYMQTLGRQARAASRVLATASTADKNAALVAMAAAIREQTGELLAANARDLDEARAAGLEAALIDRLTLTAKGIEAMAEGLEQVAGLPDPIGEITDVKRRPSGIQVGKMRVPLGVIGIIYEARPNVTADAAALCLKSGNAAILRGGKEALHCNQAIAQCVRTGLAAAGLPETSVQVVETTDRAAVGHLITMPEFVDVIVPRGGKGLIERISKEARVPVIKHLDGNCHVYIDRDADVAKVVPIVENAKTQRYGTCNTAESLLVAREVAPRLLPEIGRMLATKGVEMRGCEQSLAILRAAGIAADKLRAASEQDWSEEYLAPVIAVKVVADLDEAIAHINTYSSGHTEAIVTENYTSAMRFLREVDSSSVMVNASTRFADGFEYGLGAEIGISTDKIHARGPVGLDGLTSQKWIVFGNGEIRG

SEQ ID NO: 17438 - protein, 1086 aa, Pseudomonas putida
  misc_feature (312)..(318): Xaa can be any naturally occurring amino acid
MKRMLINATQPEELRVALVDGQRLYDLDIESGAREQKKANIYKGKITRIEPSLEAAFVDFGSERHGFLPLKEISREYFKKAPEGRVNIKEVLSEGQEVIVQVEKEERGNKGAALTTFISLAGRYLVLMPNNPRAGGISRRIEGEERNELREALNGLTVPGDMGLIVRTAGLGRSSEEMQWDLDYLLQLWTAIKEASLDRAAPFLIYQESNVIIRAIRDYLRQDIGEVLIDSIDAQEEALTFIRQVMPQYASKVKLYEDSVPLFNRFQIESQIETAFQRVVDLPSGGSIVIDPTEALVSIDINSARATKGSDXXXXXXXTNLEAAEEIARQLRLRDIGGLIVIDFIDMTPAKNQRAVEERVRECLEADRARVQVGRISRFGLLEMSRQRLRPSLGESSGIVCPRCSGTGIIRDVESLSLAILRLIEEEALKDRTAEVRAQVPIPVAAFLLNEKRNSITKIELRTRARIIILPNDHLETPHFEVQRLRDDNPEVLNNQSSYEIAAAETEEAPQPTATRTLVRQEAAVKTAPARANAPVPAAAEEPQAAAPVAPAPSAPEPSLFKGLVKSLVSLFAGKDEPAAAPVVAAEKPAAERSPRNEERRNGRQQSRNRNGRRDEERKPREERAERAPREERQPREERAPREERAPREERAPREERAPREERAPRQPREDRRSNRGEERVRELREPLDATPPAEREERQPREERATREERAPREERAPREERAPREERAPREERAPREERAPREERAPREERAPREERAPRPPREERQPRAAEEAAEQAAELAEEQLPNDELLQDEQEATDGERPRRRSRGQRRRSNRRERQRNANGELIDGEEEGSEEQPQQHQATELGAELAAGLAVTAAVATSNISTDAEAQANQQAERATAEVATAAETDNSEAAQPVEQVEKVEQVEAVAKAEEVAVAPAVEQPVSEPVAVVEATAEPVVEIAPQAAVEATPVVEPAVVAETVAAEAPVEAPAVEAGEIEQAPAVVEAASVAKQPAPVIEAQPEAVAEPAPVVVEPAAIEAPAAVEPATVMLANGRAPNDPREVRRRKREAEAAAKAAQEAAATEEPALEAADEHKPHHG

SEQ ID NO: 17439 - protein, 809 aa, Solibacter usitatus
MAKQNPITPVVAGDARRHLPLLLLLFAGSGCSALIYEIVWYQLLQLVIGSSAVSLGVLLATFMGGLCLGSLLLPRLKAAGQHPLRVYGKIEFGIAVCGILVLFVMPLVDSVYTSAVGHGLPAILLRALVCALCLLPPTFLMGASLPAASRWLKATPEGVSWLGLLYGANTVGAVMGCLLAGFCLLRVFDMATATFIAAAINVTVGLVSFGLAKRSPEYPPASDSRVVIAPGAWPVYVTIALSGATAMAAEVVWTRLLGLMLGATVYTFSIILAVFLVGLAIGSTGGAMAARTAKSPKALLGWSQMLLAAAIAWTAYMLSESLPYWPVNPLLSTSPWYTFQIDLVRCIWAIFPAALLWGASFPLALAAAASEEGDPGRLVGGIYAANTGGAILGALGTSLILVPAIGTASSQSVLIALCAVSGLLMLVPLLKSMRISNALMVGAALVIAIMLAGSVSPVPGMLIAYGRRMMTSMGRSKVLFTGEGINSSIAITEWDDGAVQFHVSGKVEASTESYDMRLQRMLGHLPALMHKEPKSVLIVGFGAGVTAGSFVPYPSIQRIVICEMEPLIPPTATKYFGKQNYFVMNDPRTQVIYDDARHFVLTTREKFDIITSDPIHPWVKGSATLYSKEYFELVKQHLNPGGVITQWVPLYESDPETVKSEIATFFDAFPNGTIWGNDISGGGYDIVLLGQVDPAKIDLDAMQARLDRPEGARVQESLREVGFGNVVQLLATYAGQEPDLRPWLAGAQINRDGNLRLQYMAGLALNVSREGAIYSEMLGYRRWPDSLFTGSEDKRRALRYALDPRSVGQ

SEQ ID NO: 17440 - protein, 478 aa, Rhizobium leguminosarum
MPPRTEQLSVFPAFFRVEGLKTAVFGNGDEAFAKVRLLLNTKARIIAYADRPEADYHAFLIANRIETVRAAFAAEQVEGSALVFAATGNEADDRSIVDAARAARIPANAVDQPDYCDFFTPALVNRAPVAVAIGTEGAGPVLAQMIRAQIDQLLSPSLGRLAGLATSYRKAVEQLIPRGVSRRVFWRHFFSGSVADAVANGNLPQARHAADRLLHAMDKVAGHVWLVGAGPGAEDLLTLRAQRVMMEADVIVYDALVPQAIVDMGRRDAERLSVGKRKGCHSKSQEEINDLLVDLGRQGKRVVRLKSGDPLVYGRAGEEMAALRAAGITYEVVPGITCAFAAAADFELPLTLRGVASSLVFTTGHDLTGDVLPDWASLAVSGATIAVYMGRTVAASVAERLMQAGIPSETTVAVIENASRAERRLLHGTLADLPDLQHRDELTGPVMVIIGDAVAGANFELSEPLVRANARLEELARS

SEQ ID NO: 17441 - protein, 210 aa, Triticum aestivum
MYGQIWRLVPNACSPLPPIRAGAGRGSWPAGRPAPLRRPALASASASTRGLCRPLAVSAQSASLDAGVRVDKFFEVEMKVRDYELDQYGVVNNAIYASYCQHGRHELLESVGISADAVARSGESLALSEMHLKYFAPLRSGDKFVVKVRLASIKGIRMIFEHCIEKLPNHELIVEAKATAVCLNKDYRPTRVPPEFLSRLQLFSSMDNSG

SEQ ID NO: 17442 - protein, 420 aa, Bordetella parapertussis
MDEIQSIVIVGAGQADAVAAASLRQLGYRGGLTLIGQEAHPPYERPPLSKAVLQGTATHAEAAVHPAGFYAENDIALLTETAVAALDPIARTVRLADGRTLPYDRCLLATGGHARELPALPRGRAGVHYIRTLNDALDLRAALRPGVRAAVIGGGFLGLEVASTARELGAEVTVIENGSRLLERALPAIVSDWLAERVRASGVDLRLGGAIAAIGDGPPYAITLADGTQVNADLIVVSIGLAPEVTLARQAGLPLDDNGGICVDAQARTADPHVYAAGDCASQPRACLGTAARFESWQNANEQARAAATAMLGLAPAAEPYPWFWTDQYGCNIQILGLPQPGLRYVCRPQTDPQAAPRVLWIGLRDGVPCHGIAVNAGGDLRQLRVLFERGIPVDPHRLADPAEALKPLVKAWQAAVAVA

SEQ ID NO: 17443 - protein, 620 aa, Actinomadura hibisca
MSGFAGWVDYERDLRREGATTRTMTATMACRGPDAEEVWLSERAAFGHRRLAVLDPKGGRQPMRAEHDGRELAVLAFNGEIYNAGEVRAELAARGHRFRTRSDTEVILEAYLEWGAGCAAKLNGIFAFAVWDPRSEELLLARDQLGAKPVIYYPTPTGVLFASEPKALLAHPWVDAVVDTDGFRELLSQAGTPGAVVFKGMHEVRAGHVVRIGERGIVTEKYWGLEGREHTDDRDATIANVRRLLEESIGRQLRADVPVCSLLSGGLDSSGLTAIAAHILAERGEGPVRTFTVDYAGLAENFVPDQVRTSLDAPYVKDLVAHVGSEHTDVMLDTSDLLDPVMRAETIRARDLPSPLGDMQTGLYLLYRAAAEHSTVALTGQLADSLFGGPAWVQDPEFANADTFPWVALAQRRACPDGLGNGLLAPALRRSLDIPGYVRDRFHEALAEVPHVGEADPQERRMREITYTHLTRYPETLIRNDERLSAYVGLETRVPFCDPELLQYAFNTPWHLQTFDGREKSLLRAAVADLLPESVLKRPKSPFPVSVDPGYAKVLRTELSEILADPSAPVAPFLDPQGARELLDDPNSLAEGWRGRTNVELILQLDTWLRDYGVRLDLDV

SEQ ID NO: 17444 - protein, 522 aa, Listeria monocytogenes
MTLTKFSEFGLDEKIVKSVNRMGFEEATPIQEKTIPLGLEGKDLIGQAQTGTGKTAAFGLPMIHKIDQKSNNVQALIIAPTRELAIQVSEELYKLSYDKHVRVLAVYGGSDISRQIRSLKKNPQIVVGTPGRILDHINRRTLKLDHVETLVLDEADEMLNMGFIDDIETILKEVPAERQTLLFSATMPDPIRRIGERFMHSPELIRIKAKEMTALLIEQFFVKVHEKEKFDVLSRLLDVQAPELAIVFGRTKRRVDELSRALDMRGYVAEGIHGDLTQAKRMSVLRKFKEGKIDVLVATDVAARGLDISGVTHVYNYDIPQDPESYVHRIGRTGRAGKEGMAITFVQPREMGYLRIVEETTKKRMQPLQAPTWDEAFAGQLRVATEKIQEAITEENLADYKTFANELLEKYDATDIAAAMLKMLAKEPDKTPVHITEERPLPSRGGGGYKGKNGKGGKGGGYRGGSGKGGSYRDRNNSGKGRRSGGGSGGGSGSGGGGNRDRRGGGEQRSGGNKGNYSQKSK

SEQ ID NO: 17445 - protein, 560 aa, Aspergillus nidulans
MKDASESAAQIPLLASINAESQVHLIVGANPLAAARCTKSVQAGAKPVVISPDPGSLQYTLAAHFENGNAKWVQREFEDADLTTLGREEVDHVVDMVFVTLGGNHPLSSHISKLCRRLRIPVNVSDAPDLCTFSLLSTYSDGPLHVGITTSGRGCKLAARLKREIAATLPPNLGNAIDRLGTIRRRLWEEDFAAGLCDAVFDIDDDDATGQKHTFNNLVTESDVNAAKTRRMRWLSQICEYWPLRKLAAIDDSDIDKILQEYSAGTVKSTDTNGTFIEKKGKIVLAGSGPGHPDLLTRATYNAIQCADIILADKLVPAPVLELIPRRTEVHIARKFPGNADQAQEEFLRMGLDALKKGRKVLRLKQGDPYLYGRGGEELEFFRAEGFTPVVLPGITSALSAPLFAEIPATHRGVADQVLVCTGTGRKGAAPEPPTYVPTQTVVFLMALHRLSALINSLTMPPAEDFDRPPQPRTLWPKETPCAIIERASCSDQRVIRSTLEHVCQAFEVEGSRPPGLLVVGASCHVLHKPEDQKWIVEEGFRGLDELQSTVEVPMMNETA

SEQ ID NO: 17446 - protein, 433 aa, Sulfolobus solfataricus
MLCLFIFRRDLRLDDNTGLIKALEDCEKVIPAFILDPRQVGNENEYKSEFAINFMINSLNELNDELRKRGSRLYVYFGLAEEVIKNLLKDVDAVYLNEDYTPFSKMRDERIRKYCEDTGKIMKSFEDYLLTSKNDFKNYRNFTTFYNVVKNKQIKKPVQNNYTNYYKNSLGDEHELPPRQGERGGRKEGIKLIERARQINYDRKDFVAEDNRTFLSPHLKFGTLSIREVYYSLLDSQAIIRQLYWRDFYTLLAYYNERVFHEPLKREYNCIEWENNERLFQAWLEGKTGYPIIDAGMRQLNRTGDMPNRVRMLTAFFLVKVLIIDWRIGEKYFASKLIDYDPSVNNGNWQWIASVGTDYIFRVFDPWKQQVTYDPEAKYIKRWVDELESYDAEIIHNAYKYTLKSYPKPIVDWRIRVNLAKRLYEVCRKSKIK

SEQ ID NO: 17447 - protein, 262 aa, Rhodobacter sphaeroides
MTAAAQPSGLPGLATAPGRPWPLGASFDGEGVNFALFSAHAEKVELCLFAPDGRREALRLPLTERDGDIWHLKVNGLLPGQLYGYRVHGPYQPEQGHRFNPNKLLIDPYARKLDGRLRWSDAVMGYRVGSARADLSFDGRDSAFAVPKSVVVGHNFNWGPDAPPERALTETLIYEAHVKGLTALHPGVEDGLRGTFLGLASDPILEHLTRLGVTAVELLPVQAFLDDRFLVNRGLSNYWGYQTVGFFAPDPRYLAKGALWEF

SEQ ID NO: 17448 - protein, 467 aa, Listeria monocytogenes
MTSVMWFRRDLRVNDNKALYHACKENDLLLLFQVNPAQFITGSPSHQAFFASVAHFKQEIDKTAHLQIMFGEPIECFQQLKDSLPSWDKVYFNRDETGYGAKRDEAAQAFFDEQKIEVQAFHDSYLHSAEEVKKSPTEYYKIFTPYYKKWREEIKETPFKVTLKHENIRKESLFLKYEEQFAEMTSDLPILDIGERAANTRLANFIKHDVADYDKARDFPELDKTSHLSRYLRTGEISIRTIWQSLQETEATEGRATFEKELCWRDFYNMIYVSFPNQKNEPIQENYRFIEWENNREYFKAWQEGKTGFPLVDAAMRQLKETGWMHNRLRMITASFLTKDLLIDWRFGEKYFQQMLIDYDPASNIGGWQWAASTGTDAVPYFRIFNPTTQSQKFDSTGKFIRKYVKELANLPDKYIHQPEKMSETEQKEHGLLLGKDYPFPIVDHKERRKLAIARYEFSKEHSRGNI

SEQ ID NO: 17449 - protein, 434 aa, Hordeum vulgare
MQVRRDDDGAGGCAGDAVPGGGEGQDGVPARQPAGRVWGVSRAARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTSQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRDTEAKGKGYLEDRRPASNMDPYTVTALLAETTILWEPTLEAEALAAKKLALKV

SEQ ID NO: 17450 - protein, 423 aa, Zea mays
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQGEPLPTNKRHRAAQIFSDPKVGEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEEIKRAILNLSLRHDLHISAYGEGNERRLTGKHETASIGTFSWGVANRGCSIRVGRDTEAKGKGYLEDRRPASNMDPYIVTGLLAETTILWQPSLEAEALAAKKLALKV

SEQ ID NO: 17451 - protein, 305 aa, Bacillus cereus
MKLCENITELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKEIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGAGKKVLCIAPDTGERYLSMGLFE

SEQ ID NO: 17452 - protein, 329 aa, Legionella pneumophila
MNKKTIAMLGAGSWGTAVAIHLAKIGHKTLLWSHNPQHVALMAEQHSNPAYLPGIPFPENLIPSDDLIECVQLADYVIIAVPSHAFAEIINKIPKPTQGLAWLTKGVDPASHQLLSQLVASRFGVDFPIAVISGPSFAKEVARFLPTALTLASNNTNYQKKMHQLFHHDNIRVYLSDDLIGVQLCGAVKNILAIACGISDGLGYGANAKAALITRGLAEMTRLGLSMGARQDTFLGLAGVGDLVLTCTDDQSRNRRFGLLLGREVPIPEAEHQIGQVVEGKHNAAQICAIANKNKVEMPICEQINALLHGIVHAQQAVNNLMSRPAKEE

SEQ ID NO: 17453 - protein, 474 aa, Bacillus thuringiensis
MNGYVYLVGAGPGDEGLITKKAIECLKRADIVLYDRLLNPFFLSYTKQTCELMYCGKMPKNHIMRQEMINAHLLQFAQEGKIVVRLKGGDPSIFGRVGEEAETLAAANIPYEIVPGITSSTAASSYAGIPLTHRNYSNSVTLLTGHAKGSLTDHGKYNSSHNSDTIAYYMGIKNLPTICENLRQAGKKEDTPVAVIEWGTTGKQRVVTGTLSTIVSIVKNENISNPSMTIVGDVVSLRDQIAWKEHKPLHGKKVLFTSATNKTSVMKQKLQEAGAEIYQIPTFKKEEYTLTLEQINEIFNVNRLVFCSAESVEILMQSCSKYKKDIRSLQAELQHMNVATQEKLMQYGLLSKEAKFSSDTTVYLGRNINRIAFIQEKIGAGSYMMTHKYTIDHRFDEVHSRMLSEFLWDSIVFDGRASIDTFLAEVKRLGFIDIVTLPFSYTDVPTLHYANKVGFHNIDYQLQETLMKKDMVRQ

SEQ ID NO: 17454 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMNWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 17455 - protein, 430 aa, Pisum sativum
MAQILAPSTQWQMRITKTSPCATPITSKMWSSLVMKQTKKVAHSAKFRVMAVNSENGTINRVEDLLNLDITPFTDSIIAEYIWIGGTGIDVRSKSRTISKPVSHPSEVPKWNYDGSSTGQAPGEDSEVILYPQAIFKDPFRGGNNILVVCDAYTPAGEPIPTNKRHRAAEIFSNPKVEAEIPWYGIEQEYTLLQTNVKWPLGWPVGGYPGPQGPYYCAAGADKSFGRDISDAHYKACIYAGINISGTNGEVMPGQWEYQVGPSVGIEAGDHIWASRYILERITEQAGVVLTLDPKPIEGDWNGAGCHTNYSTKSMREDGGFEVIKKAILNLSLRHKIHIEAYGEGNERRLTGKHETASINDFSWGVANRGCSIRVGRDTEKNGKGYLEDRRPASNMDPYVVTALLAESTLLWEPTLEAEALAAQKIALKV

SEQ ID NO: 17456 - protein, 72 aa, Streptococcus mutans
MAKEDVIEIEGKVVETMPNAMFTVELENGHQILATVSGKIRKNYIRILVGDKVTVEMSPYDLTRGRITYRFK

SEQ ID NO: 17457 - protein, 356 aa, Phaseolus vulgaris
MSLLSDLINLNLSESTEKIIAEYIWVGGSGMDLRSKARTLPGPVDDPAKLPKWNYDGSSTDQAPGDDSEVILYPQAIFKDPFRRGNNILVICDVYTPAGEPLPTNKRYDAAKIFSHPDVVAEVPWYGIEQEYTLLQKDVNWPLGWPLGGYPGPQGPYYCGVGADKAYGRDIVDAHYKACVYAGINISGINGEVMPGQWEFQVGPSVGISAGDEVWAARYILERITELAGAVVSFDPKPIPGDWNGAGAHSNYSTKSMREEGGYEVIKKAIEKLGLRHKEHIAAYGKGNERRLTGRHETADINTFSWGVANRGSSVRVGRDTEKQGKGYFEDRRPASNMDPYVVTSMIAETTILWKP

SEQ ID NO: 17458 - protein, 340 aa, Streptomyces hygroscopicus
MSIKAEYIWIDGTQPTAKLRSKTKILSDGSRLPRWGFDGSSTNQAEGHASDLVLEPVFSCPDPIRGGDHLLVLCEVLHTDLTPHPSNTRALLRPVAERFAGQEPIFGIEQEYTFLKGDRPLGFPEGGGYPAPQADYYCGVGADAIFGREIVEKHLDLCLAAGLGLSGINAEVMPGQWEFQVGALPPLEVSDHMWVARWLLHRVAEEFGVTASLDAKPAKGDWNGAGAHTNFSTRAMREGYDPIITACEALGQDDKPLEHVRQYGTGIEDRLTGAHETAPWDAYSYGASDRGASVRIPWQVEVEKKGYIEDRRPNANVDPYVVTRLMVDTCCTELARREQI

SEQ ID NO: 17459 - protein, 426 aa, Bacteroides thetaiotaomicron
MKRDDLIFDIIEKEHQRQLKGIELIASENFVSDQVMQAMGSCLTNKYAEGYPGKRYYGGCEVVDQSEQIAIDRLKEIFGAEWANVQPHSGAQANAAVFLAVLNPGDKFMGLNLAHGGHLSHGSLVNTSGIIYTPCEYNLNQETGRVDYDQMEEVALREKPKMIIGGGSAYSREWDYKRMREIADKVGAILMIDMAHPAGLIAAGLLENPVKYAHIVTSTTHKTLRGPRGGVIMMGKDFPNPWGKKTPKGEIKMMSQLLDSAVFPGVQGGPLEHVIAAKAVAFGEILQPEYKEYAKQVQKNAAILAQALIDRGFTIVSGGTDNHSMLVDLRSKYPDLTGKVAEKALVSADITVNKNMVPFDSRSAFQTSGIRLGTPAITTRGAKEDLMIEIAEMIETVLSNVENEEVIAQVRARVNETMKKYPLFAD

SEQ ID NO: 17460 - protein, 343 aa, Streptomyces viridochromogenes
MTFKAEYIWIDGTEPTAKLRSKTKIITGQPAGLDALPIWGFDGSSTNQAEGHSSDCVLKPVFTCPDPIRGGDDILVLCEVLNIDLTPHASNTRAALAEVAERFAAQEPIFGIEQEYTFFQDGYPLGFPKGGFPAPQGGYYCGVGADEIFGRDVVEAHLDNCLKAGLAISGINAEVMPGQWEFQVGPVSPLEVSDHLWVARWLLYRTAEDFDVAATLDPKPVKGDWNGAGAHTNFSTKAMRESYDAIITAAESLGEGSKPLDHVKNYGAGIDDRLTGLHETAPWNEYSYGVSDRGASVRIPWQVEKDGKGYIEDRRPNANVDPYVVTRLLVDTCCSALEKAGQV

SEQ ID NO: 17461 - protein, 315 aa, Lupinus angustifolius
MSLLSDLINLNLSDTTEKIIAEYIWVGGSGVDLRSKARTLSGPVNDPSKLPKWNYDGSSTGQAPGKDSEVILWPQAIFKDPFRRGNNILVICDTYTPSGKPIPTNKRHAAAKIFSHPDVAAEEPWFGIEQEYTLLQKDIHWPIGMALGGFPGPQGPYYCGTGAEKAFGRDIVDSHYKACLYAGINISGINAEVMPGQWEFQVGPSIGISAGDELWVARYILERITEIAGVVLSLDPKPIPGDWNGAGAHTNYSTKSMRNDGGYEVIKQAIEKLEKRHNEHIAAYGEGNERRLTGRHETADISTFSWGVANRGASI

SEQ ID NO: 17462 - protein, 751 aa, Methanosarcina mazei
MTEEINLRVAEAYHKDVGRGIARIDTRLMQEMGLVSGDIIEISGRSKTYAIVWPNVERGQENRIRIDGNLRSNAKVGIDDRVTIQKVQAKHAQRVTLAPSQPVRLVGGAHYILRIIEGRPLNKGQQIRVETVNNPLTFVVASTRPAGPVVVTKDTEIIIKEKSIEEIKAPEGISYEDIGGLRREIQLVREMIELPMRHPELFQKLGVEPPKGVLLHGPPGTGKTMIAKAVASETDANFITISGPEIVSKYYGESEQKLREIFEEAEKDAPSIIFIDEIDSIAPKRGEVTGEMERRVVAQLLSLMDGLKSRGEVVVIAATNRPNSIDEALRRGGRFDREIEIGIPDRNGRKQILLIHTRGMPLEDEVSLSEIADVTHGFVGADLSSLCKEAAMHALRRITPEIDIEEEIPQEIIDNLVVTKENFREALKNIEPSAMREVYIEVPHVGWDDIGGLEKAKQELIESVEWPLKYPEMFKAVSIKPPRGVLLFGPPGTGKTLLAKAVANESEANFISIKGPELLSKYVGESERAIRETFRKAKQAAPTVIFFDEIDSIAPQRSSVSDTHVSERVVSQILTELDGIEELKDVIIVAATNRPDMVDPALLRPGRFDRLIYIKPPGKEGREKIFEIHAKEKPLAEDVKLSELAEMTEGYVGADIEGICREAAMLALREIVTPGADRKNIQEKAAEVRLSKRHFEKAIRRVKPTTSRETLSAYEKSAELFARYATEFEEESSEEKDQEIKVEEKDQETRV

SEQ ID NO: 17463 - protein, 358 aa, Unknown
  Pseudomonas sp. Y2
MSQFHSLTVKQVRSETRDAVSILFDVPGDLRETFRFTQGQYLVLRTHLDDEEVRRSYSICTGINDGELRVAVKKVAGGRFSAFANETLAAGDVLDVMPPSGSFHVALDPARHGHYLAVAAGSGITPILSIVKSTLEAEPNSRVTLLYGNRASGGALFREQLEDLKNRYLQRLNLIFVFSREQQDIDLYNGRIDAAKCEQLFSRWLDVPNLDAAFICGPQEMTETVRDALKAKGLASERIHFELFATAGNEQRRQAREAARQVDSAVSQVTVISDGRALSFDLPRNSVSVLEAGNAIGAELPWSCKAGVCSTCKCKVIEGEVEMDSNHALEDYEVAAGYVLSCQSYPVSERVVLDFDQL

SEQ ID NO: 17464 - protein, 550 aa, Desulfovibrio desulfuricans
MSENDSAQNSEERRWLIPEEGRKHLAGVFAGLPGEVTLDVFTDGDEKNQYNEYTVRFAQELAELADKIDTRVHALDSAEAQRLGVTLGPSTLLNAGTYAIRFTGAPLGEEARGFIEAIMLVSAGKAAVSENVGRILERLEEKRTVRVFSSPGCPYCPGQVVNAVKCAIASPQLVSAEAVNSDEFPELSRKYGVGSVPHTNINDEFDAVGLMPEERFAVELVTMKDASGMVREAGQDAGTGDYPVEKVDLVIVGAGPAGLTAGIYAERSGLKSVVLDKAVVGGQVAVTPVVENYPGFKNVGGMNLVEMLAAHTREYAHVQEHEEIEEIKIGRNIEVYTARNVYLARALVFATGAQWRELGVPGEDTYFGKGVSHCASCDGFMFKGKKVIIVGGGNTALTDALHLKNLGVDITVVHRRDAFRAEQQLQDALEREQIPVLWDTVVEEILGTDGLVTGARLKNVKSGDVHEVALDGVFVAVGHVPNSALAAELGVTLNEDGTIAVDRAMRTNIPRVYAAGDVTGGIRQIVTAVGNGATAALSAFEDLQSSRWKK

SEQ ID NO: 17465 - protein, 521 aa, Glycine max
MEPLSSTKHNNNLSKPSSLHTEAPPPEASPLRKIMVVASIAAGVQFGWALQLSLLTPYVQLLGIPHTWAAFIWLCGPISGMLVQPIVGYHSDRCTSRFGRRRPFIAAGSLAVAIAVFLIGYAADLGHMFGDSLAKKTRPRAIAIFVVGFWILDVANNMLQGPCRALLADLCAGDHRKTRNANAFFSFFMAVGNVLGYAAGSYSGLHNVFPFTKTKACDVYCANLKSCFFLSIALLLTLSTIALTYVKEKTVSSEKTVRSSVEEDGSHGGMPCFGQLFGAFRELKRPMWILLLVTCLNWIAWFPFLLFDTDWMGREVYGGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPQMVVSVISGPWDALFGGGNLPAFVVGAVAAAASGILSIILLPSPPPDLAKAATAAGGGFH

SEQ ID NO: 17466 - protein, 377 aa, Unknown
  Synechocystis sp. PCC 6803
MPGDYYQTLGVTRDADKDEIKRAYRRLARKYHPDVNKEPGAEEKFKEINRAYEVLSEPEIRQRYDQFGEAGVSGGGAQGFDVGNMGDFADIFETIFGGFGGGMGGQQRGRRRANGPTRGDDLRLDLQLTFQEAIFGGEKEIRIPHLESCQVCEGTGAKPGTGVKTCGTCNGAGQVRRATRTPFGSFAQVSACPTCNGSGEVIEQKCEACNGVGRKQETKKLKITIPAGVDDGTRLRVGKEGDAGLRGGPAGDLYVFLMVETDKHFVREGMNIRSNLEVSYLQAILGCRLEVDTVDGKAELTIPAGTQPNTVLTLENKGVPKLGNATIRGDHLITVKVQIPTRINSEERELLERLATIKGESHGKGGLEGFLGGLFHK

SEQ ID NO: 17467 - protein, 479 aa, Brassica napus
  misc_feature (187)..(187): Xaa can be any naturally occurring amino acid
  misc_feature (201)..(201): Xaa can be any naturally occurring amino acid
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNXLGYAAGSYKNLYKXVPFTMTKSCDLYCANLKTCFFLSITLLVLVTFVSLCYVKEKPWTPEPTADGKASNVPFFGEIFGAFKELKRPMWMLLIVTALNWIAWFPFLLFDTDWMGREVYGGNSDATASVASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGAPFDELFHGGNIPAFVLGAIRA

SEQ ID NO: 17468 - protein, 115 aa, Chlamydomonas reinhardtii
MQALSARAPRVAAKPVSRSGARSAVTVVCKATTVRSEVAKKVAMLSTLPATLAAHPAFALVDERMNGDGTGRPFGVNDPVLGWVLLGVFGTMWAIWFIGQKDLGDFEDADDGLKL

SEQ ID NO: 17469 - protein, 365 aa, Triticum aestivum
MVQPVFDAAVLSGRADIPSQFIWPEGESPTPDAAEELHVPLIDIGGMLSGDPRATAEVTRLVGEACERHGFFQVVNHGIDAELLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNDSIMRLNYYPPCQRPMETLGTGPHCDPTSLTILHQDNVGGLQVHTEGRWRSIRPRADAFVVNIGDTFMALSNGRYKSCLHRAVVNSKVPRKSLAFFLCPEMDKVVAPPGTLVDAANPRAYPDFTWRSLLDFTQKHYRADMKTLEVFSSWIVQQQQGQLLPPLASH

SEQ ID NO: 17470 - protein, 550 aa, Pseudomonas putida
MRTPYCVADYLLDRLTDCGADHLFGVPGDYNLQFLDHVIDSPDICWVGCANELNASYAADGYARCKGFAALLTTFGVGELSAMNGIAGSYAEHVPVLHIVGAPGTAAQQRGELLHHTLGDGEFRHFYHMSEPITVAQAVLTEQNACYEIDRVLTTMLRERRPGYLMLPADVAKKAATPPVNALTHKQANADSACLKAFRDAAENKLAMSKRTALLADFLVLRHGLKHALQKWVKEVPMAHATMLMGKGIFDERQAGFYGTYSGSASTGAVKEAIEGADTVLCVGTRFTDTLTAGFTHQLTPAQTIEVQPHAARVGDVWFTGIPMNQAIETLVELSKQHVHTGLMSSSSGAIPFPQPDGSLTQENFWRTLQTFIRPGDIILADQGTSAFGAIDLRLPADVNFIVQPLWGSIGYTLAAAFGAQTACPNRRVIVLTGDGAAQLTIQELGSMLRDKQHPIILVLNNEGYTVERAIHGAEQRYNDIALWNWTHIPQALSLDPQSECWRVSEAEQLADVLEKVAHHERLSLIEVMLPKADIPPLLGALTKALEARN

SEQ ID NO: 17471 - protein, 171 aa, Enterococcus faecalis
MEEKAIFAGGCFWCMVQPFDTQPGIISVVSGYTGGHVPNPTYEQVLTHTTGHTEAVEITFDPAIISYEQLVDIYWQQTDPTDAFGQFQDRGDNYRPVIFYRSQEQKEIAEKSKERLANSGRFTEPIVTTIEPAAPFYPAEEYHQDFYKKDALRYGLSHQRRSEFIEEKWSD

SEQ ID NO: 17472 - protein, 336 aa, Pseudomonas aeruginosa
MGRRYLSGAAGAIRRRGSTCHCRQRRMRAFLRGAGKSRCQIAALPGRSRPMSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKEFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTHEGLRRLPLETLRQRFRDSGIATRYYNADIHLGAFALPQYVLQAIGKQDND

SEQ ID NO: 17473 - protein, 153 aa, Physcomitrella patens
MQIFVKTLTGKTITLEVESSDSIQNVKTKIQDKEGIPPDQQRLIFAGKQLEDERTLADYNIQKESTLHLVLRLRGGTMIKVKTLTGKEIEIDIEPYDTIERIKERVEEKEGIPPVQQRLIFAGKQMNDDKTAKDYNIEGGSVLHLVLALRGGC

SEQ ID NO: 17474 - protein, 111 aa, Bradyrhizobium japonicum
MKKIEAIIKPFKLDEVRSLSGVGLQGITVTEAKGFGRQKGHTDLYRGAEYIVDFLPKVKIEIVIGDDLVERAIDAIRRAAQTGRIGDGKIFVSNIEEAIRIRTGESGLDAI

SEQ ID NO: 17475 - protein, 479 aa, Pisum sativum
MEEPTFLFPPPDSDLDLSFTSTTTDRTFTSSSARTSLARTSSLALSFNDRLSTASAAAGDTVSSAIIRRPHRSSDPNWTAIKAATNLSSDGRLHLRHLKLLRHLGSGDLGRVFLCRLRDYDGANFALKVVDKDLLTLKKSTHAETEAEILHALDHPFLPTLYARIDVSHYTCLLIDYCPGGDLHSLLRKQPGNRFTLSAARFFAAEILVALEYLHALGVVYRDLKPENVLIREDGHVMLSDFDLCYKADVSPTFEFSTNHKLHVDPTHGCFSYNRSKSRESVTAEFVAEPTTAFSRSCVGTHEYLAPELVSGNGHGNGVDWWAFGVFIYELLYGTTPFKGCNKESTLRNIASNKDVKFHVAENEEVGMVGARDLIEKLLVKDPRRRLGCARGATDIKRHPFFDGIKWPLIRTYKAPEVKGLLRRKKSESSLSQLSSKRKRGWWKRLGCVLRNKGARFDLLSNYSNNNHYYCYVNNSKVR

SEQ ID NO: 17476 - protein, 445 aa, Shigella flexneri
AVMGRNLALNIESRGYTVSIFNRSREKTEEVIAENPGKKLAPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRSALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 17477 - protein, 112 aa, Synechococcus elongatus
MKKIEAIIRPFKLDEVKIALVNAGIVGMTVSEVRGFGRQKGQTERYRGAEYTVEFLQKLKLEIVVEDAQVDTVIDKIVAAARTGEIGDGKIFVSPVDQTIRIRTGEKNADAI

SEQ ID NO: 17478 - protein, 526 aa, Chlamydophila pneumoniae
MERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIAQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 17479 - protein, 231 aa, Unknown
  Candidatus Blochmannia floridanus
MKKLSMREMLQAGVHFGHQTRYWNPKMKPFIFGIRNKIHIINLDKTIVMFSNALVELKKIALAKGKILFVGTKRATRESIKSTALICGQFFVNYRWLGGMLTNWKTVRQSIKRLKDLENQSQDGTFDKLTKKEVLILNRELISLENSLGGIKNMGGLPDALFTAGAEQEHIAIKEANSLGIPVFSIVDTNSDPDGIDFIIPGNDDAIRAINLYLNIVSNVICSDELNKETH

SEQ ID NO: 17480 - protein, 379 aa, Rhodopseudomonas palustris
MSTTKRCYYETLEVERNADDSTLKSAFRKLAMKWHPDRNPGDPQCEIKFKEINEAYEVLKDGDKRAAYDRYGHAAFEQGGFGGGAGFGAGFASSFSDIFEDLFGMAAQRGRGTGRERGADLRYNMEITLEDAFKGKTAQIEIPVSVTCEACSGTGAKAGTKPKTCSTCGGAGRVRQAQGFFTLERTCPSCQGRGQTIEDPCPSCTGSGRVTKERTLSVNIPQGVEDGTRIRLAGEGEAGLRGGPPGDLYIFLSLANHAIFQRDGADLHCRVPISMVTAALGGEFEVPTIDRGKTKVKVPSGTQTGRRFRIAGKGMPVLRSRQVGDMYVQVVVETPQNLTKKQQELLAEFEKLSSGETQPEAVGFFSKVKEFFGSRASAP

SEQ ID NO: 17481 - protein, 333 aa, Chlamydophila pneumoniae
MKGVRMAFKEVVRVAVTGGKGQIAYNFLFALAHGDVFGVDRGVDLRIYDVPGTERALSGVRMELDDGAYPLLHRLRVTTSLNDAFDGIDAAFLIGAVPRGPGMERGDLLKQNGQIFSLQGAALNTAAKRDAKIFVVGNPVNTNCWIAMKHAPRLHRKNFHAMLRLDQNRMHSMLAHRAEVPLEEVSRVVIWGNHSAKQVPDFTQARISGKPAAEVIGDRDWLENILVHSVQNRGSAVIEARGKSSAASASRALAEAARSIFCPKSDEWFSSGVCSDHNPYGIPEDLIFGFPCRMLPSGDYEIIPGLPWEPFIRNKIQISLDEIAQEKASVSSL

SEQ ID NO: 17482 - protein, 222 aa, Prochlorococcus marinus
MMEAGAHFGHQTRRWNPKMSRYIYSARNGVHIIDLVKTAVCMNSAYKWTRGAARSGKRFLFVGTKKQASEVVAQEAIRCGASYVNQRWLGGMLTNWTTMKARIDRLKDLERMESSGAIAMRPKKEGAVLRRELERLQKYLGGLKGMRRLPDVVVLVDQRRETNAVLEARKLDIPLVSMLDTNCDPDLCEIPIPCNDDAVRSVQLVLGRLADAINEGRHGPNE

SEQ ID NO: 17483 - protein, 121 aa, Zea mays
MFLHIAACNVPQGNSSDQQVQHPPWIRDCKGEIPTGVSLFLGRFVFFNFQRENVAKQVPAQNGKTHFDAGDERAKEFAALLKSNDPVGFNLVDVLAWGSLGHIVAYYILATSSNGYDPNFF

SEQ ID NO: 17484 - protein, 162 aa, Shewanella oneidensis
MTSTIYRHNAIDIQGNPTPLTQYQGKVILIVNTASECGFTPQYKGLEALYQEYKARGFVVLGFPCNQFGAQEKANEQGIKSFCELNFGVSFPLFSKIEVNGEHTHPLYQYLKKAAPGMLGTERIKWNFTKFLINRQGEAVARFAPTTKPEDIRDKIESLLNK

SEQ ID NO: 17485 - protein, 663 aa, Daucus carota
MKGEHGDVDEVMEAFGEEIWRGSEESSIFCDVFPALPDFPCMSSTSSSSSNPALNRQFVSSSASSGCSASSSVVVKSDGNLRSVKYEVDVSSALSSTDCMGVMEEFGYMDLIEDGNEGWDPSSIFRNDDESNVGEELIDQGGFKEEERVEEEMGLDELGVMFFEWLKTNKEHISAEDMKNIRFKKSTIECAYKRMGSSKEGKKQLLKLILEWVEQYQLQKKRSREAAEAAAEAATSHQVPCLYQEPNPNPNPNSNFVNFMPTPGANACMWIPTPQSSSIDPLAVVPSGPAPPAVAYYQPYPFVGGANVGPVNCQPYPPQMPQPEYQMLESPQLWPRSQFVLAPQYNSLPDQNGNFVPIAPHPVAPVYGGQYPSQVYNGSNSDRVVRLAPSATKEARQKRMARKRWGSFHRNQPHQNQIQKTDSPEQISEKKLGAENFTNSINGQSSPVNWLYWPAVGPPKLAQPPMAAQSQQPDQYQQGYPTFLPVKAQSNRRPAQQQQKKQGFKGEKNLKFLLQKVLKQSDVGCLGRIVLPKREAETQLPQLEDRDGIQIVMEDIGTSKVWNLRYSLRYWPNNKSRMYVLENTGEFVKENGLQEGDFIVIYSDIKCGKYLIRGVKVRQPVKGKLEAKVTRKHHSNSGAGTDIPQNHSNSGAGTDIPPYTPSN

SEQ ID NO: 17486 - protein, 554 aa, Saccharomyces cerevisiae
MSNNSFTNFKLATELPAWSKLQKIYESQGKTLSVKQEFQKDAKRFEKLNKTFTNYDGSKILFDYSKNLVNDEIIAALIELAKEANVTGLRDAMFKGEHINSTEDRAVYHVALRNRANKPMYVDGVNVAPEVDSVLKHMKEFSEQVRSGEWKGYTGKKITDVVNIGIGGSDLGPVMVTEALKHYAGVLDVHFVSNIDGTHIAETLKVVDPETTLFLIASKTFTTAETITNANTAKNWFLSKTGNDPSHIAKHFAALSTNETEVAKFGIDTKNMFGFESWVGGRYSVWSAIGLSVALYIGYDNFEAFLKGAEAVDNHFTQTPLEDNIPLLGGLLSVWYNNFFGAQTHLVAPFDQYLHRFPAYLQQLSMESNGKSVTRGNVFTDYSTGSILFGEPATNAQHSFFQLVHQGTKLIPSDFILAAQSHNPIENKLHQKMLASNFFAQAEALMVGKDEEQVKAEGATGGLVPHKVFSGNRPTTSILAQKITPATLGALIAYYEHVTFTEGAIWNINSFDQWGVELGKVLAKVIGKELDNSSTISTHDASTNGLINQFKEWM

SEQ ID NO: 17487 - protein, 425 aa, Novosphingobium aromaticivorans
MSTQPATIADSATDLVEGLARAARSAQRQLARMDSPVKERALTLAAAALRAAEAEILAANAQDMANGAANGLSSAMLDRLKLTPERLAGIADAVAQVAGLADPVGEVISEAARPNGMVLQRVRIPVGVIGIIYESRPNVTADAAALCVRSGNAAILRGGSEAVHSNRAIHKALVAGLAEGGVPAEAVQLVPTQDRAAVGAMLGAAGLIDMIVPRGGKSLVARVQADARVPVLAHLDGINHTFVHASADPAMAQAIVLNAKMRRTGVCGAMETLLIDATYPDPHGLVEPLLDAGCELRGDARARAIDPRIAPAADNDWDTEYLEAILSVAVVDGLDEALAHIARHASGHTDAIVAADQDVADRFLAEVDSAIVMHNASSQFADGGEFGLGAEIGIATGRLHARGPVALEGLTTYKWLVRGSGQTRP

SEQ ID NO: 17488 - protein, 279 aa, Bdellovibrio bacteriovorus
MKKEMSHRKKVRRRVNKKSTALVFDKYELYRKAVQSAENDVVFIWNTFRELKGKQPRVFREDFCGTFALSTEWIKLHPRHEAVGVDLDPEPMAYGKANYLTKLKPEQQKRMKLVEGNVLDPNLAKADIVAAMNFSYFCFKKRDVLKKYFANVLKTLNKDGMFLVDIFGGSQCYEAIEDAIKHEGFTYYWDQTNFDPVTNEALFHIHFKVGGKKIEQVFTYDWRMWSISEIRDIMEEVGFKKSHVYWEGTAPDGSGDGNFTRVDHGEACQSWIAYVVGEK

SEQ ID NO: 17489 - protein, 356 aa, Phaseolus vulgaris
MSSISDLVNLNLSDSTERVIAEYIWVGGSGMDMRSKARTLSGPVKDPSKLPKWNYDGSSTGQAPGQDSEVILYPQTIFRDPFRRGNNILVMCDAYTPAGEPIPTNKRHNAAKIFSNPEVVAEEPWYGIEQEYTLLQKDVQWPVGWPLGGFPGPQGPYYCGIGANKAFGRDIVDSHYKACLYAGINISGINGEVMPGQWEFQVGPSVGISAADELWVARYILERITEIAGVVLSFDPKPIQGDWNGAGAHTNYSTKSMRNDGGYEVIKKAITKLEKRHKEHIAAYGEGNERRLTGKHETADMNTFIWGVANRGASIRVGRDTEKAGKGYFEDRRPASNMDPYVVTSMIAETTLLWKP

SEQ ID NO: 17490 - protein, 489 aa, Vibrio cholerae
MSAELLLNVTPSETRVAMIEGGILQEIHIEREAKRGIVGNIYKGKVSRVLPGMQAAFVDIGLDKAAFLHASDIVPHTECVAESEKQQFQVRDISELVRQGQDIVVQVVKDPLGTKGARLTTDITLPSRYLVFMPGASHVGVSQRIESEAERERLKKIVSHYCDEHGGFIIRTAAEGANEKELTQDAAFLKRLWSKVIERRSKYKNRSMLYGELGLAQRILRDFVGTELTKILIDSRQEFENLKEFTSEYVPELTAKLELYHGDKPIFDMYDTENEIQRSLERKVELKSGGYLIIDQTEAMTTIDINTGAFVGRRNLEETIFNTNIEATQAIARQLRLRNLGGIIIIDFIDMASDEHRKRVLTSLETALMKDRVKTNINGFTQLGLVEMTRKRTRESIEHVLCSTCPTCEGRGSVKTVETVCFEILREITRVNRAYDADKFVVYASPAVADTLQGEESHALAELEVFIGKEVRIQAEPLYNQEQFDVVMM

SEQ ID NO: 17491 - protein, 446 aa, Rhodopirellula baltica
MQPEHVAGANMPNAVGNHDPMMRQTVTVILAGGRGSRLEPLTRDRAKPAVPIGGAYRIIDFVLSNCLNSDMRRLLLLTQYKAQSLDRHINVAWRNYFCRELGEFIDVVPPQQRIDDNWYQGTADAVYQNIYAIEREAPEYVVILAGDHLYKMNYESMVNFHHRKGADVTVGALRVSREEARQFGVMQVDTDNRLVEFQEKPENPRPTLDDPDVCLASMGIYVFNTRFLFERLCDDATQPDSDHDFGKNIIPGAIEDSQVFAFPFTDENRKRDAYWRDVGTLEAYYEANMDLVGVDPQLNLYDRQWPIRSFQPQLPPPKFVFGSEGRSSRRGEALDSIVCQGAIISGGCVRRSVIGTGCRINSYAQVEDSILFDDVNVGRHSRIRRAIIDKGVQIPPETEIGYDLALDRARGLTVTDSGLVVIARGEMIASPVSTNGSHDPTSSLTS

SEQ ID NO: 17492 - protein, 429 aa, Phaseolus vulgaris
MAQILAPSTQWQMRFTKSSRHASPITSNTWSSLLMKQNKKTSSAKFRVLAVKSDGSTINRLEGLLNLDITPFTDKIIAEYIWIGGTGIDVRSKSRTISKPVEHPSELPKWNYDGSSTGQAPGEDSEVILYPQAIFKDPFRGGNNILVICDAYTPAGEPIPTNKRHRAAEVFSNPRVIAEVPWFGIEQEYTLLQTNVNWPLGWPVGGYPGPQGPYYCSAGADKSFGRDISDAHYKACLFAGINISGTNGEVMPGQWEYQVGPSVGIEAGDHIWASRYILERITEQAGVVLSLDPKPIEGDWNGAGCHTNYSTKSMREDGGFEVIKKAILNLSLRHKEHISAYGEGNERRLTGKHETASINTFSWGVANRGCSIRVGRDTEKNGKGYLEDRRPASNMDPYVVTSLLAESTLLWEPTLEAEALAAQKLALKV

SEQ ID NO: 17493 - protein, 238 aa, Triticum aestivum
MAAPPSSVSVRAGASVSAKLTPSRAARVGFGGRVSVGSGRKCGGPVRASLFSPKPAVAMDARPTKVQELHVYELNEHDRESPAYLRLSAKQSQNALGDLVPFTNKVYNGSLDKRIGITAGICILIQHVPERNGDRYEAIYSIYFGDYGHITVQGPYLTYEESYLAVTGGSGVFEGVYGQVKLNQIVFPFKIFYTFYLKGIPDLPRELLCTPVPPSPTVEPTPAAKATEPHACLNNFTD

SEQ ID NO: 17494 - protein, 450 aa, Salmonella typhimurium
MPTHLVWFRRDLRLQDNLAAAACRDASARVLALYISTPQWQAHDMAPRQAAFISAQLALQTALAEKGIPLLFHEVAFNASIETVKNVCRQHDVSHFYNYQYEFNERQRDRAVEKLPSVICEGFDDSVILAPGAMTGNHEMYKVFTPFKNAWLRLKEDIPPCVPAPKIRVSGLSTPLTPVSLNYPQQEFDALFPVEENAVIAQLRQFCAQADEYALRRDFPAVDGTSRLASLATGGLSPRQCLHRLLAQPQALDGGPGSVWLNELIWEFYRHLMTWYPALCKHQPFRWTKRVAWQENPHYFQAWQGETGYPIVDAAMRQLNATGMHNRLRMITASFLVKDLLIWRLGERYFMSQLIDGDLAANGGWQWAASTGTDAAPYFRFNPTTQGERFDRDGEFIRQLPALRDIPGKAIHEPWRWAKAGVVLDYPRPIVEHKQARATLSAYEAARKGA

SEQ ID NO: 17495 - protein, 195 aa, Geobacter metallireducens
MSRKATIERVTKETQIKLSLEIDGAGEAKICTSVPFLDHMLDLFARHGLFNLQVDARGDIDIDFHHTVEDIGIVLGQALKEALGDKKGIRRYGQASVPMDETLASVAVDISGRPYLVYHVALPKVKIGEFDVELVREFFQAVVNNLGANIHVNVMYGDNVHHMVEACFKAFARAMDQATQVDPRIEGVMSTKGKL

SEQ ID NO: 17496 - protein, 192 aa, Staphylococcus aureus
MIYQKQRNTAETQLNISISDDQSPSHINTGVGFLNHMLTLFTFHSGLSLNIEAQGDIDVDDHHVTEDIGIVIGQLLLEMIKDKKHFVRYGTMYIPMDETLARVVVDISGRPYLSFNASLSKEKVGTFDTELVEEFFRAVVINARLTTHIDLIRGGNTHHEIEAIFKAFSRALGIALTATDDQRVPSSKGVIE

SEQ ID NO: 17497 - protein, 475 aa, Bartonella henselae
MLNDANNELKRNLQNRHIQMIALGGVIGTGLFYGSKEAIQLAGPSAILAYLIGGLIIYFIMRMLGEMSVEEPSSGAFSFFAYKYWGRLAGFITGWNYWFLYILVSMTELTVIGFYLDHWILIDHWKSSFIVLLLITLVNLFNVRFYGEFEFACALIKVAAVISMIIFGIFLIVTGVGGNQASIHYLWCHGGFFSYGAIGVVLATSVVMFSFGGTELIGIAAGETSNPQKTIPVAIRQVMWRIIIFYIGSISVIMIISPWNMIEKNSSPFVTIFETLGIPAAGHILNFVVIMAAISVYNSGIYSNGRMLYSLAIQKNAPYIFSKLSTARVPYIAILFSSFCTAIIVVINALVPDNSFMRIMALATAAAVITWAIIIIVHLKFRKAHKNKKEDFMYAFGLYPYANYLCLCFLALLFCIMFVSGFGKNGLMTRLFDMIGIKMSFLETYIPMQMPDMSLAVVIIPLWCLFLFLGYKLKR

SEQ ID NO: 17498 - protein, 1118 aa, Unknown
  Magnetococcus sp. MC-1
MDHRNSLLTLYMVMVVAVVAVAAGLLLLLYQDSFAKKQAHLQDLATNQARLIDEVANFNHSYRHDYPTGAVEATISQIRDAHGKSIGFGQTGEFIIAYRKSGHSHVHFIVAHRFTQAVTPSFRENPNHLHPAMARAMAGESGFMEGTDYRGKQVLIAYAPVVKLRMGVVAKMDVQEVLAPFERILKIGLSITLLLIGGGSVAYLWVAKGVAGRMEWQHQRLAMLVEGMPAVIYTEDLRTQLPYYVSPQAVVLLGGQGCQADEPLDVWWNRHVWAEDWETLQHARQMLKKHKRPMQVEYRMVRQDGQLIWVRDVARLVCDEQGLPLLVQGMVMDVSEARHTHEKLIASEVRFRQLYENAPIAYQSLNTEGVIQNVNQAWLKKTGYELSQVLDHSLFEFLVVGQEQEVAKKFEAFLQAGYVQDLHYELRCADGRALKVSINGQVSRDRSGRLVKTHCVLTDITEQDRAAQALQESESRLRLILASTGEGLFGLDLQGNFIFANPACLRMMGYRDDRQLLGKPMLEIVSCCSSQFVRRGKGSCPISQILKTGLPNHAEGELFRRADGSFFSTEFWSHPIQQNGELVGAVVTFIDISQRVLNQTALKASELKYRTIFESVPTPLLILDTSGVVRDVNSAHQSTFGRFAGGSLMGVSIREHPGVAGSLLAESFLALAKGEPMPLQQASYTMEAEGEAIHFNVRGVPFVTRDGEGREDLQGALVIHENITDLKQTELKLRKAVEEADCATHAKGDFLAVMSHEIRTPMNLVVGMAELLLETDVNAEQKHYLEKLQKAGDTLLSLINNILDLTKLDEGQLKLLDEPFAPQALLDEVSGIISLAAEAKGLTLSCEIQEGVPERVLGDSVRIKQVLLNLLSNALKFTQQGFIRLSLTVEGAEGAQQLCYAVSDSGMGIPDYHLDEVFERFSQGDSSMTRRFGGSGLGLAICKKLVILMQGQIQVSSQVDVGAIFQIRLPLRAAALAPASSQQQVKRRLNQGVRVLLAEDAVDNRMLIQAYLRNSPHDLVMVEDGQQALQLIEEGTDFNLILMDVQMPVMDGYSATRAILAELGAQQRPPCPIVALTAHALEGDQARSLQAGCVAHLTKPIKKKILLEAIQTYARLAP

SEQ ID NO: 17499 - protein, 582 aa, Oryza sativa
MTLMTDGINLFREEDCSCRLAEPKRGEEIPREEMRSHEMNNSSSRYASEEERGSNSFLIESEEEEEDEEAHPHSSILLKDADSDSDSDDSSCATPRPSSYATHQWPQSYRQSIDIYSSVQSPNLSFLGTPTLSRLSNSFLTNSFRGKTPEILSNLVKPLLRPSSSSDDQQQQQQHDDDTRKSSQYLLPSRKPSLQQIPEDQKPLVPAHEVPAYQQCSYTQAVMNGINVLCGVGILSTPYAIKQGGWLGLVILCLFAVLAWYTGVLLRRCLDSKEGLETYPDIGHAAFGTTGRYAKMTALVLTLFPCMWLHYLQIILYIELYACCIEYLILESDNLSKLFPNAHLTIGSMTLNSHVFFAILTTLIVMPTTWLRDLSCLSYLSAGGVIASILVVVCLCWVGVVDHVGFENKGTALNLPGIPIAIGLYGYCYSGHVLKIWLLFLISIGLSSILFAGAAVMGYKMFGESTESQFTLNLPENLVVSKVAVWTTQKYANIIMLRSSLVVSTLLIALSVPFFGLVMALVGSLLTMLVTYILPCACFLAILKRKVTWHQIAACSFIIVVGVCCACVGTYSSLSKIIQNYT

SEQ ID NO: 17500 - protein, 217 aa, Triticum aestivum
MGRRPARCYRQIKNKPYPKSRYCRGVPDPKIRIYDVGMKKKGVDEFPSCVHLVSWEKENVSSEALEAARIACNKYMTKNAGKDAFHLRVRVHPYHVLRINKMLSCAGADRLQTGMRGAFGKPLGTCARVDIGQVLLSVRCKESNAVHADEALRRAKFKFPGRQKIIRSRKWGFTKFNKADYIKYKSEGRIVPDGVNAKLLGVHGPIAKRAPGQAILA

SEQ ID NO: 17501 - protein, 764 aa, Unknown
  Magnetococcus sp. MC-1
MLIMLLLTRTLMGSLESNYLLAKQRQANENNIEILLASATEALENRNIIGLKKIFAQALRSQPQLLELTILNDDGKPLFSSTREQAPNTTLTHFRTPIMVQGSFQGILVGAWDLAPDLRAIDTHVNHILLLTSLLFGLITLMVIFMVHRLAIQPVDAIYNRLIKQISPPQSKPETFHAARELRRLHQTVESFSRTAASHLENARTLQESEALLKQRVERRTRELRLAKEAAEQANLAKTEFLATMSHEIRTPLNGVLGMSDLLLESDLNSYQRHHVETIHRSGRTLLRVINDILDLSRIQAGRMPLEVTAFKLRACLEDVQALFKDQARRKGLSFSINCQEELPQRLLGDATRLNQILFNLVGNALKFTERGFVRVSVQAEQVREADLLLRIQVEDSGIGISDEYKNRLFEIFSQQDSSISRRYGGSGLGLVITRKLAQIMGGKLGFSSRSGAGSTFWVTARFGRVPDTLPDHPLLPREEQQSNLLNQRFRAHILLAEDNPVNQDVARLNLERLGCRVTLVENGQQAVTVFQENRFDLVLMDCEMPIMDGYTATRTIRDLERQQGRRATPIIAVTAHALASHRNKAIATGMNDFLSKPFSTTKLIKLLATYLPPHTVIAQPDPAPPVVTQETAPSADPAHKTLDHRALDQIRALDPADPQGMLNRMIDLYFEQSAKDFKAIENGLATQNAELIRFHAHKLKSSSAQMGGQQLSLLCRTIEEQCHTFTRVEESMSQASKAQHELCAALHALRQTAPPTPPSEGEI

SEQ ID NO: 17502 - protein, 94 aa, Arabidopsis thaliana
MSSSRRSRQASSSSRISDDQITDLISKLRQSIPEIRQNRRSNTVSASKVLQETCNYIRNLNKEADDLSDRLTQLLESIDPNSPQAAVIRSLING

SEQ ID NO: 17503 - protein, 418 aa, Streptococcus agalactiae
MIFDKDNFKEFDQELWQAIHDEEIRQQNNIELIASENVVSKAVMAAQGSVLTNKYAEGYPSHRYYGGTDCVDVVESLAIERAKTLFNAEFANVQPHSGSQANAAAYMALIEPGDTVLGMDLAAGGHLTHGASVSFSGKTYHFVSYSVDPKTEMLDYDNILKIAQETQPKLIVAGASAYSRIIDFEKFRQIADAVDAYLMVDMAHIAGLVASGHHPSPIPYAHVTTTTTHKTLRGPRGGLILTNDEAIAKKINSAVFPGLQGGPLEHVIAAKAVALKEALDPSFKIYGEDIIKNAQAMAKVFKEDDDFHLISDGTDNHLFLVDVTKVIENGKKAQNVLEEVNITLNKNSIPFERLSPFKTSGIRIGTPAITSRGMGVEESRRIAELMIKALKNHENQDILTEVRQEIKSLTDAFPLYEN

SEQ ID NO: 17504 - protein, 589 aa, Phaseolus vulgaris
MMMTMMSLNSSSSFSSNCSSLTDMGFPTRFEKKGIRKVVDCALQSPSVINFPNQPHHKSQNTKEPTTPAFTTDTPKRIQWNPFQKAAAMALDMFESALVSRELQQPLSKTTDPRLQLAGNFAPVPEHPLQHSLPVIGTIPEALNGVYLRNGANPLFQPKSGHHLFDGDGMVHAVKIADGNASYACRFTQTQRLMQESQLGKPVFPKAIGQLHGYSGIARLLLFYGRGLCGILDHRRGAGAANAGLVFFNGKLLAMSEDDLPYELRVTDSGDIKTIGRYSFHDQLNSSMIAHPKIDPISGELFSLSYDITSPCVKYFNFSPKEVKSPEVEIRLDISTMTHDFAITENFVIIPDQQVVFKLGEMLNGGSPVMYDGKKPSRFGVLPKYATDASSILWVETPNMFCFHLFNAWEERDTDEVVLIGSCMTPPDSIFNDSEENLTTILTEIRLNLRTGGTTRRVLVPNMNLEVGMVNRKRLGRKTQFAYMAIAEPWPKVSGVAKVNLASGEMRKHEYGDRRFGGEPFFVPIGGGNEDEGYVMAFVHDEVTWQSELQILNGVDLKLEATVILPSRVPYGFHGTFVEAKDLALQTIH

SEQ ID NO: 17505 - protein, 445 aa, Klebsiella pneumoniae
AVMGRNLALNIESRGYTVSVFNRSREKTEEVIAENTGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPVGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRT

SEQ ID NO: 17506 - protein, 396 aa, Zea mays
  misc_feature (377)..(377): Xaa can be any naturally occurring amino acid
MAVLQVAAAAPPPVSVIGFEGFEKRLEISFSEAPVLADPSGRGLRALSRAQIDSVLDLARCTIVSELSNEDFDSYVLSESSLFVYPYKIVIKTCGTTKLLLAIPRILELAEELLLPLAAVKYSRGTFIFPEAQPSPHKNFADEVAFLNRFFGGLKSGGNAYVIGDSAKPGQKWHVYYAAEHPEEPVVTLEMCMTGLDKKKASVFFKTTADGYSLCAKEMTKLSGISDIIPEMEICDFDFEPCGYSMNAVHGPALSTIHVTPEDGFSYASYEVMGFNPGSFSYGDLVKRVLRCFGPTEFSVAVTIFGDRDNAKTWGTKLDAEAYACSNMVEQVLPFGGLLIYQSFTVMGETTHGSPRSVLHDFAGDIVKNRSESDAPXWEADAVDESEEREVKKMKC

SEQ ID NO: 17507 - protein, 445 aa, Klebsiella sp.
AVMGRNLALNIESRGYTVSVFNRSREKTEEVIAENPGKKLVPHYTVKEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILEQIAARAEDGEPCVAYIGADGAGHYVKMVHNGIEYGDMQLIAEAYALLKGGLALSNEELATTFTEWNEGELSSYLIDITKDIFTKKDEEGKYLVDVILDEAANKGTGKWTSQSSLDLGEPLSLITESVFARYISSLKDQRVAASKVLTGPKAQPAGDKAEFVEKVRRALYLGKIVSYAQGFSQLRAASDEYNWDLNYGEIAKIFRAGCIIRAQFLQKITDAYEQNAGIANLLLAPYFKQIADEYQQALRDVVAYAVQNGIPVPTFSAAIAYYDSYRSAVLPANLIQAQRDYFGAHTYKRT

SEQ ID NO: 17508 - protein, 180 aa, Amaranthus hypochondriacus
MASSLMSNAITAVVGASGAQANMVAPFNGLKSIASFPVTRKSNDITSIASNGGRVQCMQVWPPVGKKKFETLSYLPPLSDAQLLAQVQYLLNNGWIPCIEFELEHPFVYRENHRSPGYQDGRYWTMWKLPMYGCTDPAQVLNEVEEAKKAYPSAFIRIIGFDNKRQVQCVSFIAFKPPGY

SEQ ID NO: 17509 - protein, 586 aa, Cuscuta reflexa
MANSLYKPKLCMGSSKFPPLLLQRRSKGFLRVNCSLQTPLLHYSASNSSVTAAISCPVEENSSSSSSRSSLAPRWNFFQRAAAMALDAVEGKLTEHELEQPLPKTADPKVQISGNFAPVTEHPVRQALPVAGRVPDCIQGVYVRNGANPLHELAAGHHFFDGDGMVHAVQFKNGDVSYACRFTETQRFVQERALGRPVFPKAIGELHGHTGIARLMLLYARGLFGLVDHSKGIGVANAGLVYFNNRLLAMSEDDLPYHVRVTPSGDKLKTVERYDFDGKLKSTMIAHPKLDPVSGELFALSYDVIQKPYLKYFWFSKSGEKSQDIEIPVPEPTMMHDFAITERFVVVPDQQVVFKISEMVHGGSPVVYDRNKVSRFGVLNKYAKDSSEMKWVEVPDCFCFHLWNAWEEPETDEIVVVGSCMTPPDSIFNETDEGLQSILSEIRLNLNTGKSTRKPIIQPHVNLEAGMVNRNKLGRKTRYAYLAIAEPWPKVSGFAKVDLFTGEVEKFMYGEEKYGGEPLFLPGDDEAEEDDGYILTFAHDEKAWKSELQIVNAQTLKLEATVKLPSRVPYGFHGTFINAMDLATQV

SEQ ID NO: 17510 - protein, 184 aa, Amaranthus hypochondriacus
MASSMMSNAATAVAVAATSGGAQANMVAPFNGLKSIASFPVTRKSNDITSIASNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPTAFIRIIGFDNKRQVQCVSFIAYKPADSY

SEQ ID NO: 17511 - protein, 598 aa, Oryza sativa
  misc_feature (26)..(26): Xaa can be any naturally occurring amino acid
  misc_feature (512)..(512): Xaa can be any naturally occurring amino acid
  misc_feature (556)..(556): Xaa can be any naturally occurring amino acid
  misc_feature (577)..(577): Xaa can be any naturally occurring amino acid
MMGAAVTMVDRRMAFAAEADVDSKAXAFGFFGGECFVGEGDLVNPAPPPPQQQQVHEGGFAAEDESDGDDDDDDDDDDVDDIEELERRMWRDRVRHKRLKELQQSRAGRESRAGDAGGGGRQQRQSQEQARRKKMSRAQDGILKYMLKMMEVCNAQGFVYGIIPEKGKPVSGASDNLRSWWKEKVRFDRNGPAAIAKYQADNAVPGCDGDAGGAAPAGPHSLHELQDTTLGSLLSALMQHCDPPQRRFPLEKGVPPPWWPEGSEAWWPEAGVPKELGPPPYKKPHDLKKAWKVAVLTAVIKHMSPDVDKVRRLVRQSKCLQDKMTAKEIVTWLAVLKQEEDLYLKLHPGALPPPLSAASFNASVSGEYDVEGVDGDEAGNNNLQKAQNDATAFMDLTTTMDAALSNNKFLIMPLMKEEAIDVDFIQKRSEPELMLSSDSHARVYTCGNVQCPHSNYALGFLDRNERNAHQYACKHNAAAAAAESKPPPPHIFEPLGSFDFDLPVDGQRCLAXGLMTMYDNDVAAATQMHHHHHQQQQANFFIRDDAPFGGDVAATXAAAAPEFRFSSNFNVTGGGAXVDYGGAMQQPPAKYAGSNWFY

SEQ ID NO: 17512 - protein, 160 aa, Bacillus anthracis
MSIEVGSKLQGKVTGITNFGAFVELPEGLTGLVHISEVADNYVKDINDHLKVGDQVEVKVINVEKDGKIGLSIKKAKEREKTEGDRPRGEYQRGGDQQRSGRPQRNRSFNRDNRGGGNDRAPKETFEQKMARFLKDSEDRLTSLKRNTESKRGGRGARRG

SEQ ID NO: 17513 - protein, 380 aa, Cryptococcus neoformans
MWRPSISRVLFRPSFRKNLRLLCCPYKKTSRWAQSHCPSPSPISPPQSAILQSVPHALRQKHPITLWLFQYITDSELGHGAPLSITHPLLPDCDHLKQPPSSPISSTGSGSSSDAEDVWTCTCTSYYESEKQTYLCSAECGDLCDCVAQFGNFYSSTNPQTLKLDALPDNWPLVECSPSCLCGLSCSNRVTQQGVRTPLTIRPTPPKGYGLFYTPSTPQFLPRGAFISLYAGEYILPSEIRSRWSPRSTTDLASDKEGYGEEGQGNYVLSLRLPDQTIHIDPRWKGNVGRFLNHSCGANCVVHYVKWGRGRGWPRAAIFTNRDIHPEEELTFDYANASGEPQRAIQLIQESKTKEDTKGRTRCLCGAEQCRGWIPFDETL

SEQ ID NO: 17514 - protein, 636 aa, Cuscuta reflexa
MLQHVGNILHVTIGPPSLSIYKCLPFSLSLFSQHFKPNQTAMAGAPATTTKPWVHPNICIPSSKAMCSSFLSFSKELRLNCSVQASSSMLHFPNKPSPPITIPKEESSVSPSSSPHRQWNLFQRAAAVALDAVESRITERELERPLPKTVDPRVQIAGNFAPVPEQPVCHALPVAGRIPECVSGVYVRNGANPHFEPVAGHHFFDGDGLVHAVQFKNGAASYACRFTETQRLVQERALGRPFFPKAIGELHGHSGIARLLLFYSRGIFGLLDRSRGTGVANAGLVYFNNRLLAMSEDDLPYHVRVTPSGEKKTVERYDFDGKLKSTMIAHPKLDPVSGELFALSYDVIQKPYLKYFWFSKSGEKSQDIEIPVPEPTMMHDFAITERFVVVPDQQVVFKISEMVHGGSPVVYDKSKASRFGVLNKYAKDSSEMKWVEVPDCFCFHLWNAWEDAETDEIVVIGSCMTPPDSVFNECDEGLKSVLSEIRLNLKTGKSTRKAIIQNPSEDVNLEAGMVNRHKLGRKTRYAYLAVAEPWPKVSGFAKVDLFTGQVKKFMYGDEKYGGEPLFFPGDLDSEEEDEDGGYVLAFVHDERRWESELQIVNAQSLELEASVKFTIRVPYGFHGTFITSNDLLTQVM

SEQ ID NO: 17515 - protein, 220 aa, Hyacinthus orientalis
VSSGSPWYGPERVKYLGPFSGEAPSYLTGEFPGDYGWDTAGLSADPETFAKNRELEVIHCRWAMLGALGCVFPELLARNGVKFGEAVWFKAGAQIFSEGGLDYLGNPSLVHAQSILAIWATQVLLMGAVEGYRVAGGPLGEVVDPLYPGGSFDPLGLADDPEAFAELKVKEIKNGRLAMFSMFGFFVQAIVTGKGPLENLADHLADPVNNNAWAFATNFV

SEQ ID NO: 17516 - protein, 180 aa, Bacillus anthracis
MMNQDIEKVLISEEQIQEKVLELGAIIAEDYKNTVPLAIGVLKGAMPFMADLLKRTDTYLEMDFMAVSSYGHSTVSTGEVKILKDLDTSVEGRDILIVEDIIDSGLTLSYLVDLFKYRKAKSVKIVTLLDKPTGRKVDLKADYVGFTVPHEFVVGYGLDYKEQYRNLPYVGVLKPSVYSN

SEQ ID NO: 17517 - protein, 95 aa, Arabidopsis arenosa
LPPPQQQPTGIDGIDQKSVLLELALTAMDELVKLAHSEEPLWVKSLDGERDELNQDEYMRTFSSTKPTGLATEASRTSGMVIINSLALVETLMDS

SEQ ID NO: 17518 - protein, 346 aa, Xylella fastidiosa
MIDSKQKIAVLGAGSWGTALAALVARHAYPTILWGRDVGVIQSIDIQRQNFRYLPSIMLPQTLRATTDLAAAVSGADWVLVAVPSYAFTETLRRLAPLLSTGVGVAWATKGFEPGSGRFLHEVAREILGGDAPLAVVTGPSFAKEVTLGLPTAVTVHGEYARFTQMVANAMHGPMFRAYTGNDVIGAELGGAMKNVLAVAIGVADGMQLGMNARAGLITRGLNEMLRLSAVIGARPETLMGLAGLGDLVLTCTGDLSRNRRLGFALGRGQSLSDAIREIGQVVESVQTSDEVMRQAEQHGVELPISEAVRAVLREEITPYAGMKALLAREQKPEYLDILFKANSSL

SEQ ID NO: 17519 - protein, 112 aa, Methylobacillus flagellatus
MKFISAIIKPFKLDEVREALSAIGVQGITVTEVKGFGRQKGHTELYRGAEYVVDFLPKVKLEVAIEDSLLDQVIDAIEQSASTGKIGDGKIFVFDLEQAYRIRTGETGGDAL

SEQ ID NO: 17520 - protein, 307 aa, Bacillus anthracis
MRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSVERRNLLRAYGAELVLTPGPEGMGGAIRQATELAKEHGYFIPQQFKNQSNPEIHRLTTGPEIVEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 17521 - protein, 502 aa, Alkalilimnicola ehrlichei
MKVVDVFKFRSPEIKALHLTWIAFFITFYVWFNMAPLATSMLRSVDWLTQDDIRLFAICNVALTIPARIIVGMALDRFGPRRVFSILMILMALPALAFAFGNNMTQLLISRLVLSSVGASFVVGIHMTALWFRPRDIGFAEGFYAGWGNFGSAAAAMTLPTIALTLFGGEDGWRWAMAVSALVMAGYGVFYWFAITDGPHATSHKRTRNAMAMEVSSWGDMIKLIICTLPLVGVLALLVWRIEQMGYLSTTGATILYLVIGGIVLYQVVQIFRVNVPILKKGVPKDDKYHFNSVIALNSTYFANFGAELAVVSMLPMFFEQTWGLGAAAAGAIAASFAFVNLVARPMGGLVSDRMGNRRFVMLCYMFGIGIGFVLMGLLDSNWPLIVAIAITIFTSFFVQGSEGATFGIIPSIKRRITGQISGMAGAYGNVGAVVYLTIFTFVTPTQFFFIIATGAFLSWLICLLLLKEPEGAFAEDYHVSSVDRMIEEEDLKRERQKAWAR

SEQ ID NO: 17522 - protein, 522 aa, Triticum aestivum
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 17523 - protein, 463 aa, Unknown
  Rhodococcus sp. RHA1
MPPGGPMPKVLAAPPPQSTLQPISGNAGFPVIGHSLDYFRDPMGLLQSRWDRYGPVSWLSMAGKRWVTVLGPDGCQTVLQNKDRAFVNSDGWSVLIGPFFHRGLMLLDGDEHLAHRRIMQQAFTRDRLSRYTEALHPAVEKGLDGWQPTAGFAAYPALKELTLDLATSIFMGGAEGSTPREMAEINRAFIDCVQAATSVIRYPLLGTRWKRGIDGRARLEEFFRRYLPARRAGAGEDLFSALCHIESEEGQRFSDDDVVNHMIFLLMAAHDTSTITLSTMMQYLGQHPDWQERCRRQSAALGTSTPTYDQLDELTDLDLVMKECLRLVPPVPVVARRAVEDTEVLGHYIPRGTYMSVVVHFTHHMPEYWPDPERFDPERFAPERREDKVHRFAWEPFGGGVHKCLGMHFAGAEIKTVMHHLLRRFHWHVSPGYVAPLNYTSLPFPSDGQPVDLYHRVGGADTP

SEQ ID NO: 17524 - protein, 234 aa, Dunaliella salina
KAQEPWFGIEQEYTLLNSVTKWPLGWPKGGYPAGQGPYYCSVGAGRSIGRDIPEVHYRCCLHAGIQISGVNGEVLPSQWEYQVGPVEGIAMGDQMWMSRYLMYRVAELFNVEVTFDPKPIPGDWNGSGGHVNFSNRQPESPPAGKQSRSSAKKLGKRHRWHIAAYGEGNERRLTGKHETSSMNDFSWGVANRGCSIRVGRMVPVEKCGYYEDRRPSSNLDPYVVTRLLVETTLL

SEQ ID NO: 17525 - protein, 354 aa, Bradyrhizobium japonicum
MGVRPMTKPFPMNAWYAAAWDAEVKPALLPRTICGKHVVMYRKADGAVAALEDACWHRLVPLSKGRLEGDTVVCGYHGLKYNAQGRCTFMPSQETINPSACVRAYPVVERHRYIWLWMGDPALADPALVPDMHWNHDPAWAGDGKTIRVNCDYRLVLDNLMDLTHETFVHGSSIGNDAVAEAPFDVTHGEKTVTVTRWMRNIEPPPFWAKQLGKPGLVDRWQIIRFEAPCTIAIDVGVAPTGTGAPEGDRSQGVNGFVLNTITPETEKTCHYFWAFVRNYQIGEQRITTEIREGVSGIFHEDELILEAQQRAMDENPDRVFYNLNIDAGAMWTRKLIDKMVAKENAPQHLQAAE

SEQ ID NO: 17526 - protein, 396 aa, Saccharomyces cerevisiae
MKHSQKYRRYGIYEKTGNPFIKGLQRLLIACLFISGSLSIVVFQICLQVLLPWSKIRFQNGINQSKKAFIVLLCMILNMVAPSSLNVTFETSRPLKNSSNAKPCFRFKDRAIIIANHQMYADWIYLWWLSFVSNLGGNVYIILKKALQYIPLLGFGMRNFKFIFLSRNWQKDEKALTNSLVSMDLNARCKGPLTNYKSCYSKTNESIAAYNLIMFPEGTNLSLKTREKSEAFCQRAHLDHVQLRHLLLPHSKGLKFAVEKLAPSLDAIYDVTIGYSPALRTEYVGTKFTLKKIFLMGVYPEKVDFYIREFRVNEIPLQDDEVFFNWLLGVWKEKDQLLEDYYNTGQFKSNAKNDNQSIVVTTQTTGFQHETLTPRILSYYGFFAFLILVFVMKKNH

SEQ ID NO: 17527 - protein, 72 aa, Alkaliphilus metalliredigenes
MSKEDVIEVEGVIKEALPNATFQVELENGHVVLAHLSGKLRMHFIRILPGDKVTVELSPYDLTRGRITWRKK

SEQ ID NO: 17528 - protein, 237 aa, Oryza sativa
MAGRGGGGELRLLGTWSSPWVIRVRVALGMKGLSYEYTEEDLSSKSDHLLRSNPVHEKVPVLIHGGRPVCESLVVLEYIDETWGATGTPQLLPADPYDRATARFWTNYVNDTFFPSWKVLFRSTAAEQRAEAFKNVVPRVEALERAFGECSKGKAFFGGDDAGLVDVALGSHLVWIKVVDEVAGANLLDEAKFPGLAAWAERFLAVDAVRQVMPDAGDVLKQYKGFLAKWTAGAGSS

SEQ ID NO: 17529 - protein, 399 aa, Saccharomyces cerevisiae
MSFDREEDQKLKFKTSKKLKVSSTFESMNLKDDLLRGIYSYGFEAPSSIQSRAITQIISGKDVIAQAQSGTGKTATFTIGLLQAIDLRKKDLQALILSPTRELASQIGQVVKNLGDYMNVNAFAITGGKTLKDDLKKMQKHGCQAVSGTPGRVLDMIKKQMLQTRNVQMLVLDEADELLSETLGFKQQIYDIFAKLPKNCQVVVVSATMNKDILEVTRKFMNDPVKILVKRDEISLEGIKQYVVNVDKEEWKFDTLCDIYDSLTITQCVIFCNTKKKVDWLSQRLIQSNFAVVSMHGDMKQEERDKVMNDFRTGHSRVLISTDVWARGIDVQQVSLVINYDLPEIIENYIHRIGRSGRFGRKGVAINFITKADLAKLREIEKFYSIKINPMPANFAELS

SEQ ID NO: 17530 - protein, 447 aa, Triticum monococcum
MVLDLNVESPADSGTSSSSVLNSADAAGGGFRFGLLGSPDDDDCSGEPAPVGSGFVTRQLFPASPPGHAGAPGMMMGQQAPAPAPMAPVWQPRRAEELVVAQRVAPAKKTRRGPRSRSSQYRGVTFYRRTGRWESHIWDCGKQVYLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGREAVTNFESSSYNGDAPPDAENEAIVDADALDLDLRMSQPTAHDPKRDNIIAGLQLTFDSPESSTTMVSSQPMSSSSSQWPVHQHGTAVAPQQHQRLYPSACHGFYPNVQVQVQERPMEARPPEQPSSFPGWGWQAQAMPPGSSHSPLLYAAASSGFSTAAAGANLAPPPPYPDHHRFYFPRPPDN

SEQ ID NO: 17531 - protein, 76 aa, Escherichia coli
AEIEVGRVYTGKVTRIVDFGAFVAIGGGKEGLVHISQIADKRVEKVTDYLQMGQEVPVKVLEVDRQGRIRLSIKEA

SEQ ID NO: 17532 - protein, 240 aa, Cleistachne sorghoides
GITGIVNGMDVSEWDPSKDKYIAVKYDVSTAVEAKTLNKEALQAEVGLPVDRKVPLVAFIGRLEEQKGPDVMAAAIPLLMEEDVQIVLLGTGKKKFERMLMSAEEKYPDKVRAVVKFNAALAHHIMAGADLLAVTSRFEPCGLIQLQGMRYGTPCVCASTGGLVDTVIEGKTGFHMGRLSVDCNVVEPADVKKVATTVKRAIKVVGTPAYEEMVKNCMIQDLSWKGPAKNWENVLLSLGV

SEQ ID NO: 17533 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17534 - protein, 255 aa, Microstegium nudum
CELDNIMRLNGITGIVNGMDVSEWDPSKDKYIAVKYDVSTAVEAKALNKEALQAEVGLPVDRKIPLVAFIGRLEEQKGPDVMAAAIPQLMEEDVQIVLLGTGKKKFERMLMSAEEKYPDKVRAVVKFNAALAHHIMAGADLLAVTSRFEPCGLIQLQGMRYGTPCACASTGGLVNTIIEGKTGFHMGRLSVDCNVVEPADVKKVATTLKRAIKVVGTPAYEEMVKNCMIQDLSWKGPAKNWENALFSLGVAGGEP

SEQ ID NO: 17535 - protein, 599 aa, Solibacter usitatus
MSILRTFLSAALCLGVIPACAADLELIQNAARRDGISLNGPWHAIVDPYESGYLDYRYRPYADGGFGANKKPKTKSDLIEYDFDSSSTLNVPGDWNTQRPELLLYEGTIWYKRDFDCVKQPGHRIFLWFGAANYRAMVFLNGAKIGEHAGGFTPFQFEITDKVRDKGNVVIVKVDDQRKQEFIPTVMTDWWNYGGLTREVRIVDVPGTFVQDYSIQLEKGRQSQIGGWVRLNGADLRQKVTVRIPEAGITQTFTPDETGLARISFDATLNLWSPESPKLYDVTVEAGADHVTDRIGFRTIEAKGRDLLLNGKPIHLRGVSVHAEAPFRAGRVFSEADGRTLLNWAKEVNCNFVRLPHYPHDEVMTRLADEMGLLVWSEIPVYWTISWENPETLRNAEHQLTEMIARDKNRASVILWSVANETPRGDARLKFLTALVERARSLDSTRLITAALETHYADPRTIVVEDPLGQYLDVVSCNEYVGWYDGPPEKIDTITWQTAYEKPFVLSEFGADAQASRHGDEFTRFTEENQADVYRRQVAMFKRIPFLTGTIAWVLVDFRSPRRPLAGIQDFYNRKGLFSDRGERKQAFYILRDYYKSVK

SEQ ID NO: 17536 - protein, 433 aa, Pinus taeda
MRVEELGGILKPASDLEAAANAKEKLKEKHQLPKESNRMVKHGEGLRQYYLQHIHDLQLQVRQKTHNLNRLEAQRNDLNSKVRALREELQLLQEPGSYVGEVVKVMGKSKVLVKVHPEGKYVVDVDKNIDITKITPSTRVALRNDSYVLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEESRFDILKIHSRKMNLMRGIDLKKIAEKMSGASGAELKAVCTEAGMFALRERRVHVTQEDFEMAVAKVMKKETEKNMSLRKLWK

SEQ ID NO: 17537 - protein, 255 aa, Miscanthus japonicus
  misc_feature (148)..(148): Xaa can be any naturally occurring amino acid
  misc_feature (187)..(187): Xaa can be any naturally occurring amino acid
CELDNIMRLTGITGIVNGMDVSEWDPSKDKYIAVKYDVSTAVEAKALNKEALQAEVGLPVDRKIPLVAFIGRLEEQKGPDVMAAAIPQLMEEDVQIVLLGTGKKKFERMLMSAKEKYPDKVRAVVKFNAALAHHIMAGADLLAVTNRXEPCGLIQLQGMRYGTPCACASTGGLVDTIIEGKTGFHMXRLSVDCNVVEPADVKKVATTLKRAIKVVGTPAYEEMVKNCMIQDLSWKGPAKNWENVLLSLGVAGGEP

SEQ ID NO: 17538 - protein, 314 aa, Glycine max
  misc_feature (304)..(304): Xaa can be any naturally occurring amino acid
MWPFSRKGASGFSSSSTAEQVTEGIDGTGLTAIVTGASSGIGTETTRVLSLRGVHVIMGVRNMLAAKDVKETLLKEIPSAKVDAMELDLSSLESVKKFASEFKSSGLPLNMLINNAGIMACPFKLSKDKIELQFATNHLGHFLLTNLLLDTMKKTSRETKKEGRIVNVSSEAHRFTYSEGIRFDKINDESSYSNWRAYGQSKLANILHANELTRRLKEDGVDISANSLHPGVIATNLSRHISPVNGLTKAIARLVLKNVQQGAATTCYVALHPQVKGTSGKYFSASNVAKTTSQGTDADLAKKXLWDFSMDLTK

SEQ ID NO: 17539 - protein, 162 aa, Pseudomonas putida
MAASMLDIPCVTLGGEHKTLADYPGKVLLVVNTASQCGFTPQYKGLEQLWQTYRERGLVVLGFPCNQFGKQEPGDAREIAQFCERNFGVSFPLFRKIEVNGPGTHPLYVELKQRAPGLLGSQKIKWNFTKFLIDPASGQVTRYAPTTKPQALEADIERLLSR

SEQ ID NO: 17540 - protein, 95 aa, Arabidopsis suecica
LPPQQQQSTVINGIDQKSVLLELALTAMDELVKLAQSEEPLWVKSLDGERDELNQDEYMRTFSSTKPTGLATEASRTSGMVIINSLALVETLMDS

SEQ ID NO: 17541 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENVDIANLLLAPYFKKIADEYQQALRDVVAYAVQNGIPVPTFSAAVAYYDSYRAAVLPANLIQAQRDYFGAHTYKRT

SEQ ID NO: 17542 - protein, 309 aa, Arabidopsis thaliana
MGKASRDKRDIYYRKAKEEGWRARSAFKLLQIDEEFNIFEGVKRVVDLCAAPGSWSQVLSRQLYLPAKSSAESKDGDLPLIVAIDLQPMAPIEGVIQVQGDITNARTAEVVIRHFDGCKADLVVCDGAPDVTGLHDMDEFVQSQLILAGLTIVTHILKEGGKFIAKIFRGKDTSLLYCQLKLFFPTVTFAKPKSSRNSSIEAFAVCENYSPPEGFNPRDLHRLLEKVGSPSGGSDLDCSSGWLEGPNKVYIPFLACGDLTGYDSDRSYPLPREADGSSYQSLDPIQPPIAPPYKRALELKKASAQSFNS

SEQ ID NO: 17543 - protein, 445 aa, Salmonella enterica
AVMGRNLALNIESRGYTVSVFNRSREKTEEVIAENPGKELVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYSENAGIANLLLAPYFKKIADEYQQALRDVVAYAVQNGIPVPTFSAAVAYYDSYRAAVLPANLIQAQRDYFGAHTYKRT

SEQ ID NO: 17544 - protein, 324 aa, Triticum aestivum
RAEFGTSFHTLCMALSVSLFFFLFAIPIFWPLLVPYMLYCMYSTSSTSGDLSHRSPFLRSLSVWDLFATYFPARLHRSQNLIATRKYIFGYHPHGIISMGAFAAFCTESLGFATLFPGIENTLLTLDSNFRIPIYRDYALAMGLASVSKESCENLLSKGGINNEGMGRAITIVIGGARESLNAQPGTLRLVLKRRKGFVKMAFRTGADLVPVLGFGENDLYDQVQPDEYPNIYRLQLLVKKLLGFTIPLFHARGIFNYDMGLMPYRRPMNIVVGRPILVEQNHDPGQEQIDHVHEQYVQELERIWNMWKNEYAPYRKEELVFVR

SEQ ID NO: 17545 - protein, 604 aa, Hordeum bulbosum
MAALVTSQLATSGTVLGITDRFRRPGFQGLRPRNPADAALGMRTIGASAAPKQSRKVHRGSRRCLSVVVRATGSSGMNLVFVGAEMAPWSKTGGLGDVLGGLPPAMAANGHRVMVVSPRYDQYKDAWDTSVVSEIKVADGYERVRFFHCYKRGVDRVFIDHPWFLEKVRGKTKEKIYGPDAGTDYEDNQQRFSLLCQAALEAPRILNLNNNPYFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLTVNYDITTALEAKALNKEALQAEVGLPVDRKVPLVAFIGRLEEQKGPDLMIAAIPEIVKEEDVQIILLGTGKKKFEKLLKSMEEKFPGKVRAVVRFNAPLAHQMMAGADLLAVTSRFEPCGLIQLQGMRYGTPCVCASTGGLVDTIVEGKTGFHMGRLSVDCNVVEPADVKKVATTLKRAVKVVRTPAYQEMVKNCMIQDLSWKGPAKNWEDVLLELGVEGSEPGIVGEEIAPLAMENVAAP

SEQ ID NO: 17546 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDENGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17547 - protein, 603 aa, Hordeum bogdanii
MAALVTSQLATSGTVLGITDRFRRPGFQGLRPRNPADAALSMRTIGASAAPKQSRKAHRGSRRCLSMVMRATGSGMNLVFVGAEMAPWSKTGGLGDVLGGLPPAMAANGHRVMVVSPRYDQYNDAWDTSVVSEIKVADECETVRFFHCYKRGVDRVFIDHPWFLEKVRGKTKEKIYGPDAGTDYEDNQQRFSLLCQAALEAPRILDLNNNPYFSGPYGEDVVFVCNDWHTGPLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDISEWDPTKDNFLAVNYDITTALEGKALNKEALQAEVGLPVDRKVPLVAFIGRLEEQKGPDVMIAAIPEIVKEEDVQIILLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVVTTLKRAVKVVGTPEYQEMVKNCMIQDLSWKGPAKNWEDVLLELGVEGSEPGIVGDEIAPLAMENVAAP

SEQ ID NO: 17548 - protein, 263 aa, Triticum aestivum
HYRTSLYKKAGWYRSGIPGISSTHASGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSFLLIEPLLQSAR

SEQ ID NO: 17549 - protein, 242 aa, Prochlorococcus marinus
MFKFLKNIMNNEESNLTNDPYSLHRVLKTDIKKDPNEKEDEIIFGCGCFWGAEKCFWKLPGVITTSVGYAGGEKINPTYYEVCSGLTGHSEVVRVIWDKREIDVSDLLKMFWECHDPTQKNRQGNDMGTQYRSAIYYKNENNINTILASKEQYQTELSKKNLGLIETEIKMIDSYFYAEQYHQQYLASAGSRQYCSASPTKVKLGVFTGSDYKLEDHIWENFNWEVEKCVLRSDNNPIKNNI

SEQ ID NO: 17550 - protein, 487 aa, Ostreococcus tauri
MPRATPRIGFDVIARASGCVDARRARRARAWRPRASAGGGDDDAARADDGDDVADVVRTARAGVGGIEWATTSTREDARDGATTAARVCIVGCGPGDPGLLTLRAFQLMRRADVVLYDRLVSNEILNLVRTEARMVYVGKRAGFHTRTQEEIHALLSAFAERGALILRLKGGDPLVFGRGGEEFEFLREKNPDVRVEVVPGITAASGVGSELGIPLTHRGVATSVRLLTGHLREGARERGEDPVDFAVTSADADTTLVVYMGLGTLPRLSEKLIESGFPRDAPAVAVERGTTVDERRVFSSIEHLPEAARECELVSPTLIIIGKTCVLSPHWPYAAGVRVGVDGVPRWIASSGSVRAPEDLNDWRAWLDVDLTCTRHESPAKTPTLLTRPRAMAEDDAAVREPLDLIRLALDERVYVKLRGDREARGRLHAYDQHLNMILGEVEETITSTETDEETFEEFTKTTKRRVPYLFIRGDAVTLVSPPLRN

SEQ ID NO: 17551 - protein, 390 aa, Xylella fastidiosa
KVGALPIIGAPSLTASLQRWAETGRITWRQGTFENSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLAGPLQRLLRKQRHAEAEAVLEAALAKTPPTESGSVTLVGAGAGDAGLLTLNALRALNEADIILYDRLVSDTVLQMARRDAEQIEVGKSATGHSVRQEDIHTLMLQHARAGQRVVRLKGGDPFVFGRGGEELEFLRTHGIPYEVIPGITAALACAAYAGIPLTHRDHAQSLCLITAHCQSSLDTLNRAALAQERQTLAFYMGVAGLPTIQQRLCEAGRTETTPFALIENGARAQQRVLT

SEQ ID NO: 17552 - protein, 1645 aa, Unknown
  Nostoc sp. PCC 7120
MLIDYQRTKVLLIDNSLENWHCLSGFLAETKYLLQRVGTAKISISSVSELMPDIILIDSSIDKIDGHYFCQNLKAEETLQNISILLLTYIDQLSEYSSYFQIGVSDFISKPLCQEELFLRMRNQLKISSQQKNQLEEYHEPFPIGNGLISLNNAVNHNVISNKKECCFQLSDLNNEESINQSLNSQSLVSSNNKITRSKNNTQEYQINAVKLYKHNLVLTKLAKNQVLYQGNLKTALAEITNVAAHNLGIERASIWLYDETLTKIQCADLFEYSRNQHSAGLSLSAKEYPTYFQALHQDEAIAVDDAYTDPRTKEFAQSYLTPLNITAMLDTPIRLAGKTVGVLCLEAVKLPHHWTPEDQNFARSLTNLVSLALEARERQRAEAAHRISEQKLASAFRASPDPIALCTYPETRYIEVNDSFCRLFGYSRSQVIGNTDKELNIWVNLEECHFLSQILEKAKAIRNHEVDFRTSNGEIKTTLFSAEMIEIDGQKYILGTAKDITERKQAEAESRLLLLTTQAIARAVDVKSALTLVLRVICQTIGWDFGEAWTPNRESHVLEHSLVCYCEEASLEEFCHQSQNLRIAPGEGLPGRVWQTKQSEWIEDVSLVKQGQFLRSPQAAKVGLKAGFGIPIIAGKEVLAVLIFFKRSSIPVDKRLLMLLGAVATQLGSLIERKLIESAHRNSEERLQLALEASDLGLWDWNITTGKIYRDWQWQKMLGYTQEDIEDDERVIEQLLHPEDLATVKSAITAHLQGVTPVYEMEFRMRCAAGGWKWVQSRGQIVERNEQGQPLRMTGTTKDITERKILEKELELREARLNAFFSGAPVGMSILDNQLRFVQINELIAHIHGKPAQEHIGKTLEEIAPRIAPLVTPLCQKVLLTGQPILNVELSLPAVNQADSLRHFLVSYFPIPGEGNQLSGVGKVIVEISDVYDELRLRKRAEEALKESIERERAIAQVIQRMRQTLDLDTIFAATTEELRQVLNCDRAVVYRFDSQGSGEFVAESWGKGWISLIEKQKNVPHLTENTAKDQSCLAKLLEYTPQATPDKNFLCVADIYQAGFGSCYIEFLERLQAKAYIIVPILSGDQVWGLLATYQNSGPRQWKTGEINIVIQIGNQLEVALQQAQLLTQTQRQSQALEAAAIAADAANRAKSEFLANMSHELRTPLNAILGFTQIMSHDKTLSKDNQQNLTIINRAGEHLLDLINDVLEMSKIEAGRTTLNINSFDLIHLLDNLQEMMQGRATAKGLHLKFEYAPNIAQHIQADESKLRQVLLNILGNAIKFTETGSIILRVKMGTGDWGLGTEEDTKTHLSIPNTQSPITNPQSLIFEIQDTGIGICDDEVCVLFEAFGQTEAGRKSQQGTGLGLAISRKYVQLMGGDISVSSAVGVGSTFSFQIQVGLVSAHEIPYQPTTRSVIGLAPQQRECRILVVDDVADSRLLLVKLLSSVGFVVQEAANGQEALAIWQQWHPQLILMDMRMPIMDGYEATHFIRSAEIENHTTIPNPHTIIIALTAHAFEEQRQAMLQVGCDDLINKPFSEKEILEKLNKYLGIKYLYQEDSSQTLKARTKIFTHDNLLPLLSTLPRDWLINLYNAAAQCSDDLILKLVGEISAENTALKEYFVDLAHNFQFEKIMEIVSTIKDIS

SEQ ID NO: 17553 - protein, 336 aa, Hyphomonas neptunium
MTQHFKTFGVIGAGAWGTAIAQMLAREGQTVHLWALEPEVAAAINTARENTAFLKGVPLKPEIRATNKLEDLGLADAIFAVAPAQHTRTTLRALRASLRPGTPVVLCSKGIELATGEFMTQVLKDELPEAIPAVMSGPSFAIDVAKGLPTAVTLAIEDTRLGTELIQAISTPTFRPYLGTDLLGAEVGGSVKNVLAIACGIALGKGLGRSAHAALIARGYAEMTRLALTLGAEAETLTGLSGLGDLVLTCSSETSRNMSLGLALGKGETLASILAARNAVTEGVATAPVLRRLARSQGIEMPICEAVAAVIEGEITVDDAITALLMRPVKAEAVKP

SEQ ID NO: 17554 - protein, 390 aa, Xylella fastidiosa
KVGALPIIGAPSLTASLQRWAETGRITWRQGTFENSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLAGPLQRLLRKQRHAEAEAVLEAALAKTPPTESGSVTLVGAGAGDAGLLTLNALRALNEADIILYDRLVSDTVLQMARRDAEQIEVGKSATGHSVRQEDIHTLMLQHARAGQRVVRLKGGDPFVFGRGGEELEFLRTHGIPYEVIPGITAALACAAYAGIPLTHRDHAQSLCLITAHCQSSLDTLNWAALAQERQTLAFYMGVAGLPTIQQRLCEAGRTETTPFALIENGARAQQRVLT

SEQ ID NO: 17555 - protein, 511 aa, Glycine max
MAQPSTGIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGLGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQHVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQSKKLDYCISANQDFPNKCNIFCSDCMLS

SEQ ID NO: 17556 - protein, 174 aa, Hyphomonas neptunium
MPKIDVILSEADLMARVDELAARLAPRLQSDDWTAVSILIGATPFTSDLMKALARRHIHPVLDVMWLESYRDARESSGRVVVRADIARSVEGRGILLVDDVFDTGRTLDFAKHHLLAKGAREVITVALTQKPWAPRGENGVDFCAFDAPGRFLVGYGMDDKGRYRGLPYIGALD

SEQ ID NO: 17557 - protein, 265 aa, Panax ginseng
MATSAIQRSAFAGQTALKPQNELVRKIGSLGGGRITMRRTVRSAPESIWYGPDRPKYLGPFSEQTPSYLTGEFPGDYGWDTAGLSADPETFAKNRELEVIHSRWAMLGALGCVFPEILARNGVKFGEAVWFKAGAQIFSEGGLDYLGNPNLVHAQSILAIWASQVVLMGFVEGYRVGGGPLGEGLDKIYPGGSFDPLGLADDPEAFAELKVKELKNGRLAMFSMFGFFVQAIVTGKGPIENLYDHLADPVANNAWAYATNFVPGK

SEQ ID NO: 17558 - protein, 261 aa, Streptococcus mutans
MAVISMKQLLEAGVHFGHQTRRWNPKMAKYIFTERNGIHVIDLQQTVKLADQAYDFVRDAAANDAVILFVGTKKQASEAIKEEAERAGQYYINHRWLGGTLTNWDTIQKRIARLKEIKQMEVDGIFDVLPKKEVALLNKQRARLEKFLGGIEDMPRIPDIIYIVDPHKEQIAVKEAKKLGIPVVAMVDTNADPDDIDVIIPANDDAIRAVKLITSKLADAVIEGRQGEDSVEAVEAELAAGETQADSIEEIVEVVEGANEN

SEQ ID NO: 17559 - protein, 449 aa, Geobacillus stearothermophilus
MTHIRFDYSKALSFFGEHELTYLRDAVKVAHHSLHEKTGVGNDFLGWLDLPVNYDKEEFARIQKAAAKIQADSDVLLVIGIGGSYLGARAAIEMLHHSFYNALPKEKRNTPQIIFVGNNISSTYMKEVMDLLEGKDFSINVISKSGTTTEPAIAFRIFRKLLEEKYGKEEARKRIYATTDRARGALKTLATAEGYETFIIPDDVGGRYSVLTAVGLLPIAVSGANIEEMMKGAAQAREDFSSSELEENAAYQYAAIRNILYNKGKTIELLINYEPALQYFAEWWKQLFGESEGKDQKGIFPASANFSTDLHSLGQYIQEGRRDLFETVLKVEKPRHDLVIEAEENDLDGLNYLAGKTVDFVNTKAFEGTLLAHTDGGVPNLVITLPELNEYTFGYLVYFFEKACAMSGYLLGVNPFDQPGVEAYKVNMFALLGKPGYEEKKAELEKRLK

SEQ ID NO: 17560 - protein, 356 aa, Nicotiana plumbaginifolia
MSLLSDLINLNLSDSTEKIIAEYIWIGGSGMDLRSKARTLSGPVTDPAKLPKWNYDGSSTGQAPGEDSEVILYPQAIFKDPFRRGNNILVMCDAYTPAGEPIPTNKRHAAAKIFSNPDVVAEEPWYGIEQEYTLLQRDINWPLGWPIGGFPGPQGPYYCGTGADKAFGRDIVDSHYKAYLYAGINISGINGEVMPGQWEFQVGPSVGISAGDEVWVARYILERIAEIAGVVVSFDPKPIPGDWNGAGAHTNYSTKSMREDGGYEVILKAIEKLGLKHKEHIAAYGEGNERRLTGKHETANISTFKWGVANRGASVRVGRDTEKAGKGYFEDRRPASNMDPYVVTAMIADTTIIGKS

SEQ ID NO: 17561 - protein, 2155 aa, Sclerotinia sclerotiorum
MTRKDGSYRNSSATSSSTGSWKSTDTIKGPGSSYFQGSSTKRGAPMQVKTDRTSRVENDAQVSPTSAGPRNTISPSSSISPNVSPREQRMAADFGNYRRDLAVLETSGGRIPQIHHNPPTAIASTNPITPWMSTGSSATGSPNGFTSFYNDSSDALSQASQLSPIARPGTAVTGHTNTSESPADAFFGDGDERRPSVASITTASSTGSKSSLGRAVGGLHKKLTSFFGEDLPSSSETSLPSQGKEVRSHSFARSHRDRNHSSATDHGHYRDASPAGGSRPRTPVPSSEVVPFLYQNSQDITLYGEAPVRENLSGPDRERYINDSSDKPPKTSSSAKSHHLPGHHLRNRSNDDTRSLRPTVSREESAFSMRFKDRNNNPMGTAAANASNPNLQRPKSPTPSGMSTWSQTTKGGNSDGPSSPRDNNNGTKRSLLNLTGRFKRHKDKDHTPSRLKETPAASRAPINGSSKQDAGKIYESPDLAKYSQDGSITGSELNLPSQSTNGNARPPGGRQGTFPKLPFRKGRGNKGAEDSDQLYDTSDRSGDNVHHLDTNLSNMEGILTKPPPLTPLDNSIFNGEEDEGKEETESLGGLGWNAPDSWAVKKIDDDNMSRLPEIDEAGIPQKAEEKANPYCIRIFKADGTFATLSTSLNTTVTELLAQLNKKTYQADSLDNYQIVMKKHDLQRILAPGERPLVIQRRLLEQAGYQPEDRIEDVGREDNSYLCRFSFLPARQGGYASVSNDNGLGRVQKFSHVDLSGKNLITIPIALYSKTSEMISLNLSRNLSLDLPKDFISSCVNLREIKFLSNEAWKLPASLSRANRLTILDVSNNRLEQLEHAELSRLQGLISLKLANNRLKSLPSYFGMYRSMRTLNLSSNFLEEFPEFLCNMTALIDIDMSFNGISNLPNEIGKLKHLERFVITNNRLKGSLPNTFGELVNLKEVDVRYNMLSSIDIIATLPKVEQISADHNSVSVCECEFAKIRILRLNSNPVTKFEIKNLVPTLTTLNLSNAKLAQIPDAAFDKMPNLNKLVLDINHFVSLPAQIGKLRKLEYFSIARNALSSLPAELGCLTELRYLDIRQNNLKKLPMEIWWANKLEFLNVSSNVLDNFPKPGSRPPQPPGDVGSTNSNNTGANSQNSSFEELGPLDFAHRRPSQASSGLLSVGSSPVPDARKGSVVSVYGKGGRKTSVVSRSTSASTINHQTPTNIRKDSGLSAKLINTFAGSLKILHLADNGLDDDVFDEITLLSELRVLNLSYNDLNDMPSRSIKSWPQLVELYLSGNELTSLPSDDFEEFSLLQVLHINGNKFQTLPAELGKAHRLQVLDCGSNSLKYNVSNWPYDWNWNWNTNLKYLNLSGNKRLEIKPSLPGSAAARDGRDLTDFSALQNLRILGLMDVTLTIPSIPDQTEDRRVRTSGSLAGQLAYGMADSLGKNEHLSIIDMVVPRFNSTETETLLGMFDGQALSSGGSKIAKYLHENFGHIFSEELKRLNALNNETPKDALRRAFLSLNKDLATAATQNTEERSLLSHRGSATPAVLSQADLISGGVATVMFLQQSELYVANVGDAQAMLIHEKDGHRILTRKHDPAEPNERQRIRDAGGWVSRQGKLNDVLEVSRAFGYVQLMPAVQAAPNVEHITIKEQDEMVLIASRELWEYLSPELVVDIARYEKHDLMRAAQRLRDLAIAFGASGKIMVMMMGVSDLKKRAQIRPHRVQSLSFNPNMMMEDGYVPSKRPKKKTDDVDDSMLRRLQAEVQAPVGDIGIVFTDIKSSTALWETYPSAMRSAIKLHNEVMRRQLRIIGGYEVKTEGDAFMVSFPTATSALLWCFAVQSALLEVNWPAEVITSNMGHEVYDSNKNLIFKGLSVRMGAHWGRPVCENDPVTRRMDYFGPMVNRTARISAVADGGQITVSADFISEIQRCLETYSESDRSGSTGSEDAFDSDFISHSIRRELRSLSSQGFEVKDIGERKLKGLENPEYIYLMYPHALAGRIQFQRSLESGEAAVVEEEPATLARDSELSIDTENVWDIWRLSLRLEMLCSTLEEPRGSALQPPETAMLEKMRNRGGEVSDRFLLSFLTHQVSRIETCTAALATRHLVIGQSLISDLDQLRAPMAGIIEGLAADLQELQKYRAMYGPLEPLEPLEPSVYEYEDEDESEDL

SEQ ID NO: 17562 - protein, 445 aa, Geobacillus stearothermophilus
MAISFDYSNALPFMQENELDYLSEFVKAAHHMLHERKGPGSDFLGWVDWPIRYDKNEFSRIKQAAERIRNHSDALVVIGIGGSYLGARAAIEALSHTFHNQMNDTTQIYFAGQNISSTYISHLLDVLEGKDLSINVISKSGTTTEPAIAFRIFRDYMEKKYGKEEARKRIYVTTDRTKGALKKLADQEGYETFVIPDNIGGRYSVLTAVGLLPIAVAGLNIDRMMEGAASAYHKYNNPDLLTNESYQYAAVRNILYRKGKAIELLVNYEPSLHYVSEWWKQLFGESEGKDQKGLFPASVDFTTDLHSMGQYVQEGRRNLIETVLHVKKPQIELTIQEDPENIDGLNFLAGKTLDEVNKKAFQGTLLAHVDGGVPNLIVELDEMNEYTFGEMVYFFEKACGISGHLLGVNPFDQPGVEAYKKNMFALLGKPGFEDEKAALMKRLSK

SEQ ID NO: 17563 - protein, 183 aa, Panax ginseng
MASSVISSATVAAVSRAVPAQASMVAPFTGLKSTAAFPVTRKVNDITSLPSNGGRVQCMKVWPPLGLKKFETLSYLPQLTQEQLSKEVDYLLRSGWVPCLEFELEHGFVYREHHHSPGYYDGRYWTMWKLPMFGCTDSSQVLKEVEECKKEYPNAYIRIIGFDNVRQVQCISFIAFKPPSAST

SEQ ID NO: 17564 - protein, 272 aa, Staphylococcus aureus
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLVSLIVVPFIIYKIYPPTVKETPNAKSWAENELATMGKIALAENL

SEQ ID NO: 17565 - protein, 542 aa, Streptococcus mutans
MTLDKRKVVYQIYPKSYKDTSGNGVGDLQGIIEKLPYLEELGIDVIWLNPFYPSPQRDNGYDVSDYTAVNPLFGSMADFEELVRKGKEHGIEIMLDMVLNHCSIEHEWFQKALAGDKYYQDFFILRDRPTDWVSKFGGNAWAPFGETGKYYLHLYDVTQADLNWRNPHVREELFKVVNFWRNRGVKGFRFDVINVIGKDEVLKDNPHFDGKPEYTDRPINHDYLKMLNKASFGQDENGMTVGEMSFTDIPNCIQYSNPDNHELDMVFNFHHLKVDYENGQKWTRKTFDFEELKHLFHTWGEGMSQGNGWSALFWNNHDQPRALNRFVDIKQFRNEGATMLAASIHLSRGTPYIYMGEEIGMIDPDYGSMADYVDVESLNAYQELIDKGKSSEEAFHIIRAKSRDNARTPMQWDTSENAGFSTGRPWLKVGKSYPQINVANEKQGKIFPFYQKLIRLRKEMPLIAQGSYQAALTDSDKIYAFEREYEGQKLLVLNNFFAETVELDLPSLYQAGTVLISNYDDVILDKRISLKPYQTVAILAEV

SEQ ID NO: 17566 - protein, 200 aa, Staphylococcus aureus
MIGIFVIALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 17567 - protein, 138 aa, Bacillus licheniformis
MAKEKDAEQKSALNIIPLAVTILVGAVIWFIPSPAGLDPKAWHLFAIFVATIIGFISKPLPMGAIAVFALAITALTGTLSIEETLSGFGNKTIWLIVIAFFISRGFIKTGLGARIAYLFVRMFGKKHSDSRIHSLSAI

SEQ ID NO: 17568 - protein, 293 aa, Bacillus licheniformis
MGFQGNLITSAMFLTAMAANPLIAKLAHDVAGVNLTWTSWAVAAIVPGLVSLIITPLVIYKLYPPEVKKTPDAAKIATEKLKEMGPFKKSELSMVAVFLLVLFLWIFGGNLNIDATTTALIGLAVLLLTQVLTWDDIKKEQGAWDTLTWFAALVMLASFLNELGMVGWFSDAMKSYVSGFSWISAFLILIAVYYYSHYFFASATAHISAMYSAFLAVIIAAGAPPLLAALSLAFFSNLFASTTHYGAGAAPVFFGAGYIPQSKWWSIGFILSIVHIVTWLVVGGLWWKLLGIW

SEQ ID NO: 17569 - protein, 211 aa, Saccharum officinarum
  misc_feature (97)..(97): Xaa can be any naturally occurring amino acid
  misc_feature (137)..(137): Xaa can be any naturally occurring amino acid
KALNKEALQAEVGLPVDRKIPLVAFIGRLEEQKGPDVMAAAIPQLMEEDVQIVLLGIGKKKFERMLMSAEEKFPDKVRAVVKFNAALAHHIMAGADXLAVTSRFEPCGLIQLQGMRYGTPCACASTGGLVYTIIERXTGFHLGRLSVDCNVVEPADVKKVATTVKRAIKVVGTPAYEEMVKNCMIQDLSWKGPAKSWENVLLSLGVAGGEP

SEQ ID NO: 17570 - protein, 280 aa, Nostoc punctiforme
MLNSQSPLRNVALFLINETCMIAITYFHARVNKSCSMYKPFLEFLEKELFQRFDLQSRVIPPGLEFKVSDRGRNPATIRSWCYQSQELRKIRYTYIDAGESAQIFNSVVYPSHNYDLPLLGIDFLSFGKVKNLIVLDFQPLFQDEDYQNKYIAPLKYLHNKYPDLAQNLEMKFYDANQYFSKYLLFAKTDAETVSTRVFEAFQDYLNLYWQMLADAQALHDPEDIQRIVKAQKDYDQYSADRDPASGLFSSYFGHEWAERFLHEFLFEDAVPLAVSASKR

SEQ ID NO: 17571 - protein, 161 aa, Unknown
  Helicosporidium sp. ex Simulium jonesii
ANPEVHYQTTGPEIWRDTEGRVDIFVAGVGTGGTITGTGRYLKEQNPDVQVVAVEPLESPVISGGEPAPHMIQGIGAGFIPKNLDMSIVDSVLTVGSAEAMVAARRLASEEGLLVGVSSGAALVAVDRLARRPENEGKLIVTVLPSMGERYLSSALFQDLR

SEQ ID NO: 17572 - protein, 550 aa, Escherichia coli
MFCVQCEQTIRTPAGNGCSYAQGMCGKTAETSDLQDLLIATLQGLSAWAVKAREYGIINHDVDSFAPRAFFSTLTNVNFDSPRIVGYAREAIALREALKAQCLAVDANARVDNPMADLQLVSDDLGELQRQAAEFTPNKDKAAIGENILGLRLLCLYGLKGAAAYMEHAHVLGQYDNDIYAQYHKIMAWLGTWPADMNALLECSMEIGQMNFKVMSILDAGETGKYGHPTPTQVNVKATAGKCILISGHDLKDLYNLLEQTEGTGVNVYTHGEMLPAHGYPELRKFKHLVGNYGSGWQNQQVEFARFPGPIVMTSNCIIDPTVGAYDDRIWTRSIVGWPGVRHLDGEDFSAVIAQAQQMAGFPYSEIPHLITVGFGRQTLLGAADTLIDLVSREKLRHIFLLGGCDGARGERHYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFLTPDLLAVLNEKFGLRSITTVEEDMKQLLSA

SEQ ID NO: 17573 - protein, 338 aa, Streptococcus agalactiae
MTKQKIAVLGPGSWGTALAQVLNDNGHEVRLWGNVVEQIEEINTSHTNQRYFKDITLDSKIKAYTNLEEAINNVDSILFVVPTKVTRLVAKQVANLLKHKVVIMHASKGLEPGTHERLSTILEEEISEQYRSDIVVVSGPSHAEEAIVRDITLITAASKDIGAAKYVQKLFSNHYFRLYTNTDVVGVETAGALKNIIAVGAGALHGLGYGDNAKAAIITRGLAEITRLGVQLGADPLTFSGLSGVGDLIVTGTSVHSRNWRAGDALGRGEKLEDIEKNMGMVIEGISTTKVAYEIAQNLNVYMPITEAIYKSIYEGANIKDSILDMMSNEFRSENEWH

SEQ ID NO: 17574 - protein, 471 aa, Pasteurella multocida
MRFYMTKVASIVDVLQGKIAIGETVTVRGWIRTRRDSKAGLSFLAIYDGSCFDPIQAIVNNDIENYETEVLRLTTGCSVIVTGTVVESPAEGQAVELQAEKVEVAGWVEDPETYPMAAKRHSIEYLREVAHLRPRTNIIGAVARVRHCLAQAIHRFFHEQGFYWVATPLITASDTEGAGEMFRVSTLDLENLPRDDKGAVDFSQDFFGKESFLTVSGQLNGETYACALSKIYTFGPTFRAENSNTTRHLAEFWMVEPEIAFATLADNAKLAEDMLKYVFRAVLEERKDDLKFFEKHVDNDVISRLENFINSDFAQIDYTDAIEVLLQSGKKFEFPVSWGIDLSSEHERYLAEEHFKSPVVVKNYPKDIKAFYMRLNDDGKTVAAMDVLAPGIGEIIGGSQREERLDVLDKRMIEMGLNPEDYWWYRDLRRYGTVPHAGFGLGFERLIVYVTGVQNIRDVIPFPRSPRNANF

SEQ ID NO: 17575 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRT

SEQ ID NO: 17576 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRT

SEQ ID NO: 17577 - protein, 519 aa, Oryza sativa
MVEVGRLLYLLGRWLPLDQFDFAAVPGLPIIGNLHQLKEKKPHQTFAKWAEIYGPIYTIRTGASSVVVLNSTEVAKEAMVAKFSSISTRKLSKALTVLTRDKSMVATSDYCDFHKMVKRYVMSSMLGTSAQKQFRDIRDMMIHNMLSTFHKLVKDDPHAPLIFRDVFKDELFRLSMIQSLGEDVSSVYVDEFGRDISKEEIYNATVTDMMMCAIEVDWRDFFPYLSWVPNKSFETRVFTTETRRTAVMRALIKQQKERIVRGEAKTCYLDFLLAENTLTDEQLMMLVWEALIEAADTTLVTTEWAMYELAKNPDKQARNIVTLFQLIVGILGIINQSFLFLAFFLLSCQERLYQEIREVCGDETVTEEHLPRLPYLNAVFHETLRRHSPVPLIPPRFVHEDTKLAGYDVPAGTEMVINLYGCNMNRKEWESPEEWVPERFAGGRLEVADMYKTMAFGAGRRACAGSLQATHIACAAVARFVQEFGWRLREGDEEKVDTVQLTAYKLHPLHVHLTRRGRM

SEQ ID NO: 17578 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKAQRVAASKLLSGPKAQPAGNKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17579 - protein, 776 aa, Pseudomonas amyloderamosa
MKCPKILAALLGCAVLAGVPAMPAHAAINSMSLGASYDAQQANITFRVYSSQATRIVLYLYSAGYGVQESATYTLSPAGSGVWAVTVPVSSIKAAGITGAVYYGYRAWGPNWPYASNWGKGSQAGFVSDVDANGDRFNPNKLLLDPYAQEVSQDPLNPSNQNGNVFASGASYRTTDSGIYAPKGVVLVPSTQSTGTKPTRAQKDDVIYEVHVRGFTEQDTSIPAQYRGTYYGAGLKASYLASLGVTAVEFLPVQETQNDANDVVPNSDANQNYWGYMTENYFSPDRRYAYNKAAGGPTAEFQAMVQAFHNAGIKVYMDVVYNHTAEGGTWTSSDPTTATIYSWRGLDNATYYELTSGNQYFYDNTGIGANFNTYNTVAQNLIVDSLAYWANTMGVDGFRFDLASVLGNSCLNGAYTASAPNCPNGGYNFDAADSNVAINRILREFTVRPAAGGSGLDLFAEPWAIGGNSYQLGGFPQGWSEWNGLFRDSLRQAQNELGSMTIYVTQDANDFSGSSNLFQSSGRSPWNSINFIDVHDGMTLKDVYSCNGANNSQAWPYGPSDGGTSTNYSWDQGMSAGTGAAVDQRRAARTGMAFEMLSAGTPLMQGGDEYLRTLQCNNNAYNLDSSANWLTYSWTTDQSNFYTFAQRLIAFRKAHPALRPSSWYSGSQLTWYQPSGAVADSNYWNNTSNYAIAYAINGPSLGDSNSIYVAYNGWSSSVTFTLPAPPSGTQWYRVTDTCDWNDGASTFVAPGSETLIGGAGTTYGQCGQSLLLLISK

SEQ ID NO: 17580 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFLDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTKWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYLWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17581 - protein, 445 aa, Salmonella enterica
AVMGRNLALNIESRGYTVSIFNRSREKTEEVIAGNPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRT

SEQ ID NO: 17582 - protein, 480 aa, Coffea arabica
MSRIKLLFSLLVLVFVGISNDVVGVEGLGVNWGTQATHKLPPKVVVQMLKDNGITKVKLFDADASTMSALAGSNIEVMVAIPNDQLLVMNDYDRAKNWVKRNVTVYLFNGGVNIKYVAVGNEPFLASYNNSFVNTTFPALQNIQNALNDAGHGDTIKATVPLNADVYFSPEGNPVPSAGRFRADISSQMTQIVQFLNQNNAPFTVNIYPFLSLYLNSHFPVDYAFFDGAANPIVDDGVQYTNVFDANFDALVSALKGLGYGSMNILVGEVGWPTDGDRNANVNYAIRFYRGLLPRLAANKGTPLRPGYIEVYLFGLLDEDLKSVAPGNFERHWGIFRYDGQPKFPMDLSGQLQDKYLVGAQNVQYFPAKWCQFNPNAKDLSKLVENINYACTFADCTALGYGSSCNGLDANGNASYAFNMYFQVQNQGDLSCNFQGLAMVTEQNISQANCNFTIQIATSSSMKLLPVAGLYLAALTFLLL

SEQ ID NO: 17583 - protein, 431 aa, Rickettsiella grylli
MSYSLQDTINNFDPDLWSSMNKEMQRQEDHLELIASENYASPRVLQAQGSGLTNKYAEGYPGKRYYGGCEYVDEVEQLAVERAKKLFKADYANVQPHSGSQANAAAYMALLKPGESLLGMSLAHGGHLTHGAKVSFSGKIYQSYAYGVTSDTQRIHYEEVEALAKKYKPALIIAGFSAYSREVDWQRFRDIADEVGAYFLVDIAHVAGLVAAGLYSSPISIADVVTSTTHKTLRGPRGGLILARSNPEIEKKLNAAVFPGQQGGPLMHVIAAKAVAFKEALEPHFKAYQRQVILNAKAMVQVMQERGYNIVSGGTDNHLFLIDLIDKKMTGKEAEALLEKASITLNKNMLPNDPCKPFITSGLRVGTPAVTTRGFKESQVREVAHWMCDLLDNRNDSARLEMIKKQVVALCHQFPVYSAERRDDNPMDSIE

SEQ ID NO: 17584 - protein, 225 aa, Cryptococcus neoformans
MSRSPSPTLSDSALLDSLEDSFDFSAHREARMEALSRQIKQVKDLRESEYGRVVEFNEEKALIERMAKEKYCVLHFVHPNFQRCDIMDRHLSQLAPKHKHTLFLRANVDNVPFLVTKMAIKVLPCVMSYVDGRAVDRLIGFEELGQTDNFTTKALEFRLSQTGVLPTDLTLATNVSSSLLTQKQQGSRSDFEEEDSEEEKDRRRGKSGIRGGFRNKRGDESDDDW

SEQ ID NO: 17585 - protein, 963 aa, Thermus thermophilus
MDPLWYKDAVIYQLHVRSFFDANNDGYGDFEGLRRKLPYLEELGVNTLWLMPFFQSPLRDDGYDISDYYQILPVHGTLEDFTVDEAHGRGMKVIIELVLNHTSIDHPWFQEARKPNSPMRDWYVWSDTPEKYKGVRVIFKDFETSNWTFDPVAKAYYWHRFYWHQPDLNWDSPEVEKAIHQVMFFWADLGVDGFRLDAIPYLYEREGTSCENLPETIEAVKRLRKALEERYGPGKILLAEVNMWPEETLPYFGDGDGVHMAYNFPLMPRIFMALRREDRGPIETMLKEAEGIPETAQWALFLRNHDELTLEKVTEEEREFMYEAYAPDPKFRINLGIRRRLMPLLGGDRRRYELLTALLLTLKGTPIVYYGDEIGMGDNPFLGDRNGVRTPMQWSQDRIVAFSRAPYHALFLPPVSEGPYSYHFVNVEAQRENPHSLLSFNRRFLALRNQHAKIFGRGSLTLLPVENRRVLAYLREHEGERVLVVANLSRYTQAFDLPLEAYQGLVPVELFSQQPFPPVEGRYRLTLGPHGFALFALKPVEAVLHLPSPDWAEEPAPEEADLPRVHMPGGPEVLLVDTLVHERGREELLNALAQTLKEKSWLALKPQKVALLDALRFQKDPPLYLTLLQLENHRTLQVSLPLLWSPQRREGPGLFARTHGQPGYFYELSLDPGFYRLLLARLKEGFEGRSLRAYYRGRHPGPVPEAVDLLRPGLAAGEGVWVQLGLVQDGGLDRTERVLPRLDLPWVLRPEGGLFWERGASRRVLALTGSLPPGRPQDLFAALEVRLLESLPRLRGHAPGTPGLLPGALHETEALVRLLGVRLALLHRALGEVEGVVGGHPLLGRGLGAFLELEGEVYLVALGAEKRGTVEEDLARLAYDVERAVHLALEALEAELWAFAEEVADHLHAAFLQAYRSALPEEALEEAGWTRHMAEVAAEHLHREERPARKRIHERWQAKAGKA

SEQ ID NO: 17586 - protein, 312 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLDTMKSTSRESKREGRIVNLSSEAHRFSYPEGVRFDKINDKSSYSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 17587 - protein, 483 aa, Unknown
  Nostoc sp. PCC 7120
MFSCHSPCRSDMLCYIKRSRYEFVINIMSNPTVENLVIIGSGPAGYTAAIYAARANLKPVVFEGFQAGGLPGGQLMTTTEVENFPGFPQGITGPELMDRMKAQAERWGAELYTEDVISVDLSQRPFTVRSEEREVKAHTIIIATGATAKRLGLPSEHEFWSRGISACAICDGATPIFHGAELAVIGAGDSAAEESIYLTKYGSKVNLLVRSEKMRASKAMQDRVLSNPKIQVHWNTEVVDVFGNGHMDGVKVRNNQTGEETNVHAKGLFYAIGHKPNTSLFQGQLELDEIGYVVTKHGSPETSVEGVFAAGDVQDHEYRQAITAAGSGCAAALLAERWLSANALIQEFHQEATINNELETQPVAQKTEAEQEAGFDVNATRHAGGYALRKLFHESDRLLIVKYVSPGCGPCHTLKPILNKVVDEFDSKIHFVEIDIDQDRDIAENAGVTGTPTVQFFKDKELVKEVKGVKQKSEYRLLIEGNL

SEQ ID NO: 17588 - protein, 388 aa, Xylella fastidiosa
KVGALPIIGAPSLTTSLQRWAETGRITWRQGTFEDSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLAGPLQRLLRKQRHAEAEAVLEAALAETPPTESGSVTLVGAGAGDAGLLTLNALRALNEADIILYDRLVSDTVLQMARRDAEQIEVGKSATGHSVRQEDIHTLMLQHAHAGQRVVRLKGGDPFVFGRGGEELEFLRTHGIPYEVIPGITAALACAAYAGIPLTHRDHAQSLCLITAHCQSSLDTLDWAALAQERQTLAFYMGVAGLPTIQQRLCEAGRAETTPFALIENGARAQQRV

SEQ ID NO: 17589 - protein, 149 aa, Arabidopsis thaliana
KHILYRKKKRFREGCGNSGTKAQKNHPAQKVNAKMLWNGGEIFPPNTPNIKEVFFSKMIFERFFPQNFGRKRVSGGAPGACSTAKAGEGDPSGSPKRGPPGKAAMGVPLWAHKGKKGALPNPPLRAIDNNPIMMGQGGVIQSKLRREKG

SEQ ID NO: 17590 - protein, 608 aa, Oryza sativa
MATITTPGYAHIQRQHGRCSTTAGRRGASNSVRFSARAVSSVPHAAAASSAPAFLPVPFVPGADAPSPSGKSAIGVPKAPRKGEEGKRLNFFQRAAAMALDAFEEGFVANVLERPHGLPSTADPAVQIAGNFAPVGETPPARALPVSGRIPPFINGVYARNGANPHFDPVAGHHLFDGDGMVHAVRIRNGAAESYACRFTETARLRQERAMGRPMFPKAIGELHGHSGIARLALFYARAACGLLDPSHGTGVANAGLIYFNGRLLAMSEDDLPYQVRVTADGDLETVGRYDFDGQLGCAMIAHPKLDPATGELHALSYDVIKKPYLKYFYFAPDGTKSADVEIPLDQPTMIHDFAITENYVVVPDHQVVFKLQEMLRGGSPVVLDKEKTSRFGVLPKHAADASEMVWVDVPDCFCFHLWNAWEEADTDEVVVIGSCMTPADSIFNESDDRLESVLTEIRLNTRTGESTRRAILPPSSQVNLEVGMVNRNLLGRKTRYAYLAVAEPWPKVSGFAKVDLATGELTKFEYGEGRFGGEPCFVPMDAAAATPRGEDDGYILSFVHDERAGTSELLVVNAADMRLEATVQLPSRVPYGFHGTFITGDELTTQA

SEQ ID NO: 17591 - protein, 606 aa, Zea mays
WVCSLMEDNQILVQSEHNLIPGAQTLVIGQEFADVDTCRRAVKDMAIALHYELRVVKSDRSRFIAKCSKEGCPWRVHIAKCPGVPTFTVRTLHGEHKCEGVLNLHHQQATVGWVARSVEARLRDNPQIKPKEILQDIREQHGVAVSYMQAWRGKERSMAAVNGTLEDGYRLLPAYCEQIVKTNPGSVATYRGIGPGNAFQRLFVSFRASIYGFLNGCRPLLEIDKADLKGKYLGTLLCASAIDADHMMFPLAFGVVDSESDDNWNWFISELRKMLGVNTDKMPVLTILSERKRQVVAAVGSNFPTAFHGFCLRHVSESFRDEFKNTKLLNLFWSAVYALTASEFDAKVNEMMRVQDVMPWLQRFPPNLWAVSCFQGIRYGHFSLGITEILYNLSLDCHELPIVQAIEHIRHQLTCWFAERQNLAQSYNSVLVPSAEKLVSEAIHDSQCYQVLRANKVEFEIVSSERTNIVDTEARSCSCRRWQIYGIPCAHATAALLSCGEDPRFYAHDCFSVMKYRETYSQPIHPIPDRSHWSNSSPGLQGVASKADVMMLSPPNIRRPPGRPKMKILKIESMKRPKRIVQCGRCHLVGHSQKKCSLRSCDSYPH

SEQ ID NO: 17592 - protein, 342 aa, Ralstonia metallidurans
MKLTILGAGAWGTALASHAATAAADHDVVLWGRDPAQLAGIAATGVNATYLPGVSLSPRLVCEPDFDRAVDHALTDPEGLLIIGTPVSGLREMTRRLAARRKGPLAMLWLCKGFEAETHAMPHQMVHDELNALGVAPGEIEYGVLTGPSFAKEVAQGLPCALTVAGTAHVLIDRAQAAFHHHAMRIYGSDDLIGVEVGGAVKNVLAIATGASDGLGLGLNARAALITRGLAEMTRLGLALGGRVETFMGLAGMGDLILTATGDLSRNRKVGQQLAGGKTLDQILADLGHVAEGVRCAQAVAALAARVGVEMPITRAVCAVLFEGLPVADAVSQLLQRDARDE

SEQ ID NO: 17593 - protein, 603 aa, Unknown
  Rhodococcus sp. RHA1
MTTGTTEPDVLVVGTGFAGLCMAIKLKEAGEENVVVLEKADRVGGTWRENTYPGCGCDVMSLMYSFSFAPNRKWTRMYARQPEILDYIERVVRDYDLAPHIRFGAEVISYEFDETTDRWRVETRSGSVYHPRIVVAGPGPLHKPSVPDLPGRKSFSGVAFHSAEWDHSVDLTGKRVAVVGTGASAVQFVPEVAKTAAHVDVFQRTPHWILPKLDRPITAGEKAVFKAVPGVQKAYRGAIYWSHESLIAGFLHPRLMTVLESAARGLLRRQVRDPELRATLTPDYIIGCKRILVSSNFYPALQRGNVDLVTSGISEVTERGIRTDDGTMHEADVIVYGTGFAAGDRFENEHIVGRRGLTIQRAWRDGMEAYLGVAVAGFPNFFLMMGPNSGGGNQSIVFVIEAQAHYITRCLALMKKRDATRIEVRAGAQREFNRVVHRKLAGSVWNSGGCDSWYLDSTGHNRAAWPGSSASYWRRMRTPDDRHFELSSLAEREDDTEYRGPGVLTSGDLTVAVEVFLNGHIEPLDGLYHWYGRVVGDGVDAAKGRNRTPLFLTIGDGPEVPAALAERDPWGHFRIAGVGTPPFPLAPVEVEVPISRAKLASAE

SEQ ID NO: 17594 - protein, 175 aa, Brassica napus
  misc_feature (43)..(43): Xaa can be any naturally occurring amino acid
MAYSMLSSAAVVTSPAQATMVAPFTGLKSSSAFPVTRKANNDXSGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 17595 - protein, 105 aa, Brassica napus
MCGILAVLGCSDDSQAKRVRVLELSRRLRHRGPDWSGIYQNGFNYLAHQRLAIIDPASGDQPLFNEDKSIVVTVNGEIYNHEELRKGLKNHKFHTGSDCDVIAHL

SEQ ID NO: 17596 - protein, 350 aa, Oryza sativa
MARLLLPLPIAAAAASRLRLPVLSSSVARREALLFGGRVAAARAPVRLARRGVSAGAEAGGSSSAAAAAQVIGQDEAVEWVKKDRRRMLHVVYRVGDLDKTIKFYTECLGMKLLRKRDIPEERYTNAFLGYGPEDSHFVVELTYNYGVESYDIGTAFGHFGIAVEDVAKTVDLIKAKGGTVTREPGPVKGGKSVIAFIEDPDGYKFELIERGPTPEPLCQVMLRVGDLDHAINFYEKAFGMELLRKRDNPQYKYTIAMMGYGPEDKNAVLELTYNYGVKEYDKGNAYAQIAISTDDVYKTAEVIRQNGGQITREPGPLPGINTKITACTDPDGWKTVFVDNVDFLKELEE

SEQ ID NO: 17597 - protein, 112 aa, Azospirillum brasilense
MKKIEAIIKPFKLDEVKEALHEVGIKGITVTEAKGFGRQKGHTELYRGAEYVVDFLPKVKIEVVMEDSLVERAIEAIQQAAHTGRIGDGKIFVTPVEEVVRIRTGEKGGDAI

SEQ ID NO: 17598 - protein, 181 aa, Brassica napus
STTRPLSSAAVATSPAQATMVAPFTGLKSSAAFPVTRKSNTDITSITSNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 17599 - protein, 206 aa, Brassica rapa
MSNEYDYLFKLLLIGDSSVGKSCLLLRFADDAYIDSYISTIGVDFKIRTIEQDGKTIKLQIWDTAGQERFRTITSSYYRGAHGIIIVYDCTEMESFNNVKQWLSEIDRYANDSVCKLLIGNKNDMVESKVVSTETGKALADELGIPFLETSAKDSTNVEQAFLTIAGEIKKKMGSHTNANKTSGSGTVQMKGQPIQQNNGGGCCGQ

SEQ ID NO: 17600 - protein, 111 aa, Rhizobium leguminosarum
MKKIEAIIKPFKLDEVRSPSGVGLQGITVTEAKGFGRQKGHTELYRGAEYVVDFLPKVKVEVVLADENAEAVIEAIRKAAQTGRIGDGKIFVSNVEEVIRIRTGETGIDAI

SEQ ID NO: 17601 - protein, 352 aa, Porphyromonas gingivalis
MKYLSLILISMASFSFSLSAGSCSSSAKHNDSIPETKTIYFAGGCFWGTEHFFKQVRGVVATEVGYANGNVEDPSYEEVCSQTTGFAETVRVEYDPSELSLSLLLDLFFKTIDPTILNRQGNDVGSQYRTGIYYTDQEDLSLISSALSALATKYDRPIVVENEPLKNFYPAENYHQDYLDHNPRGYCHIDPSLFELARKANPARFYKKADDAELRARLTPEQYAVTRNNATEPAFDNEYWNEFREGIYVDVTTGEPLFLSTDKFDSGCGWPSFSKPIGKELISERIDRSFGMTRTEVRSTTGDAHLGHLFNDGPLEKGGLRYCINSASLRFIPKEDMKKEGYGSLLPLLNKR

SEQ ID NO: 17602 - protein, 112 aa, Rhodobacter capsulatus
MKKVEAIIKPFKLDEVKEALQEAGIQGLSVIEVKGFGRQKGHTELYRGAEYVVDFLPKVKIEMVLPDEMVDIAIEAIVGAARTEKIGDGKIFVSSIEQAIRIRTGETGEDAV

SEQ ID NO: 17603 - protein, 140 aa, Unknown
  Helicosporidium sp. ex Simulium jonesii
MAALMATVATRPMPLAPVAIRARSALTSQLRYLSAPVRHQKVRASYKITFKMPENEEETIEAPEDQYILDAADDAGLDLPYSCRSGTCSTCLGRVVEGSVDQSDQSFLDDDQMGKGYSLLCVAYPTSDLVIETHKEEELY

SEQ ID NO: 17604 - protein, 451 aa, Streptococcus agalactiae
MNVVLKQRIPLKIKRMGINGEGIGFYKKTLIFVPGALKGEEVFCQISSVRRNFAEAKLLKINKKSKNRVDPACSIYKECGGCQIMHLQYDKQLEFKTDVIRQALMKFKPEGYENYEIRKTIGMSEPEHYRAKLQFQVRSFGGNVRAGLYAQGTHRLIDIKDCLVQDSLTQEMINRVAELLGKYKLPIYNERKIAGVRTVMIRRAQASGEVQLIFITSKRLDFDDVVIELVREFPELKTVAVNINASKTSDIYGQITEVIWGQESINEEVLDYGFSLSPRAFYQLNPKQTQILYSEAVKALDVKEDDDLIDAYCGVGTIGLAFAGKVKSVRGMDIIPEAIQDAKENALHMGFTNTHYEAGKAEDVIPRWYSEGFRANALIVDPPRTGLDDKLLNTILKMPPEKMVYVSCNTSTLARDLVTLTKVYHVHYIQSVDMFPHTARTEAVVKLQRKE

SEQ ID NO: 17605 - protein, 105 aa, Unknown
  Synechocystis sp. PCC 6803
MAVKKQFANFAEMLAGSPKPVLVDFYATWCGPCQMMAPILEQVGSHLRQQIQVVKIDTDKYPAIATQYQIQSLPTLVLFKQGQPVHRMEGVQQAAQLIQQLQVFV

SEQ ID NO: 17606 - protein, 493 aa, Methanosarcina mazei
MKSMGSNSGAKGTEGGSSRTEGEIQENISENASSNSRTEKEFAKVVIIGGGACGMATATKIRRQSDFDITVLSWDSHTAYSHCGIPFVLGKEIESLKKLIVKPLAFFRENKINVKLNEKVTSIDLNGQVVITGEGTYPFDRLVIATGSLPFIPRESRANILPYGIFTLRSLADGMLFEKALETARTVCIIGGGTIGIECASALTKRGIRTTLITRGNDLLTRQFDSDMSAIVREHLESLGVEVITGESVILPENFWKQKTLILRDRQLPADLVLLATGVKPETWLSRETGITIGKAGGIIVNEMLQVKAGEKFLSHVYAGGECAEVIDLITGESRLSQLGTTARSMADVIGNNITGKHSTFGPLADPWVAVAGDLQFGGVGLTSGQAEKQGIKTVTGFSRGRTRASYYPGRKDLYIKLLFKNNCLAGAQLAGGEGIKERIDALSLAIRKEATIKDLLNLETCYAPPVSTLVDPLTPAVKAAARNMRKIKGKGN

SEQ ID NO: 17607 - protein, 375 aa, Desulfovibrio desulfuricans
MSQRDYYEVLGVSRDAADDEIKRAYRKKAMEFHPDRNPDNPEAEAKFKEAAEAYDVLRDAEKRARYDRFGHAGVNGNGYGGGGGFSSTEDIFAHFGDIFGDLFGFAGMGGARGPRPQAGSDLRYNLNISFRQAARGDEVTLRIPKNVTCPDCSGSGAAPGTQPETCPQCGGSGQVVRQQGFFQMAMPCSACRGEGRIVRNPCPRCRGAGQVQDIRELSVRIPAGVDTGNRLRLRGEGEPGVHGGPPGDLYVVIRVDDDKTFRRQGQDLVVRKEISFVQAILGDKVEVPTLDDPVTVDIPRGTQSGEVFRIAGKGLPHLGSSQTGALLVEVTVRIPSSVNDEQEKLLREFERLEENRPLRKVKNMFKKAGKAMGMD

SEQ ID NO: 17608 - protein, 304 aa, Kineococcus radiotolerans
MHIGLVGLGKMGGNMRSRLRDKGIEVTGYDPNPDVTDVPSLAALVEALPSPKIVWVMVPSGKITRDTVANLAPLLKDGDLVIDGGNSKWTDDEINSKLLAERGTGYMDCGVSGGVWGKDNGYGLMVGGSKGHVDLAMPIFDALRPEGPREEGFVHAGGVGAGHYSKMVHNGIEYGLMHAYAEGYELLEAKGIIHDVPAVFKAWTRGTVVRSWLLDLMVRALEEDPKLDNIRGYAQDSGEGRWTLEQAIENAVPMPVLAAALFARFSSRQEDSPSIKAVAALRNQFGGHAVAQAGPTSGTGSTNS

SEQ ID NO: 17609 - protein, 313 aa, Glycine max
MWLFGRKGASGFSSSSTAEQVTEGIDGTGFTAIVTGASSGIGTETTRVLALRGVHVIMGVRNMLAAKDVKETILKEIPSAKVDAMELDLSSMKSVRKFASEFKSSGLPLNILINNAGIMACPFSLSKDKIELQFATNHIGHFLLTNLLLDTIKKTSRESKKEGRIVNVSSEAHRFAYSEGICFDKINDESSYNNWRAYGQSKLANILHANELTRRLKEDGVDISANSLHPGTITTNLFRHNSAVNGLINVIGRLVLKNVQQGAATTCYVALHPQVKGISGKYFSDSNVANTTAQGTDADLAKKLWDFSMNLTK

SEQ ID NO: 17610 - protein, 379 aa, Oryza sativa
MEDAHHHHWTMVERRGTQLWASGRPFIIHGFNTYWLMSFAADQATRLRVTAAIAEAGLNVCCTWAFSDGGYRALQTAPFHYDEDVFRALDFVVSEARRHNMRLILSLCNNWEDYGGKAQYVRWGKEAGLDLTSEDDFFSDPTIKSYYKAFVEAVVTRINTVTNETYKDDPTILAWELINEPRCPSDPSGDTLQAWMEEMASYVKSIDPVHLLEIGIEGFYGPSIPELLPVNPDEYSGHAGIDFIRNHQAPGIDLASIHVYSDIWLPQSIKENHLQFVDKWMQQHIDDAANLLGMPIVVGEFGVSVKDGKFGNEFREDFMKTIYRIFLSSWKEGVIGGGCLLWQLFPEGAEHMDDGYAVIFAKSPSTLSLLANHLRCLEC

SEQ ID NO: 17611 - protein, 445 aa, Salmonella enterica
AVMGRNLALNIESRGYTVSIFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKNAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRT

SEQ ID NO: 17612 - protein, 792 aa, Escherichia coli
EAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 17613 - protein, 97 aa, Aphanizomenon flos-aquae
ATYKVTLIDAEGTTTTIDCPDDTYILDAAEEAGLDLPYSCRAGACSTCAGKLVTGTIDQSDQSFLDDDQVEAGYVLTCVAYPTSDVTIETHKEEDLY

SEQ ID NO: 17614 - protein, 415 aa, Unknown
  Shewanella sp. MR-7
MSLIKQISADAAHAARTLAQLDESLKNTVLLDMARSLREKSYEIQSANLIDVHRATQDNLSPAMVDRLTLNQHRIEAMAQGIETIAALPDPVGRERFIGKRPNGLSISKMRVPLGVVCMIYEARPNVTADAGALCFKSGNAVILRGGKEALHTSQVIASILQAVLTAYGLPKALISVIPDPDRALMLELMQQREFIDVIIPRGGEGLINYVTENSSIPVIQHFKGVCHLYVDKDANQDIALDLLLNGKTQRTGVCNALEGLLVHKDIAPRFLPRVAKALAEHQVKINACPPAAAYFDACTYMAEEDFGQEYLDLEIAIRQVDSFEVATQHIAKFGSHHTEVICTDNELTAARFQRAVDASVVMVNASSRFSDGSELGLGAEIGIATTKLHAYGPMGLEALTTEKYLVSGTGQIRA

SEQ ID NO: 17615 - protein, 771 aa, Glycine max
GGGSGPPLGWLVGPPPPRLQTVNRKLTAMNKLLMEENDRLQKQVSQLVCENGFMRQQLHTPSATTTDASCDSVVTTPQHTLRDASNPAGLLSIAEETLTEFLSKATGTAVDWVQMPGMKPGPDSVGIFAISQSCSGVAARACGLVSLEPTKIAEILKDRPSWFRDCRSLEVFTMFPAGNGGTIELVYTQTYAPTTLAPARDFWTLRYTTSLENGSLVVCERSLSGSGTGPNPAAAAQFVRAETLPSGYLIRPCEGGGSIIHIVDHLNLEAWSVPEVLRPLYESSKVVAQKMTIAALRYIRQIAQETSGEVVYGLGRQPAVLRTFSQRLSRGFNDAVNGFNDDGWTVLNCDGAEDVIIAVNSTKNLSGTSNPASSLTFLGGILCAKASMLLQNVPPAVLVRFLREHRSEWADFNVDAYSAASLKAGTYAYPGMRPTRFTGSQIIMPLGHTIEHEEMLEVIRLEGHSLAQEDAFVSRDIHLLQICSGIDENAVGACSELVFAPIDEMFPDDAPLVPSGFRIIPLDSKPGDKKDAVATNRTLDLTSGFEVGPATTAGADASSSQNTRSVLTIAFQFPFDSSLQDNVAVMARQYVRSVISSVQRVAMAISPSGINPSIGAKLSPGSPEAVTLAHWICQSYSYYLGSDLLRSDSLVGDMMLKQLWHHQDAILCCSLKSLPVFIFANQAGLDMLETTLVALQDITLDKIFDEAGRKALCTDFAKLMEQGFAYLPAGICMSTMGRHVSYDQAIAWKVLTGEDNTVHCLAFSFINWSFV

SEQ ID NO: 17616 - protein, 496 aa, Phaseolus vulgaris
MALFMAILGVLVLLLCFCSALLKWNEVRFRRKGLPPGAMGWPVFGETTEFLKQGPNFMKNKRARYGSFFKSHILGCPTIVSMDPELNRFILMNEAKGLVPGYPQSMLDILGTRNIAAVHGSTHKYMRGALLSIISPTLIRDQLLPKIDEFMRTHLMDWDNKVINIQEKTKEMAFLSSLKQIAGMESSSIAQPFMTEFFKLVLGTLSLPINLPRTNYRGGLQARKSIISILSQLLEERKASQDVHVDMLGCLMKKDENRYKLSDEEIIDLVITIMYSGYETVSTTSMMAVKYLHDHPKVLEEIRKEHFAIRERKKPEDPIDCNDLKSMRFTRAVIFETSRLATIVNGVLRKTTHDMELNGYLIPKGWRIYVYTREINYDPFLYHDPLTFNPWRWLVCNTTYTFFHFNMKPRKVESRIINEKLQMQGNSLESQSHFLIFGGGTRQCPGKELGIAEISTFLHYFVTRYRWEEVGGDKLMKFPRVVAPNGLHIRVSSFSN

SEQ ID NO: 17617 - protein, 294 aa, Arabidopsis thaliana
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLITINVQPKEIQNVQDAQIEEKTNAPPELRLPDVLDAKVVTCSRHTTWQDYVDYFKSPNQRKQPERNTEDESVLIAF

SEQ ID NO: 17618 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17619 - protein, 625 aa, Cryptomeria japonica
MSCSARLVVDSYTHSRVPLGESSQWRHQSLSRTSNFHRLHRHVDIRARVVTPTTPIEQKPIIQTSTPTSNSTSTSLTWRSDPDERFEIPNRVFPGMGKKKSKSESCGWNPVQRLAAAALDAMEKSFIMALEKKFPLPKTADPEIQIAGNFSPVPESPVQHELEVVGQIPQCLEGVYVRNGANPLFEPLAGHHFFDGDGMVHAVRLKQGIASYCSRFTRTYRLVEEEKLGRAFYPKAIGELHGHSGIARLMLYYARSMFGLVDRSKGMGVANAGLIYFNGRLLAMSEDDLPYAVRVTEDGDLATLGRFDFDGQLQSAMIAHPKIDPETKELFALSYNVIKKPYLKYFMFSPDGRKGPDVTISVKEPTMMHDFAITDKYVVVPDQQLVFKLQEMVAGGSPVIYDKEKVPRFGILPKYDSDESRMKWIEVPDCFCFHLWNAWEENEDEVVVIGSCMTPPDSIFNESDAALRSVLSEIRLNLKTGKSSRRQLAPMNLEAGQVNRNKLGRKARYVYLAIAEPWPKVSGIAKVDLEAESPERVVGKIEYKKGCYGGEPFFVPRTSNPEAPEDDGYVLTFMHNEETWQSELLILDAKSPTLEPVASVKLPSRVPYGFHGTFITSQELDQQVL

SEQ ID NO: 17620 - protein, 528 aa, Pseudomonas putida [sequence omitted]

SEQ ID NO: 17621 - protein, 314 aa, Ostreococcus tauri
MAMTSSSSSRRTRLARPRRALRVEASREEELMSKLMSMIGVGGDGIVSAAEALPGRAEAMRTPEAHYVLRPNRMTAPWPEGHEVAVIASGCFWGSEKGAWRIPGVYSTAVGYVGGHTKNPTYEEACSGRTGHTEGVQIVFDPNVVSYADILALFWTSHDPTQGMRQGNDRGTQYRSGIYCTTDAQLKMALDSKEAYERALKASGRGSITTEIKGPAILGETQRSTGAHRRNRRDDARTSLDRKPRFANTRLTAARVLHAVLLRATDGRPDARGLVDGERRQVRPGLPRRVRSASGCTIGFPNAPVSLEEALAAN

SEQ ID NO: 17622 - protein, 390 aa, Xylella fastidiosa
KVGALPIIGAPSLTASLQRWAETGRITWRQGTFEDSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLVGPLQRLLRKQRHAEAEAVLEAALAETPPTESGSVTLVGAGAGDAGLLTLNALRALNEADIILYDRLVSDTVLQMARRDAEQIEVGKSATGHSVRQEDIHTLMLQHARAGQRVVRLKGGDPFVFGRGGEELEFLRTHGIPYEVIPGITAALACAAYAGIPLTHRDHTQSLCLITAHCQSSLDTLNWVALAQERQTLAFYMGVAGLPTIQQRLCEAGRAETTPFALIENGARAQQRVLT

SEQ ID NO: 17623 - protein, 257 aa, Ostreococcus tauri
MQAIRNMFGGAGGERVPMKINPKHFILKTDVTTVPSGHASFVAATGCFWGSEKMFWRVPGVRATSVGYIAGKIEHPTYEEICGGRTGHAECVRVIYDPKIVSFADLLAMHWTSHDPTQGDGQGNDRGTQYRSGLYCSTDEQLKMARDSREADHDRDQGARGYFLLRRGLPSAVLGCVCLSNLFRDVLTTPLFSRAAKPGSRKYCSAEPTGVPMPTAWLKANGGKFGPGFWAKYGPKPGCTIGVPDAQVSLDAALEAK

SEQ ID NO: 17624 - protein, 625 aa, Cryptomeria japonica
MSCSARLVVDSYTHSRVPLGESSQWRHQSLSRTSNSHRLHRHVDIRARVVTPTTPIEQKPIIQTSTPTSNSTSTSLTWRSDPDQRFEIPNRVFPGMWEKKSKSESCGWNPVQRLAAAALDAVEKSFITALEKKFPLPKTADPEIQIAGNFSPVPESPVQHELEVVGQIPQCLEGVYVRNGANPLFEPLAGHHFFDGDGMVHAVRLKQGIASYCSRFTRTYRLVEEEKLGRAFYPKAIGELHGHSGIARLMLYYARSMFGLVDRSKGMGVANAGLIYFNGRLLAMSEDDLPYAVRVTEDGDLATVGRFDFDGQLQSAMIAHPKIDPETKELFALSYNVIKKPYLKYFMFSPDGRKGPDVTISVKEPTMMHDFAITDKYVVVPDQQLVFKLQEMVAGGSPVIYDKEKVPRFGILPKYDSDESRMKWIEVPDCFCFHLWNAWEENEDEVVVIGSCMTPPDSIFNESDAALRSVLSEIRLNLKTGKSSRRQLAPMNLEAGQVNRNKLGRKARYVYLAIAEPWPKVSGIAKVDLEAESPERVVGKIEYKKGCYGGEPFFVPRTSNPEAPEDDGYVLTFMHNEETWQSELLILDAKSPTLEPVASVKLPSRVPYGFHGTFITSQELDQQVL

SEQ ID NO: 17625 - protein, 231 aa, Oryza sativa
MQQQQLCSSHCLPARAGSIASPGSGRRVVPLGRRRASLGKVTAYAYPTTRRVVDAAKSSLLQDVHVAASNPSLQLLQDYAPAKKSAKQQNGSRTKDGFYEVEMTVQDDELDEYGVVNNAIYASYIHSGRDVFLENVGVGVDYWTSTGNALALSELNLKFYTPLRKDDRFVVRMKVVKIKGVRIIVEHLIETLPDRKLVVDAKATAVCLDNKYRPTRVFPELSTKLHQFFLS

SEQ ID NO: 17626 - protein, 944 aa, Unknown
  marine gamma proteobacterium HTCC2080
MAFTPEDYNPYDFANRRHIGPSPSEMTAMLDVLGVSDLDELIEQTIPAALRQAQPLNFEEPLSERELIFKMRQVAAKNKVFTTMIGQGFYGTVCPPAIQRNILENPAWYTAYTPYQPEISQGRLEALLNFQTVVSDLTGLEVANASLLDEATAAAEAMVMAQRVAKSKARGFFIDENSHPQNIAVMQTRAEPLDIDIIIGAPEELDASTVFGGIFQYPGTYGHIRDFSPQAEQLQAAKAITVIVADPLALALLKEPAAMGADIAVGSTQRFGVPMGCGGPSAAYMACKAAYKRSMPGRIVGVSIDVEGNTAYRLSLQTREQHIRREKATSNVCTAQALLANIASFYAVFHGPEGLKAIAQTVHCKTVCVARGLEAHGFSVEPATFFDTITVEVGAFQGTIIDAARRERINLRKVGDTRVGISLDESTLTHVIERLWRAFGIHDRDAELTSDYRFDDALIRQTQYLTHPIFHLNRAETEMMRYMRRLADRDLALDRAMIPLGSCTMKLNAAAEMLPITWPEFANIHPFAPADQTQGYAELTQDLSNKLCEITGYDAMSLQPNSGAQGEYAGLLTIRAYHRARGETERNICLIPVSAHGTNPASAQMVGLDVVVVRSATNGDVDVADFRAKARAAGNRLAACMITYPSTHGVFEETVTEICNITHEFGGQVYIDGANMNAMVGLVRPGDIGGDVSHLNLHKTFCIPHGGGGPGMGPIGVKAHLAPHLPGHAEADGDGAVSAAPLGSASILPISWAYLLMMGGEGLTQATRVAILNANYIAKQLEGGYDILFKGSRGRIAHECIVDTRSFVESANVTVDDIAKRLIDNGFHAPTMSWPVSGTLMIEPTESETKAELDRFITAMKSIREEIATIERGEMAIDNNPLKHAPHTVNSLMGDWDRPYTREEGCFPPGSFRIDKYWSPVSRVDNAYGDRHFICTCPSLDEYE

SEQ ID NO: 17627 - protein, 432 aa, Gibberella zeae
MPKAPPQPASSPGVAAPAAASSIPNLKDRLPKLEPRKRRSGPSNPTPIPETPALPTPPDTSSNWTFKTPSRRILSKKDHDIFLSSPTCKLVTAWVFGLAESIVDTPNSAIRDADLSALIKTILHILDETEQLVTKSPPNEQGGSRFGNKAFRGLLDLAQKNSAAWHHDIGVQNEDAINELSTYFCESFGNANRIDYGSGHELNFMIWLLCLYQLGLLKQSDFKPIVLRVFVRYLEVMRVIQMTYYLEPAGSHGVWGLDDYQFLPFLFGATQLLHHPYITPRAIHQDLTLEEFGHEYMYLGQVSFVNSTKTVKGLRWHSPMLDDISSARSWTKIDGGMRRMFVAEVLGKLPVMQHFLFGSLVPADDSMSEDTGAGDEADVEDDPHAGHDHTGKAHDGTGWGDCCGIKVPSSIAAAQEMKKRGMNQGLRRIPFD

SEQ ID NO: 17628 - protein, 212 aa, Oryza sativa
MHHQIWRLLPSALSPIHAGAPRPSRPPARLGRPSPQRRRALALALAHLATRRTCRLLAVSAQSASPHAGLRLDQFFEVEMKVRDYELDQYGVVNNAIYASYCQHGRHELLECVGISADAVARSGESLALSELHLKYYAPLRSGDKFVVKVRLASTKGIRMIFEHFIEKLPNRELILEAKATAVCLNKDYRPTRISPEFLSKLQFFTSEGSSS

SEQ ID NO: 17629 - protein, 625 aa, Cryptomeria japonica
MSCSARLVVDSYTHSRVPLGESSQWRHQSLSRTSNFHRLHRHVDIRARVVTPTTPIEQKPIIQTSTPTSNSTSTSLTWRSDPDERFEIPNRVFPGMGKKKSKSESCGWNPVQRLAAAALDAMEKSFIMALEKKFPLPKTADPEIQIAGNFSPVPESPVQHELEVVGQIPQCLEGVYVRNGANPLFEPLAGHHFFDGDGMVHAVRLKQGIASYCSRFTRTYRLVEEEKLGRAFYPKAIGELHGHSGIARLMLYYARSMFGLVDRSKGMGVANAGLIYFNGRLLAMSEDDLPYAVRVTEDGDLATLGRFDFDGQLQSAMIAHPKIDPETKELFALSYNVIKKPYLKYFMFSPDGRKGPDVTISVKEPTMMHDFAITDKYVVVPDQQLVFKLQEMVAGGSPVIYDKEKVPRFGILPKYDSDESRMKWIEVPDCFCFHLWNAWEENEDEVVVIGSCMTPPDSIFNESDAALRSVLSEIRLNLKTGKSSRRQLAPMNLEAGQVNRNKLGRKAQYVYLAIAEPWPKVSGIAKVDLEAESPERVVGKIEYKKGCYGGEPFFVPRTSNPEAPEDDGYVLTFMHNEETWQSELLILDAKSPTLEPVASVKLPSRVPYGFHGTFITSQELDQQVL

SEQ ID NO: 17630 - protein, 123 aa, Chlamydomonas reinhardtii
MAMIVRRPMLTARAPARVAVAPLRTRVISHFKVTFKTPKGEKTIDVEADKYLLDAAEEAGMDLPYSCRSGGCSTCCGKLESGTVDQSDQNMLDEDQLKQGFVLTCVAYPTSDIVILTDQESKL

SEQ ID NO: 17631 - protein, 78 aa, Methanosarcina mazei
MKTGDELDLGGRTLIFLEAAMLHWPDSMEIFRKEDRILFSNDCFGQHLASKRYDFEVGDALPDAVEYYANTLMPFHIS

SEQ ID NO: 17632 - protein, 483 aa, Spinacia oleracea
MAPPTRIGLAGLAVMGQNLALNIAEKGFPISVYNRTTSKVDETVERAKQEGNLPLYGFHDPESFVNSIQKPRVIIMLVKAGAPVDATIKTLSAYLEKGDCIIDGGNEWYENTERREKAMEEKGLLYLGMGVSGGEEGARNGPSMMPGGSFDAYKNIEDILTKVAAQVDSGPCVTYIGKGGSGNFVKMIHNGIEYGDMQLIAEAYDVLKSVGKLSNEELKEVFAEWNRGELLSFLIEITADIFGIKDDKGEGYLVDKVLDKTGMKGTGKWTVQQAAELSVAAPTIASSLDSRFLSGLKDERVEAAKVFKAGGVEDTLSDQVVDKKKLIDDVRQALYAAKICSYAQGMNLIRAKSVEKEWDLKLGELARIWKGGCIIRAMFLDRIKKAYDRNPNLSNLLIDPEFSKEMIERQSAWRRVVCLAIGAGISTPGMSSSLAYFDSYRRERLPANLVQAQRDYFGAHTYERIDIPGAFHTEWFKLAKSKI

SEQ ID NO: 17633 - protein, 443 aa, Hyphomonas neptunium
MAFDAAAKPKTCIIGAGCSGFTMAKRLKDASLPYDCFEKSDNIGGNWYYMNPNGVSSCYQSLHIDTSKWRLAFEDYPVPGDWPDFPHHAQLLQYFHDYVDHFGLRETITFNTSVEDVADLPNGRYRVTLSTGETRDYDAVCVANGHHWDARTPTYPGTFTGYQVHSHHYRDPFEPFDFRGKRIMIVGAGNSAMDISSELSQRPIAEKLFISMRRGVWVMPKYMDGRPADKAVLPAWMPTSLGRSLAKKKIKKTIGNMEDYGLPKPDHEPLEGHPSVSGEFLTRVGCGDILPKPGIDRFDGKTVHFTDGTSEEIDAIVWATGYNTSFPFFKQDELTPKDNVFSLYKRMVKPGRETLFFLGLAQPLPTLVNFAEQQSKLVAAALQGRYAFPSHEEMDRVTVADEQAHLGHFYDSPRHRMQVDFNLYVRDLHKELERGAKRAQVGA

SEQ ID NO: 17634 - protein, 569 aa, Clarkia lewisii
MATPALISETEAWKDLKAHLEGIKRTHLRELMGDTERCQSMMVEFDNIFLDYSRQQASPDTINKLYKLAEAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVAAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPCLSILLPTLDAYRIGQLLAIYEHRVAVQGFVWGINSFDQWGVELGKSLATQVRKQLHASRVKGEPVEEGFNFSTKTLLTRYLQATTDVPADPSTLLPNI

SEQ ID NO: 17635 - protein, 361 aa, Bacteroides fragilis
MKKKFTIFVVLLAGIIYTGHAQGVQWIYQQKQEKKNMKNLSEIYFAGGCFWGTDHFLKQIRGVKSTQVGYANGNIANPTYQQVCTGKTNFAETVKVEYNPQEVPLKLLIDLFFKTIDPTSLNRQGNDKGSQYRTGIYYTDKVDLPTIRTAIDELAKEYSKPIVIEVKPLSNFYKAEEYHQDYLDKNPGGYCHINPALFELAKKANAQAEQPQTNYKKPDDATLRSKLTPEQYAVTQKNATEPAFHNEYWDEKRDGIYVDITTGEPLFISTDKFDSGCGWPSFTKPIEKEVIKEKMDTSHGMIRTEVRSKTGDAHLGHVFTDGPKEKGGLRYCINSASLRFIPKEKMKEEGYGEYLKLLPQK

SEQ ID NO: 17636 - protein, 420 aa, Rhodopseudomonas palustris
MSQGVTAPFARHAMAYVLAGGRGSRLMELTDWRAKPAVYFGGKSRIIDFALSNALNSGIRRIAVATQYKAHSLIRHLQRGWNFFRPERNESFDILPASQRVSEEMWYRGTADAVFQNIDIIESYDPKFIVLLAGDHVYKMDYEKMLQQHVEQGADVTVGCLEVPRAEATAFGVMHTDTTDRIISFLEKPADPPAMPGKADKSLVSMGIYVFETKFLLDELRRDAADPNSSHDFGKDIIPYIVKHGKAVAHHFDKSCRRSSSEAVSYWRDVGTVDAYWAANIDLTDIVPELDLYDREWPIWTYGEITPPAKFVHDKEGRRGEAVSSLVSGGCIISGASLRHSLLFTGVRVHSFSHVENTVVLPYADIGRSCRLKNVVIDAEVKLPAGLVVGEDPEFDAKRFRRTENGICLITRAMIEKLDA

SEQ ID NO: 17637 - protein, 201 aa, Cicer arietinum
AILITLAVNDRIIMPLWKKMKGKPGFTNLQRIAIGLLLSTFGMAAASLCEVKRLSVAKSVKGNQATIPISVFLLIPQFFLVGSGEAFIYTGQLDFFITQSPKGMKTMSTGLFLTTLSLGFFISSFLVSVVKKVTGTRDGQGWLADNINKGRLDLFFALLTILSFINFVAFLVCAFWYKPKKAKPSMQMGAINNGSSVEEKC

SEQ ID NO: 17638 - protein, 266 aa, Streptomyces coelicolor
MTSPSVLQAPHASSLDLHGRTALVTGAAGGIGRACALRLAAAGAEVRAVDRDAAGLEALAGSCGDLAGSVEPQVLDLTDLDAAERAAAGTDVLVNNAGLQLVRPLEEFPPDVFHTVLTVMLEAPFRLIRGALPHMYGQGWGRIVNISSVHGLRASAYKAAYVSAKHGLEGLSKTAALEGAAHGVTSNCVNPAYVRTPLVERQIADQARAHGLPEEQVLSDVLLRDSALRRLIEPDEVAEAVAYLCGPYTVGLTGTSLVLDGGWTAH

SEQ ID NO: 17639 - protein, 309 aa, Vibrio vulnificus
MKLIGMIWNFILNPQAGGGKALRFWQQLKPLLSQHNIKHHFHQTQYQGHAKVLSKELAEQGERAFVAIGGDGSVNELLQGIFESDCDLQEFVLTVAPQGTGNDWARYHHIPKSPNAWLEFLQAANVVEHDVGVVEYGDDFLQQHAFINMAGSGLDCHILQQMGCAGGKSLRYYSTLLSSLYGYQGRTLHFKRLDDSSSQDVARTVLLSMFCIGRYGGAGMDFSPKAHHQSGVLHAVCVEDMPFLKRLFSLPYLLNGKIEQHSRVQAETMRALLVAGEDTALFQCDGELIGELPARLTLRPCAIRVLTRR

SEQ ID NO: 17640 - protein, 247 aa, Unknown
  Marinobacter sp. ELB17
MAQVHMRDLLKAGAHFGHQTRYWNPKMSKYIFGARNKIHIINLEQTVPAMNDALKFVARLTENKNKILFVGTKRAAAKIIKEEAERSGQPFVNHRWLGGMLTNYKTIRQSIHRYRELQAQSKDGTFDKLTKKEALERSREMDKLERSIGGIKDMGGLPDALFVIDVDHERIAIKEANKLGIPVIGVVDTNSNPDGVDYVIPGNDDAIRAIQIYVKAVADTCLESVNVGADEFVEVSEEAPSAAPAAE

SEQ ID NO: 17641 - protein, 917 aa, Pseudomonas chlororaphis
MLKKLGIKGRVLLLTLLPTSLMALVLGGYFTWMQQSDLQTQLLQRGEMIAEQLAPLVAPALAHQNTALLERIATQSLEQQDVRAVSFLAPDRTPLAHAGPSMLNQAPTGNGSQMLQRTGSDATRYLLPVVGRHRNLAGDLIPDESDRLLGWVELELSHNSMLLRGYRSLFASLLLITAGLICTGLLALRMGRTINNPLSQIKQAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLRLPKTRDDAEDLPAPPLLGRRVAVLENHELARQALQHQLEDCGLEVTPFNTLEALTNGVTGVHQTEQAIDLAVLGITTNDMPPERLNQHIWDLEHLGCKVLVLCPTTEQTLFHLSVPNPHSQLQAKPACTRKLRRALADLVNPKAVRSEPSEPIASRPPRVLCVDDNPANLLLVQTLLEDMGAKVLAVDSGYAAVKAVQNESFDLVMMDVQMPGMDGRQSTEAIRQWESERNCTPLPVIALTAHAMANEKRALLQSGMDDYLTKPISERQLAQVVLKWTGLALRNQGPERTGEPSGNGHELQVLDHDEGLRLAAGKADLAADMLAMLLASLEADREAIRAARAANDHNALIERVHRLHGATRYCGVPQLRAACQRSETLLKQEDIKAFAALDELERAINRLATEARINA

SEQ ID NO: 17642 - protein, 443 aa, Thermotoga neapolitana
MKYDVVIVGGGPAGLVAAFTTKRFYKDKKILVVKKTEKETVPCGIPYIFHTLSGVENDYMGIEERFKSAGIDLLIDVVVDGNTDEKKLLTKTGKEIFYEKLIIATGSTPNVPNIPGVDLEGVFTVPKDANYLKMLYEKIKDSKNVVIIGGGFIGVEVADELKKSGKNVTLVEIMDSLLPVSFDPDFGEIARKEIEAENLKVLTGRKVTEIYGSKRVEGVRLDNAETILADAVILATGYRPNSDLARKLGLKVTEYGFIETDEYMRTSKPDVFAAGDCVQHRDFLTGRPSRLMLASAAVLDARIAASNLYGLKVIRANKGSLNAYSTVIGSKAFGSVGITERVAKEEGFEIVVGRAEAPDRHPGKFEDTTKLIVKLIFSEDSKILLGAQVCGGKSVGEIVNILSLGMQKGITANDLFTMQIGTHPLLTSAPTVYPLAKAAEMVL

SEQ ID NO: 17643 - protein, 320 aa, Enterococcus faecalis
MKRIGILTSGGDAPGMNAAIRAVVRKSIFDGIEVYGINYGFAGLVAGDIRRLDVADVGDKIQRGGTFLYSARYPEFATEEGQLKGIEQLKKFGIEGLVVIGGDGSYHGAMALTKRGFPAVGIPGTIDNDIPGTDFTIGFDTAINTVLESIDRIRDTATSHVRTFVIEVMGRNAGDIALWSGVAGGADEIIIPEHDFDMKNVAKRIQEGRDRGKKHCLIILAEGVMGGNEFADKLSEYGDFHTRVSILGHVVRGGSPSARDRVLASKFGSYAVELLKEGKGGLCIGMLDNQVVAADIIDTLENNKHKPDLSLYELNHEISF

SEQ ID NO: 17644 - protein, 597 aa, Penicillium minioluteum
MGSISEISQSTAAPKQSRMAAWWKESTVYQIYPASFKDSDGDGVGDLKGIISKLDYIQTLGVDIVWLNPIFSSPQVDMGYDISDYYDIHPPYGTMEDVNVLADGLQKRGMKLLMDLVVNHTSDQHPWFQDAISSVSNPRRDWYIWKKPIIDKDGKPQPPNNWRSYFGGSAWEYDDRSGEYYLHLFAKEQPDLNWENVEVRKAVHRIIRFWLDKGVHGFRMDVINFISKDQSFPDGAIVSDSKWQNGSAHYACGPRLHEYLQEIGAILKEYNAFSVGEMPEVNDCDEIIKAVGFERGELNMIFHFEIVNLDHGENDKITPKNWNMQELKSVVSKWQKFMLENDGWNALYLENHDQPRIVSRFGSDQPEYRELSAKMLAAFLGFQSGTLFIYQGQELGMPNVPRHWGIDQYRDIETLNHWKEVVSEGLADPIVSLGEYRLKSRDNARTPMQWDGSANAGFSTSTPWISVHDDYTTLNAAAQLADKHSVYHFWSTILGLRKAFPDVLVYGSSTSFPVSIRICSATCECQIAAEWRLLSSTFARGLSHGPPLQFSKIKSGGIVLSNYPGRRSLKCISEEPLNLEPLETFLWLEDMEESSRL

SEQ ID NO: 17645 - protein, 340 aa, Lactobacillus sakei
MTVNVAVLGAGSWGTILANLLVENGHHVELWGNDPEKVAEINEQHTNKHYLPEFKIDSRLHATLDLNEAFEAVDVVLFVIPTQVIRLVAEQIAPVLEAKGVKPVIVTASKGLEQGSHKRISEVLTETIPADIRNGIVVLSGPSHAEDVAMKDITTLTAASTDLVQAQWIQEIFMNDYFRLYTNTDVIGVEMGAALKNVIALGAGALHGLGYGDNTKAALMTRGLAEISRLGVAMGANPLTFIGLSGVGDLIVTGTSVHSRNWRTGNALGEGQKLDDVLENMGMVVEGVATCKAAYELAQQRSVDMPITNAIYNVLYRGCDIRTEIGNLMQRSGKPEIDFK

SEQ ID NO: 17646 - protein, 306 aa, Lactobacillus sakei
MAKSYDVIVIGAGPGGMTAALYASRSNLSVLMLDRGIYGGQMNNTAEVENYPGFKSILGPELGEKMYASATQFGAEYGYGTVNSIEDKGEFKLVHTDEGDFQARAVIIATGSEHKKVGIPGEDEYGGRGVSYCAVCDGAFFKNKEVVVIGGGDSAIEEGLYLTQLASKVTVIHRRDQLRAQKILQDRAFVNDKMAFVWNAQVKTIEGDDKKVAAVTYVDKESGETKGVPASGVFIYVGIDPMTSAFKDLGILTEAGWVKTDDHMATSVPGIFAIGDVREKDLRQITTAVGDGGIAGQEVFKYIQSI

SEQ ID NO: 17647 - protein, 372 aa, Oryza sativa
MVECSGTQLWASGRPFIIHGFNTYWLMSFAADQATRPRVTAAIAEAAEAGLNVCRTWAFSDGGYRALQTVPFHYDEDVFQALDFVVSEAKRHNMRLILSLCNNWEDYGGKAQYVRWGKEAGLDLTSEDDFFSDPTIKSYYKAFVEAVVTRINTVTNETYKDDPTILAWELINEPRCPSDPSGDTLQAWIEEMASYVKSIDPVHLLEIGIEGFYGLSTPELLPVNPDEYSGHAGTDFIRNHQAPGIDLASIHVYSDTWLPHSIKENHLQFVDKWMQQHIHDAANLLGMPIVVGEFGVSVKDGKFGNEFREDFMKTVYRIFLSSWKEGVIGGGCLLWQLFPEGAEHMDDGYAVIFAKSPSTLSLLANHLRCLEC

SEQ ID NO: 17648 - protein, 473 aa, Enterococcus faecalis
MTKQQFGVVGMAVMGKNLALNIESRGYTVALYNRTGSKTTEVVEEHPDKNFQATYSIEEFVNAIEKPRRIMLMVKAGPATDATIQELLPHLDKGDILIDGGNTFFKDTMRRNEELANSGINFIGTGVSGGEEGALKGPSIMPGGQKEAYELVAPILEKISAKAEDGEPCVTYIGPNGAGHYVKMVHNGIEYGDMQLIAESYDLMKQILGLSVDEMAEIFKEWNEGELDSYLIEITADILTRKDDEGTDQPIVDVILDAAGNKGTGKWTSQSALDLGVPLPLITESVFARFISAYKEERVKASGILSKPAAFNFAGDKKELIEKIREALYFSKLMSYAQGFAQLRAASEEYGWDLPFGEIAKIWRAGCIIRAQFLQKITDAYEKNPALENLLLDEYFVEITKKYQQAVREVVAIAVQAGVPVPTFSSAIAYYDSYRSDRLPANLIQAQRDYFGAHTYERTDKEGIYHYSWYNEE

SEQ ID NO: 17649 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17650 - protein, 452 aa, Thermobifida fusca
MSANLDEKLSPIYEEILRRNPGEVEFHQAVREVLECLGPVVAKNPDISHAKIIERLCEPERQLIFRVPWMDDSGEIHVNRGFRVEFSSSLGPYKGGLRFHPSVNLSIIKFLGFEQIFKNSLTGLPIGGAKGGSDFDPKGRSDAEIMRFCQSFMTELYRHLGEHTDVPAGDIGVGQREIGYLFGQYKRITNRYESGVFTGKGLSWGGSQVRREATGYGCVLFTAEMLRARGDSLEGKRVSVSGSGNVAIYAIEKAQQLGAHVVTCSDSNGYVVDEKGIDLELLKQVKEVERGRVSDYAKRRGSHVRYIDSSSSSVWEVPCDIALPCATQNELTGRDAITLVRNGVGAVAEGANMPTTPEGIRVFAEAGVAFAPGKAANAGGVATSALEMQQNASRDSWSFEYTEKRLAEIMRHIHDTCYETAERYGRPGDYVAGANIAAFEIVAEAMLAQGLI

SEQ ID NO: 17651 - protein, 430 aa, Thermus thermophilus
MDRRRFFRILGAGGLLGLLKAKAQGLPWTEETFAPTKTLGAPLAEYGERSPFETGVVRYISPNLRTRHSGASFAPLEKLEGVITPNGLHFERHHAGAPQVDPRHYRLVIHGMVERPLVLTLEDLKRFPSVTRTYFIECAGNGQNGYRNPPDPELTATRSRGLASNASWTGVPLALLLKEAGVKPGARWLIPEGMDAAMYTRSLPLEKAMEDVLVAYAQNGEALRPEQGYPVRLVVPGWEGSIQVKWLRRILVTDLPAMAKDETSEYTDVTADGRVLAFTWVMEPQSIITYPSGGQRVQPGFHEIRGLAWSGFGRIAKVEVSFDEGRTWRKAVLEPPVEPYAFVRFKLPWYWDGKEVVLWSRAWDEKGNTQPTREEFFRRWSRNNRYHYNAIQAWRILPDGRVVNGDRPLGQGAFGPVGPVGGCGGEVLDV

SEQ ID NO: 17652 - protein, 327 aa, Arabidopsis thaliana
MGRQPCCDKVGLKKGPWTIEEDKKLINFILTNGHCCWRALPKLSGLLRCGKSCRLRWINYLRPDLKRGLLSEYEEQKVINLHAQLGNRWSKIASHLPGRTDNEIKNHWNTHIKKKLRKMGIDPLTHKPLSEQEASQQAQGRKKSLVPHDDKNPKQDQQTKDEQEQHQLEQALEKNNTSVSGDGFCIDEVPLLNPHEILIDISSSHHHHSNDDNVNINTSKFTSPSSSSSSTSSCISSVVPGDEFSKFFDEMEILDLKWLSSDDSLGDDISKDGKFNNSTVDTMNLWDINDLSSLDMFMNEHDDGFIGNGNGCSRMVLDQDSWTFDLL

SEQ ID NO: 17653 - protein, 344 aa, Scopolia parviflora
MATLVSNWSSNNVSESFIAPLEKRAEKDVPLGNDVPMIDLQQEHHLVVQQITKACQDFGLFQVINHGFPEKLMAETMKVCKEFFALPAEEKEKLQPKGEPAKFELPLEQKAKLYIEGEQLSNEEFFYWKDTLAHGCHPLDEKLVNSWPEKPATYREVVAKYSVEVRKLTMRMLDYICEGLELKLGYFDNELSQIQMMLTNYYPPCPDPSSTLGSGGHYDGNLITLLQQDLPGLQQLIVKDGNWIAVEPNPTAFVINLGLTLKVITNEKFEGSIHRVVADPTRDRVSIATLIGPDYSCTIEPGKELLSQDNPPLYKPYPYTEFAEIYLSDKSGYMLVLSHIKSNA

SEQ ID NO: 17654 - protein, 710 aa, Streptococcus pyogenes
MSKQTFTTTFAGNPLVVEVGQVAKQANGATVVRYGESTVLTAAVMSKKMATGDFFPLQVNYEEKMYAAGKFPGGFMKREGRPSTDATLTARLIDRPIRPMFAEGFRNEVQVTNTVLSYDENASAPMAAMFGSSLALSISDIPFNGPIAGVQVGYIDGEFIINPDKEQMEASLLELTVAGSKEAINMVESGAKELSEDIMLEALLKGHQAIQELIAFQEQIVAVVGKEKAEVELLQVDADLQADIVAKYNAQLQKAVQVEEKKAREAATEAVKEMVKAEYEERYAEDENLATIMRDVAEILEQMEHAEVRRLITEDKIRPDGRKIDEIRPLDAVVDFLPKVHGSGLFTRGQTQALSILTLAPMGETQIIDGLAPEYKKRFLHHYNFPQYSVGETGRYGAAGRREIGHGALGERALEQVLPSLEEFPYAIRLVAEVLESNGSSSQASICAGTLALMAGGVPIKAPVAGIAMGLISDGTNYTVLTDIQGLEDHFGDMDFKVAGTREGITALQMDIKIAGITPQILEEALAQAKKARFEILDVIEATIAEPRPELAPTAPKIDTIKIDVDKIKVVIGKGGETIDKIIAETGVKIDIDDEGNVSIYSSDQAAINRTKEIIAGLVREAKVGEVYHAKVVRIEKFGAFVNLFDKTDALVHISEIAWTRTTNVSDVLEVGEDVDVKVIKIDEKGRVDASMKALIPRPPKPEKKEEKHD

SEQ ID NO: 17655 - protein, 359 aa, Scopolia parviflora
MAFRNGSTNTTINHLNGASTIPKNGSTTTTINHLNGASTIPKNGNNITTTLLKNGSPHEFGCIKPGWFSEFSELWPGEAFSLKIEKLLFQGKSDYQDVMLFESATYGKVLTLDGAIQHTENGGFLHIEMIVHLPLGSIPSPKKVLIIGGGIGFTLFEVLRYPTIEKIDIVEIDDVVVDVSRKFFPYLAAGFDDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPQVDFRNPVNPIDKKPSHIKSKGPLKFYNADIHKAAFILPSFARNLMEKEIFSIV

SEQ ID NO: 17656 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17657 - protein, 716 aa, Mycobacterium avium
MTSAKAAAPTPTGEVWPGKAYPLGASYDGAGTNFAVFSEVAERVELCLFDGDGTESRVALPEVDGFVWHAYIPGIEPGQRYGYRVHGPYDPAAGQRCNPNKLLLDPYSKAIDGTFEWNQSLFGYNFGDPDSRNDDDSAPSMPKSVVINPYFDWGNDRPPDHHYADTVVYEAHVKGLTQTHPDIPEQMRGSYGAVAHPVIIEHLQSIGVTAIELMPVHHFANDSTLIDKGLSNYWGYNTIGFFAPDTKYSSAATPGGQVQEFKAMVRSLHEAGIEVILDVVYNHTAEGNHLGPTLSMRGIDNAAYYRLVDDDKRYYMDYTGTGNSLNVGHPHALQLIMDSLRYWVTEMHVDGFRFDLAATLAREFYDVDRLATFFELVQQDPTVSQVKLIAEPWDVGPGGYQVGNFPPQWTEWNGKYRDTVRDFWRGEPATLDEFAYRLSGSADLYEHTGRRPVASINFVTAHDGFTLRDLVSYNEKHNEANGEDNNDGESHNRSWNCGAEGPTDDEQVNALRARQQRNFLTTLLLSQGVPMICHGDELGRTQNGNNNGYCQDNELTWIDWANADVDLLAFTRVVSALRAEHAVFRRRRFFSGKPVGRRGQDGLRDIAWFTPDGTEMTDEDWGANFAKSVTVFLNGHGIPDRDARGQRLLDDSFLLCFNAHHESIEFTLPPKEFGASWQVVVYTGPEETTPADEVPGAGVLNVDAHTAVVLRAPDGG

SEQ ID NO: 17658 - protein, 112 aa, Xylella fastidiosa
MKLITAIIRPFKLDEVREALSQVGVSGITVTEVKGFGQQKGHTELYRGTEYVIDFLPKIKIETVVTDERLDSVIEAIRIAAVTGKIGDGKIFVTKIEQVVRIRTGEIDIDAL

SEQ ID NO: 17659 - protein, 389 aa, Xylella fastidiosa
KVGALPIIGAPSLTASLQRWAETGRITWRQGTFEDSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLVGPLQRLLRKQRHAEAEAVLEAALAETPPTESGSVTLVGAGAGDAGLLTLNALRALNEADIILYDRLVSDTVLQMARRDAEQIEVGKSATGHSVRQEDIHTLMLQHARAGQRVVRLKGGDPFVFGRGGEELEFLRTHGIPYEVIPGITAALACAAYAGIPLTHRDHTQSLCLITAHCQSSLDTLNWVALAQERQTLAFYMGVAGLPTIQQRLCEAGRAETTPFALIENGARAQQRVL

SEQ ID NO: 17660 - protein, 82 aa, Rickettsiella grylli
MAKEDQVVMEGTVIETLPNTLFKVELENGHIINAHISGRMRKSYIRVLTGDKVKVEITPYDLSKGRIIFRGKGADPEKSKPN

SEQ ID NO: 17661 - protein, 239 aa, Prochlorococcus marinus
MNNKEQDNYSNATLELIKKFVDSNQRKRINSLTQIESEVENIFNLGPSLFDMFDREGDDWAAGWILQVLKKFKPEFFENSKFNNWFNTYSDIDINYEDLQLMLVEQKFEDADRLTSSYLRKLAGKLAEKRGYVFYSEVKNMSGKDLETMDRLWTIYSTGRFGFSIQAKILKSVGKKYELMWPKIGWKKEGLWTRYPGSFCWSLDAPDGHMPLINQLRGVRLMDSILRHPAISKRHNNIL

SEQ ID NO: 17662 - protein, 159 aa, Streptomyces coelicolor
MATPDFIRDLRASAGHQLLWLPGVTAVVFDDEGRVLLGRRSDNGRWSLIGGIPEPGEQPAACAVREVEEETAVQCVVERLVLVQALKPVTYDNGDVCQFMDITFRCRAVGGEARVNDDESLEVGWFEVDALPDIKEFGQTRVKQALSDAPTWFEPTGSF

SEQ ID NO: 17663 - protein, 586 aa, Oryza sativa
MCGILAVLGAADWLKHRGPDWSGLYQCEGNFLAQQRLAIVSPLSGDQPLYNADRTIVVVANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQGDGAVGPEHRVQHAGGDRVGGAVEGVARPIRPLIASHNSASASANHTNHANANANGNSNGKANGNCAMAANGTNGVGLVVANGTANGKMEA

SEQ ID NO: 17664 - protein, 423 aa, Prochlorococcus marinus
MNILQNLKESDPVISNFIKSEKNRQETHLELIASENFASIAVMEAQGSVLTNKYAEGLPQKRYYGGCEFVDQIEELAIQRAKKLFNANWANVQPHSGAQANAAVFLSLLKPGDTIMGMDLSHGGHLTHGSPVNMSGKWFNAVHYGVNKETSELNFDEIREIALETKPKLIICGYSAYPRTIDFESFRNIADEVGAFLMADIAHIAGLVASKLHPNPIPYCDVVTTTTHKTLRGPRGGLILCKDAEFGKKFDKSVFPGTQGGPLEHIIAAKAVAFGEALQPDFVNYSQQVIKNAKVLASTLINRGIDIVSGGTDNHIVLLDLRSINMTGKIADLLVSEVNITANKNTVPFDPESPFVTSGLRLGTAALTTRGFNENAFAEVGEIIADRLLNPDDSLIESQCKERVLTLCNRFPLYESKLEASIK

SEQ ID NO: 17665 - protein, 237 aa, Hyacinthus orientalis
TAVKLTPSSSGVSGDGRFTMRKTVAKPKTVSSGSPWYGPDRVKYLGPFSGEAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWATQVVLMGAVEGYRVAGGPLGEVVDPLYPGGSFDPLGLADDPKAFAELKVNEDQEWQAGYVLDVRVLCSRDRDGPRGPLEELGPITFAR

SEQ ID NO: 17666 - protein, 197 aa, Mesorhizobium ciceri
EFAEFPELEQLPLWGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLLQRLTEKYGIDIEYHCKPLGDTDW

SEQ ID NO: 17667 - protein, 288 aa, Raphanus sativus
DEFMNEVTLIARLQHINLVQILGCCIDADEKILIYEYLENLSLDSYLFGKTQSPKLNWKERFDITSGVARGLLYLHQDSRFRIIHRDLKVSNILLDKNMIPKISDFGMARIFARDETEASTMKVVGTYGYMSPEYAMNGIFSEKSDVFSFGVIVLEIVTGTRNRGFYNLNYKNNFLSYAWSNWREGRALEIVDPVILDSLSPLTLTFQRQEVLKCIQIGLLCVQELAEDRPTMSTVVWMLGSEATEIPQPKPPDYCVGKSPYETASKQLDDDESWTVNQYTCSVIDAR

SEQ ID NO: 17668 - protein, 353 aa, Solanum prinophyllum
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFTFSDFPLLNLPDEFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 17669 - protein, 241 aa, Bartonella quintana
MKKTKKTPTGGYGGSGSHKLYQRVKKKAGTIKASSRRWLERHLNDPYVHQSKVDGYRSRAAYKLIEMNERYKFLKKGQKIIDLGAAPGGWCQVAQRIVGSSDEKPSVVGIDYLPVVPLPGVIMLEMDFLHTDAPQKLIDALGTKPDVVLSDMAAPTTGHRQTDYLRTTYLCEVAADFALSVLKSGGHFLVKAFQGGAENTLLTTLKQNFKTVHHVKPPASRTESVELYLLALEFKAKTEVK

SEQ ID NO: 17670 - protein, 198 aa, Unknown
  Mesorhizobium sp. WSM1283
EFAEFPELEQLPLWGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLLQRLTEKYGIDIEYHCKPLGDTDWN

SEQ ID NO: 17671 - protein, 288 aa, Raphanus sativus
DEFMNEVTLIARLQHINLVQIIGCCIEADEKILIYEYLENLSLDSYLFGKTQRPKLNWKERFNITNGVARGLLYLHQDSRFRIIHRDLKVSNILLDKNMTPKISDFGMARTFTRDETEANTMKVVGTYGYMSPEYAMYGKFSEKSDVFSFGVIVLEIVSGKKNRGFNYGNNLLSYAWSHWKEGRALGIVDPVIIDSLPSLPLKFGQEEVLKCIQIGLLCVQELAEDRPTMSSVVWMLGSEATEIPQPKPPCHCFERSPYELDPSLSRQCYDDESWTVNQYTCSLIDAR

SEQ ID NO: 17672 - protein, 375 aa, Xylella fastidiosa
IGAPSLTTSLQRWAETGRITWRQGTFEDSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLAGPLQRLLRKQRHAEAEAVLEAALAETPLTESGSVTLVGAGAGDAGLLTLNALRALNEADIILYDRLVSDTVLQMARRDAEQIEVGKSATGHSVRQEDIHTLMLQHAHAGQRVVRLKGGDPFVFGRGGEELEFLRTHGIPYEVIPGITAALACAAYAGIPLTHRDHAQSLCLITAHCQSSLDTLDWAALAQERQTLTFYMGVAGLPTIQQRLCEAGRAETTPFALIENGA

SEQ ID NO: 17673 - protein, 1798 aa, Oryza sativa
MAASGFLLRCPAAPSAVPLWGRSGRGGGGGLAFSASSSNGAAVPSSLSDSEKKGPVVMEIPLDKIRRPLMRTRANDPAKVQELMDSIRVIGLQVPIDVLEVDGVYYGFSGCHRYEAHQRLGLPTIRCKVRRGTKETLSILRKQNRLEAREGKNHSAQGSGFSTRADSSTRERRGDGDGGGGGGREVGADGGGGGGGGDGGGGGGSDGRRGGRGRSWSAAAGGGGEWRRGKERGARQRGGAYGVEEEASPPPPAADARGGGEPRHLEGGQGQREGERRRRRRRGVSPLPLRGFFEKKLFGLPGYAATFIKKIRVGMLLFVFELGERKLYGVFEATSNGALDILPNAFTSLRKPRPAQVLNLVHLFASKRIELQPYQKPKSRVIYDYKISLAHLGREFSPRTHNKTFSSHSSSTFCNNRFSLPRSSYLYTKQNAKHDACKYESPLHSPLKSVIFKAPDVKGESLEPNPDYIPLELDDSKSDSDADPSDSLETVSFYPTLEGCISYEDQDLKPFNGKFNGDDGHHSHVLIRGLNSECETDRNSVFSRNVKERQSSLAKGGKGCKRKAIVEFDEQSSPRRGCTMKRVSFSFSGEEISVTSEKSLHRPTAFAELPNTRESSAEEGKQEVGCVVQKARSKGEDVSAKIKLMGLSLPEALRTNRVHSCSSNSQSLVTQTAALLLLFTIFKSQLSSEKIKRSEESKRRRRRNHQETKPSRTPPPPVDNLAAALHDQTRRRLHCLVCRGSCGGKPPQIVLGREFVFRLSWALNPCKNPRTRDTANIVKVKVGATLFLYDTDQHKLHGVFEATSDGSMNIIPDAYVSSGKRYPCQIRFKRIWFCKPLMESELHDAIQNNFTSKNKLRYGLSHQQVVRLLHLFSSRNRLQPRQNQNLQDELPKESEMSSLVNQTDIQSSSNSSSHGSFKSPCQTCSSSTHGERAATLSHKLADPMPLMHRGLKPYTSGAVKSKDSSRFPLHIGANTDIVTVPVSQEAMDDRSSDDYIPLPQEENTLEGIDDLSDLLEDESYSSESQGTIDSEEHGTFHQACAIKEDECYPPVVNFKLRSDSEGRSSVFSRLLGKPRTLGPRKKSSAKAFPSMSSGHLPQRKKQWRKKQSKPFPCDRDGVLGTHQANKLRRIPALDYSFVWDDGSRSTNSFGRKPSDIQTSLELCEHGNKWDMCTKEHSRSNEFKRLFVPEAIRKLIRPYDKELSIPPVFPGVHDGNEVNSKEEVNDSSLDLKRRGKDDQDFGDENDNVEEATWKKRRLADASFSQEEYLSGGVLVPKGTEDMDMLAISDGNCKDKSICLSPRDTCAEMARACLQTKVVLQDEQQKNIQDCCEEVAGVTSLILEHSESMDLLPKRNCRNMKTCLNIETKSQVASGNLETRSSLEDTQKQSVRSCHGVINGDKILLMENFETMDVLPNHDEDCLAKSTFVRNDSNHLETEMPMQEKQSPSVQNCCEALHGDNMLIQEKSENMLYKIDADSDCGKKKSVSFDKAYSNVAGSSLETHVPMQEPLRIASSCCEIVNADQVCAGEVGKNSFSLDENGGYVTCPCNTTWALENAMAMDTVESIHGDIGNNSNNSAACRSMGSDYMEEVHQLVTNCSEISAAIPESSGTLNNFAKCCGDSANKNSLLDQTSENVSTDHQEVSMLPQDQHYHSCSGDTSSALEYSDTNAGDGDSEHRNSFDQKGGESMYPVTGVLLQAEQHQKLQGEPESSSSHEISNSGSFVVCAEDSRSKSGLSADRMVTDLETNSESRTGFFNTSSSECGENFSASASSSENAQQKLSGSAVSAEVARLQHDPGE

SEQ ID NO: 17674 - protein, 223 aa, Triticum aestivum
  misc_feature (160)..(160): Xaa can be any naturally occurring amino acid
  misc_feature (178)..(178): Xaa can be any naturally occurring amino acid
MSSCVSSSHHHCARRLPAPTPRAHLAAAELCASPHRRRVGSLRAVRAEPPSSVAPAGGRKAAAVQAEMVEAAAMWCAMHGLVVGDRGDLRSGTVPGVGLVHAPFSLLPTRFPASFWKQACELAPIFNELVDRVSLDGKFLQGSLSRTKQVDDFTARLLEXHAKMMAVNKKEVINCVCXDIRLGLHRSDYMLDSETNSLLQLSSHHLTSFLGKLSVSELTDLLI

SEQ ID NO: 17675 - protein, 353 aa, Solanum ptychanthum
DAWDTSVAVEVKVGDTIEIVRFFHCYKRGVDRVFVDHPMFLEKVWGKTRSKIYGPKAGQDYLDNELRFSLLCQAALEAPRVLNLNCSTYFSGPYGEDVLFIANDWHTALIPCYLKSMYQSRGIYLNAKVAFCIHNIAYQGRFAFSDFPLLNLPDEFRGSFDFIDGYEKPVKGRKINWMKAGILESHRVVTVSPYYAQELVSAVDKGVELDNVLRKTCITGIVNGMDTQEWNPATDKYTDVKYDITTVMDAKPLLKEALQAAVGLPVDRKIPLIGFIGRLEEQKGSDILVAAIHKFIGLDVQIVVLGTGKKEFEEEIEQLEVLYPNKAKGVAKFNVPLAHMITAGADFMLVPSR

SEQ ID NO: 17676 - protein, 220 aa, Burkholderia thailandensis
MAKNRFNQSWLHDHINDPYVKMAQREGYRARAAYKLKEIDEQDKLIRPGQVIVDLGAAPGSWSQYARNKLAQGRRRDAVREGGIDGTIIALDMLPMEPIADVHFIQGDFREETVLHQLEEVLAGRSVDLVISDMAPNLSGVAVADAARIEHVCDLALEFAQNHLKPDGALLVKCFHGSGYSQIVEKFKHQFKTVAPRKPKASRDKSSETFILGRHLKLPR

SEQ ID NO: 17677 - protein, 291 aa, Raphanus sativus
DEFMNEVTLVARLQHVNLVQILGCCIDADEKMLIYEYLENLSLDSYLFGENRRSKLNWKERFDITNGVARGLLYLHQDSRFRIIHRDLKVSNILLDKNMTPKISDFGMARIFAREETEANTMKVVGTYGYMSPEYAMHGIFSEKSDVFSFGVIILEIITGKRNRGFYNLNYENDLLSYAWSNWKEGRALEIVDPVIIDSFSPLSSTYQPQEVLKCIQIGLLCVQDLAENRPTMSFVVWMLGNEATEIPQPKWPGYCVRRSPYELDPSSSRQCDDDESWTVNQYTCSVIDAR

SEQ ID NO: 17678 - protein, 412 aa, Bartonella quintana
MKDMGQKARHAAALLAVMSSEQKNKALEMIALSLEAQSAEILQANHQDLVNAAQNNLNVAMVDRLKLDKVRLCTIIDSVRQVACLPDPVGQVMSEWTRPNGLHIRRVRTPLGVIGIIYESRPSVTIDASILCLKSGNAAILRGGSDSFHSAHALHSALVKGLKEAGLPQDAIQMVGTKDRDVVGEMLKGLDGAIDVIVPRGGKDLVARVQSDARVPIFAHLEGLCHIYIDQSADLDMARNIVLNAKLRRTGICGAVETVLIDRQALKKFLPVLTALQEKGCEIRATEDIVFLLPDVKLASEEDWSQEYLDAILSVKTVEGIEGAIAHIRRYSSGHTESIIAEDMKVVKIFFNCLDSAILLHNASTQFADGGEFGFGAEIGIATGKMHARGPVGVEQLTSFQYHVKGNGQVRS

SEQ ID NO: 17679 - protein, 463 aa, Bacillus thuringiensis
MENTLVKSLYRDTDKYAGQTVQVSGWIRNLRDSKAFGFIELNDGSFFKSVQIVFDTELDNFKEIAKLPLSSSVKVEGKVIATPGAKQPFEIKAEKIDIEGLSDSDYPLQKKRHTFEYLRTIAHLRPRTNAFSATFRVRSIAAFAIHQFFQERGFVHVHTPIITGSDTEGAGEMFRVTTQDLNNVPKDEDGQVDESKDFFGKETNLTVSGQLNAEAYALAFRDVYTFGPTFRAENSNTTRHAAEFWMVEPEIAFAELGDVMNLTEDMLKYAMKYVLEHAPEEMEFFNSFVDKTVLERMNNVINSDFGRITYTEAIKVLQESGADFKYPVEWGIDLQTEHERYLSEEIFKRPVFVTDYPKDIKAFYMRLNDDGKTVAATDLLVPGIGELIGGSQREERMDVLVDRIKELGMNEEDYWWYLELRKYGGTKHAGFGLGFERFLMYITGMANIRDVIPFPRTPGSSEF

SEQ ID NO: 17680 - protein, 445 aa, Escherichia coli
AVMGRNLALNIESRGYTVSVFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAEDPQIANLLLAPYFKQIADDYQQALRDVVAYAVQNGIPVPTFAAAVAYYDSYRAAVLPANLIQAQRDYFGAHTYKRI

SEQ ID NO: 17681 - protein, 196 aa, Unknown
  Mesorhizobium sp. WSM2073
FAEFPTLEQLPLWGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLMQRLTEKYGIDIEYHCKPLGDTDW

SEQ ID NO: 17682 - protein, 509 aa, Vicia faba
MLQRSRTLPSKIYQGVIEERKDGRHYIELEPLPKMETETKPITIQSKCLDDDGRVKRTGTFWTASAHIITAVIGSGVLSLSWAIAQLGWAVGPVVMVLFAVVNLYTSTLLTQCYRSDDSVAGPRNYTYTDAVKSILGGKKFKICGVIQYVNLFGVAIGYTIAASVSMMAIKRSNCYHESHGNDPCHMSSNVYMIAFGIAEVILSQIPDFDQVWWLSIVAAIMSFTYSAVGLGLGVAKVAENGTFHGRLMGISIGTVTPAGTVTGTQKVWRSLQALGAMAFAYSFSIILIEIQDTIKSPPAEHKTMKKATMLSIMVTTVFYILCGSMGYAAFGDHVPGNLLTGFGFYNPYWLLDIANFAIVVHLVGAYQVFSQPFFAFVEKWSAHKWPKNKFVTEEYDIPIPCIGVYKLNLFRLIWRTIFVLLTTLIAMLLPFFNDVVGLLGAFGFWPLTVYFPIDMYISQKKIGRWTNRWLGLQMLSGCCLIISTLAAVGSIAGVVLDLKTYKPFKTSY

SEQ ID NO: 17683 - protein, 252 aa, Zea mays
MISPDTIRTAIGVIGNGTALVLFLSPVPTFIRIWKKGSVEQYSPIPYVATLLNCMMWVLYGLPAVHPHSMLVITINGTGMAIQLTYVALFLLYSAGAARRKVVLLLAAEVGFVGAVAALVLSLAHTHERRSMVVGILCVLFGTGMYAAPLSVMKMVIQTKSVEYMPLFLSLASLVNGICWTAYALIRFDLYITIPNGLGVLFAVAQLVLYAIYYKSTQEIIEARKRKADQIAMTGVVVDGGKTNNQAGAGQY

SEQ ID NO: 17684 - protein, 110 aa, Oryza sativa
  misc_feature (91)..(91): Xaa can be any naturally occurring amino acid
MAGKLYQLMSRMHLARSRSSSSSAATAAAAAADVPRGHFAVYVGERRKRFVIPTAYLKHPSFVLLLKRVEEEFGFDCHRCGGLTIPCATEXGDFASFVAEAIASDDHHHH

SEQ ID NO: 17685 - protein, 245 aa, Triticum aestivum
MGSEASGGAAAIDLLRSAAPFLPDADLLLTPGTGLVLVDLVNGFCTVGAGNLAPVTPNKQIEKMVEESTRLAKVFCQRNWPVFAFLDTHHPDKPEPPFPPHCIIGSGEENFVPALEWLENDPNVTMRRKDCIDGYLASFEKDGSNVFSEWVAKFQIKTVLVVGICTDYCVLDFVSSTLAARNIGRVPPLEDVVIYSEGCATFDLPVEVARSMKGALAHPQDLMHHMGLYMAKSRGAKIVDGILEE

SEQ ID NO: 17686 - protein, 252 aa, Unknown
  Synechococcus sp. WH 8102
MTHPVCFVGGGPGAADLLTLRAAERIRQADVLIWTDSLVCPQITALAPDHCERIRTSTLTLEEVIPLLIDRQRQGAKVVRLHDGDTAFYSAINEQICALNDADIPVEVVPGVSAYQAAAAGLSSELTIPGVVQTIVLGRAGGRTGVPPSEELDRLAGLGASLCLYLSARHIDDVQATLQRHYPDDTPVAIAYRVSWPDEWMSVVPLAQMAAASKERQLIRTTLYIISPALNGGQQRSRLYSPDHDHLFRQRH

SEQ ID NO: 17687 - protein, 146 aa, Unknown
  Marinobacter sp. ELB17
MQYLHTMIRVSNLDDTLHFFCDLLGMKEVSRKDSEKGRFTLVFLASRDDEERVKADRAPSLELTYNWDPEEYSGGRNFGHLAYRVDDIYQLCEHLQTGGVTINRPPRDGYMAFVRSPDGISIELLQKGEALAPREPWASMENSGSW

SEQ ID NO: 17688 - protein, 631 aa, Methanosarcina acetivorans
MTNERVMQLIREAYEKNLTTLDLSENQLTQLPSEITELKNLTTLNLSGNQLTQLPSEIGELKSLTSFDLSVNQLTQLPPEIGELKNLTILNVYRNQLIQLLPEITELKNLTTLDLSLNKLTQLPPEIGELNNLKTLYSSSNQLTQLPLEITKLKNLTELYLSSNLMIRLPLEITELKNLTTLNVYRNQLIQLPSKITELKNLKKLDLSRNQLAQLPPEIAELKNLTTLDLSRNQLAQLPPEIAELKNLTTLDLFENPLISLPPEIVSQGVKAIFTYLKQSKTTENNEAKLIVVGDGKVGKTCLAYRLINDEFLEDVQITEGINISKWEIPAPYSENRKIKLNIWDFGGQEIYHSTHQFFLTNRSVYLLVWNARITKDYTNIYYWLHTLEAFGEDSPIILVMSKMNESDDDLNLKDLKSKFLQIAGYVKIDSKDGKGISNLKEIICETVWNLPLMRVKWVDSWYEVRNELEGIGDNLILYDEFCEICRSRGLDAENIDILDGYLHDLGIILHFKDRIGLKNIVILKPEWATGAFYKILSAKSVLHNEGVLLQNELDRIWDKETYPSAVHSQLMELMNKFELAYELPDKKRYLIPELLPKNEPDYDWDDEENLYFYYSYDSFLPSGIITRTHA

SEQ ID NO: 17689 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNCELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRT

SEQ ID NO: 17690 - protein, 270 aa, Ginkgo biloba
MATMASAGVASSAFAGQIVLKPQNEFVGGVHGEGRITMRKTASKKVVASSGSPWYGPDRVKYLGPFSGEAPSYLTGEFPGDYGWDTAGLSADPETFAKNRELEVIHSRWAMLGALGCVFPELLSRNGVKFGEAVWFKAGSQIFSDGGLDYLGNPSLIHAQSILAIWACQVILMGAVEGYRIAGGPLGEITDPIYPGGSFDPLGLADDPDAFAELKVKELKNGRLAMFSMFGFFVQAIVTGKGPIENLADHLADPVNNNAWAFATNFVPGK

SEQ ID NO: 17691 - protein, 266 aa, Unknown
  Rosa hybrid cultivar
FIAFIVQCGMTHLLNGWTYGPHPFQLMLALTVFKILTALVSCATAITLITLIPLLLKVKVREFMLKKKTWDLGREVGIIMRQKEAGMHVRMLTQEIRKSLDRHTILSTTLFELSETLGLQYCAVWMPNEIKTEMILTHELKGRNYSNMYNFSIPIGDPDVALIKGSDGVNILGPDSILVSGSSGDFGEPGPVAAIRMPMLRVSNFKGGTPEFIQTCYAILVLVLAGGQPRSWSSQELEIIKVVADQVAVALSHAAILEESQLMREK

SEQ ID NO: 17692 - protein, 445 aa, Salmonella enterica
AVMGRNLALNIESRGYTVSVFNRSREKTEEVIAENPGKKLVPYYTVKEFVESLETPRRILLMVKAGAGTDATIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASEEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRT

SEQ ID NO: 17693 - protein, 402 aa, Oryza sativa
MGKHEFLTPKAIANRIKAKGLQKLRWYCQMCQKQCRDENGFKCHCMSESHQRQMQVFGQAPDRVVEGFSEEFLDAFLTLLRRAHRHSRIAATVVYNEFIADRHHVHMNSTRWATLTEFVKFLGREGHCKVEDTPKGWFITYIDRDSEQAVKARLKRKRIKSDLAEDERQERMIARQIERAQQSMGKTNGELGDDASPDGSEGESGSEDEYSDSENDHEGQEEDAKEANKAAGKIAIALQRAVPGPKVNPLDDKPKVKFGFEEEDEVSARDKEKEELAKKKGKDAINAAEARRSALDELMKEEEKAKERSNRKDYWLCPGIVVKVMSKSLAEKGYCKQKGVVKRVIDKYVGEIEMLESKHVLRVDQDELETVIPQIGGLVEKGLYDGKVLKAIEYEDICKIFH

SEQ ID NO: 17694 - protein, 340 aa, Enterococcus faecalis
MKQKVAVLGPGSWGTALAQVLAENGHEVCIWGNKPEQIDEINTKHTNKHYLPELILPTSIQATTDLATALVDVDAVLFVVPTKAIRSVAQEVAQHLKTKPIIIHASKGLEQGTHKRISEVIAEEIPAEKRQGIVVLSGPSHAEEVAVHDITTITAASENLADAVYVQELFMNDYFRIYTNDDVIGVETGAALKNIIALGAGAIHGLGFGDNAKAAIMTRGLAEISRLGVAMGANPLTFIGLSGVGDLIVTCTSVHSRNWRAGNLLGKGHKLDEVLENMGMIVEGVSTTKAAYELAQQLEVEMPITETIYNVLYNDEDVQQAAKEIMLRDGKTENEFTLDF

SEQ ID NO: 17695 - protein, 352 aa, Unknown
  Bacillus sp. MB24
MKEILDSIVIGGGQSGLASGYHLQKKGLQFLILEASEQTAGSWPCYYDSLKLFSPARFSSLPGMKFPAHPNDYPTRNEVIDYLQNYVKKFQLPVMTNQRVVSVEREDEIFKVQTVSGKTFLTRTIINATGSFHSPFNPIIKDQEKFKGNIIHSAMYRSPNHYINQRVVVVGRRNSAVQIALELADVSRVSLAVRKPVQLMKQKVWGKDLHFWLKVLGMDTFPFWRFGKTAPSSGGVIDLGDYKERLARGNPDQKPMFTSFYADGVVWPDGKKEPIDTVIFATGYHPNLSYFNAIGALDSEGNPLQIGGVSTKVQGVYYVGLEGQRSFSSATLRGVGSDAKFVVRKLISYLKI

SEQ ID NO: 17696 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17697 - protein, 243 aa, Solanum lycopersicum
KRLMTDVPFGVLLSGGLDSSLVASVTARYLAGTKAAKQWGAQLHSFCVGLEGSPDLKAAKEVADFLGTVHHEFHFTVQDGIDAIEDVIYHIETYDVTTIRASTPMFLMSRKIKSLGVKMVISGEGADEIFGGYLYFHKAPNKEEFHRETCRKIKALHQYDCLRANKATSAWGLEARVPFLDKEFINVAMSIDPEWKMIKHDQGRIEKWVLRKAFDDEEQPYLPKHILYRQKEQFSDGVGYSWI

SEQ ID NO: 17698 - protein, 378 aa, Unknown
  marine gamma proteobacterium HTCC2143
MSKRDYYEILGVARDSAGKDIKKAYRRVAMKFHPDRNPDDKDSEEKFKEASEAYEVLSDSQKRAAYDQYGHDAVNGNAGAGGFGGGNGNFGDIFGDVFGDIFGGGGGGGGRSRGPARGSDLRYNLDVDLEAAVKGTEVKIRIPTLVSCEPCSGSGAKKGSAPVTCTTCGGIGQVRMQQGFFSVQQACPNCRGKGKMISDPCNSCHGQGLKEETKTLSVKVPPGVDTGDRIRLSGEGEAGPDGGPSGDLFVQINVRSHSIFERDGKNLYCEVPISITDASLGGELEVPTLDGRVKLKIPEETQTGKLFRLRGKGVAPVRGGSTGDLLCRVVLETPVNLTKSQKDLLQQLQESFEKEGNQSPKKSSWFAGVKSFFDDMKV

SEQ ID NO: 17699 - protein, 445 aa, Salmonella enterica
AVMGRNLALNIESHGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPASDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 17700 - protein, 459 aa, Nocardia farcinica
MYLPRTAVIGAGISGLTAGKMLTDYGVPYVCFESSDRIGGNWAFGNPNGHSSAYRSLHIDTSKHQLSFRDFPMSADYPDFPHHTQIKAYLDDYCAAFGLAEHIEFGNAVEHARRLPGGGWELTTGRGETRRFDLLVVANGHHWDPRYPDFPGEFGGTVLHAHHYIDPWTPLDFTGKRILVVGLGNSAADIAVELSAKALGNTLTLSTRSGAWIVPKYIAGRPADKYYRTSPYLPLSWQRKIAQWGQPLTAGRPESYGLPTPNHKFFEAHPTQSVELPLRLGSGDVVAKPDIARLDGHTVHFVDGTSGEFDIVVYATGYNITFPFFDPEFISAPDNRIDLYKRMFAPGVEDLVFAGFAQATPTLFPFVEAQARLIGAYAVGRYRLPSPDRMRRVIAEDQQRYTGHMLDRPRHTQQVDYFLYEHDLRVRELPAGADRARRQGPPPWARVAEDDAVAAGGAR

SEQ ID NO: 17701 - protein, 291 aa, Raphanus sativus
DEFMNEVRLVARLQHINLVRILGCCIDADEKMLIYEYLENSSLDSFLFGKKRSSNLNWKDRFDITNGVARGLLYLHQDSRFRIIHRDMKVSNILLDKNMIPKISDFGMARIFAREETEANTKKVVGTYGYMSPEYAMNGIFSEKSDVFSFGVIVLEIVSGKRSRGFYNLNHENNLLSYAWSHWTEGTALEIVDPIIIDSSSSLPSTFQKKEALKCIQIGLLCVQERAEHRPTMSSVVWMLGSEATEIPKPNPPGYYVGRCSYENNPSSSRLCDDYESWTVNQYTCSVIDAR

SEQ ID NO: 17702 - protein, 281 aa, Xanthomonas oryzae
MGHACASTAQQRPFSCVLKRGTHVTTHRWRLDGQTALITGASAGIGLAIARELLGFGADLLMVARDADALAQARDELAEEFPQRELHGLAADVSDDEERRAILDWVEDHADGLHLLINNAGGNVSRAAIDYTEDEWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 17703 - protein, 112 aa, Hyphomonas neptunium
MKKIEAIIKPFKLDDVKEALQEIGLQGMTVIEAKGFGRQRGHTELYRGAEYVVDFLPKLKIEVVLPDSAVEGAVEAIKKAAHTDKIGDGKIFVSDVIDAVRIRTGETGDSAL

SEQ ID NO: 17704 - protein, 289 aa, Raphanus sativus
DEFMNEVTLVARLQHKNLVQILGCCIDANEKMLIYEYLENLSLDSYLFGKTRRPKLNWKERFDITNGVARGLLYLHQDSRFRIIHRDLKVSNILLDKNMIPKISDFGMARIFAREETEANTMNVVGTYGYMSPEYAMHGIFSEKSDVFSFGVIVLEIVTGKRNRGFNNLNYEHNLLNYAWSNWKEGRAIEIVDPDIVDSLSPLSSTFQPQVIKCIQIGLLCVQERAEHRPTMSSVVWMLGSEVTEIPQPKPPGYCVRSSYELDPSSSRQCDDDQSWTVNQYTCSVIDAR

SEQ ID NO: 17705 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLRAASEEYNWDLDYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 17706 - protein, 197 aa, Unknown
  Mesorhizobium sp. WSM2074
EFAEFPTLEQLPLWGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLMQRLTEKYGIDIEYHCKPLGDTDW

SEQ ID NO: 17707 - protein, 291 aa, Raphanus sativus
DEFMNEVRLIARLQHINLVRILGCCIDADEKLLIYEYLENSSLDSYLFGKKRSCKLNWKHRFDITNGVARGLLYLHQDSRFRIIHRDMKVSNILLDKNMIPKISDFGMARIFGRDTSEASTRNVVGTYGYMSPEYAMYGVFSEKSDVFSFGVIVLEIVSGKRSRGFYQLNNDNNLLSYAWSHWTEGRALEIVDPVIVDSLSSLPSTSQPKEVLKCIQIGLLCVQERAEHRPTMSSVVWMLGSEATEIPQPKPPVYRLAKSFYANNPSSSRHCEDNESWTVNQYTCSVIDAR

SEQ ID NO: 17708 - protein, 353 aa, Solanum repandum
DAWDTSVAIEVQVGDSIEIIRFFHCYKRGVDRVFVDHPMFLEKVWGKTGSKIYGPKAGQDYLDNELRFSLLCQAALEAPRVLNLNCSKFFSGPYGEDVLFIANDWHTALIPCYLKSMYQSRGIYLNAKVAFCIHNIAYQGRFAFSDFPLLNLPDEFRGSFDFIDGHETPVKGRKINWMKAGILESDRVVTVSPYYAQELVSAVDKGVELDNVLRKTSITGIVNGMDTQEWNPATDKYTDIKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 17709 - protein, 373 aa, Parvularcula bermudensis
MNQPPLSAPDATSADASALARARGRAPLTDIWYFAGLSSHFSAKQPQRMVLMGRPIVFARDPGGALFALADRCAHRAAPLSGGRIVDEDGTACLECPYHGWRFALSSGQCRKVPALSAEDPARADGIKVADYPIHEERGLVWIFIPAGRHSGDALPPPPALPPGVPGARPKMVITAQAEGPYDEAVIGLVDPAHTPFVHRQWFWRDPGEAAEKIKDYEPTAMGFRMKPHRPSRNGRAYRLIGGAATTEIEFRLPGLRFELIKNDRYTILGLTAITPLEHETAVITQMFFWDMPLLSLLKPLTLPLARRFLSQDGRILRLQNDNLQRQDVPMLYLGEPDRLAQWYLKLKRAYAEKDQGEAFINPLEPAVLRWRT

SEQ ID NO: 17710 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPKIANLLLAPYFKKIADDYQQALRDVVAYAVQNGIPVPTFSAAVAYYDSYRAAVLPANLIQAQCDYFGAHTYKRI

SEQ ID NO: 17711 - protein, 197 aa, Unknown
  Mesorhizobium sp. WSM2075
EFAEFPTLDQLPLWGFDGSSTMQAEGHSSDCVLKPVAVYPDPTRTNGVLVMCEVMMPDGVTPHASNKRATILDDEGAWFGFEQEYFFYKDGRPLGFPETGYPAPQGPYYTGVGYKNVGDVARQIVEEHLDLCLAAGINHEGINAEVAKGQWEFQIFGKGSKKAADQMWIARYLLLRLTEKYRIDIEFHCKPLGDTDW

SEQ ID NO: 17712 - protein, 453 aa, Rickettsiella grylli
MPFVPHTDVEIQEMLATLGVHTIDDLFDEIPPHLKTIEFSQIPSGFTEMELTQIIEKRSQENKKGLCFIGAGAYEHYIPAAVWEITSRGEFLTAYTPYQAEASQGSLQLIYEYQTMMARLTGMDYSNASLYDGATALAEAVLMAIRSNKKTHSIKILIPRTVHPHYRHTLQTIVTQQAIELIELDYCPEQGKILLSTLENDPKNDMCALVIPQPNFFGVLESVDELTDWAHSQNAFVIAVSNPLSLALLKEPGSWGTQGADIVCGEGQALGVPLAGGGPYFGFMCCKKPWLRQMPGRIVGRTRDKNNRPGFTLTLQAREQHIRRAKATSNICTNQGLLVTAATIYMSLLGSKGLQHVASLSHQRSRQLAALLTQLPEIEFIFNSPFFHEFVIRVPQPARDLLRELTTVGIHGGYDLSHHYPELGNALLVCATETKSQSDLKVYQHALLKLLSN

SEQ ID NO: 17713 - protein, 288 aa, Raphanus sativus
DEFMNEVRLIARLQHINLVRILGCCIDADEKMLIYEYLENSSLDYFLFGKKRSSNLNWKDRFAITNGVARGLVYLHQDSRFRIIHRDMKAGNILLDKNMIPKISDFGLARIIARDQTEASTDNPIGTYGYMSPEYAMYGILSEKTDVFSFGVIVLEIVTGKRNRGFYQSTPEDNLVCYAWTHWAQGRALEIVDPVIVDSLSSTFQPKEVLKCIQIGLLCIQERAVHRPTMSSVVWMLGSEATAIPQPKPPVYCLIPSFYANNPSSSRPSDNDESWTMNEYTCSVIDAR

SEQ ID NO: 17714 - protein, 406 aa, Bartonella quintana
MKNHELNPQFVQRGLILVFITLLLDVIGVAIISPILPEYFSQLTGKGVSASFADRGRLLVAYSVMQFLFAPVIGNFSDRYGRRPILLICIISFALDNFICAIAWSYAMLSIGCLLSGISGASFATRMAYIADISDDKTRTRNFGLLGIASGLGFILGSFIGGFLGQFGSRVPFYFATGFSLINFIFAWAMLPETLPMWNRRYLDIKRANPLGALLQLRQYPTVLWVLLVLFFYWLAEYIWPSLWAFIAKERYDWSPFSIGLSYSVFGIGQIIVVAFILPYFSKRWSNWCIVMVGLLFALVAMLGYTFATQGWMVYVVFVCTMFEYIVHAPLRAIASAQVPANAQGELQGAMASVVSLSSILGPIFYMLLFERFTHQDAVFYFPGAPFVGSFCVLVVTVIVFALRVR

SEQ ID NO: 17715 - protein, 142 aa, Zea mays
RDDELDEYGVVNNAIYASYLHSGRDVVLEKLGISVDYWTSTGNAMALSELNLKYFAPLRSGDRFVVKVKPVQIKGVRMIVEHMIEALPDRKLVMEGRATVVCLNKDFRPTRVFPELAARAKEVFSLPRLHKRRRLLLLRGVI

SEQ ID NO: 17716 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKEIADDYQQALRDVVAYAVQNGIPVPTFAAAVAYYDSYRAAVLPANLIQAQRDYFGAHTYKRI

SEQ ID NO: 17717 - protein, 242 aa, Shewanella oneidensis
MTTVSMRDMLQAGVHFGHQTRYWNPKMKPFIFGARNGVHIINLEHTVPMFNEALAFISNVASKKGKVLFVGTKRAAGEAIKEAAISCDQYYVDHRWLGGMLTNWKTVRQSIKRLKELESQSVDGTFDKLTKKEALMRTRELEKLEKSLGGIKNMGGLPDVLFVIGADHEHIAIKEANNLGIPVVAVVDTNSAPDGVNYIVPGNDDAMRAIRLYTTSVAAAANAGRGQDLAVQAEQDGFVEAE

SEQ ID NO: 17718 - protein, 257 aa, Burkholderia thailandensis
MGKVYLIGAGPGAADLITVRGARLLAEADVVLHDALIEPAMLDYARRARRIAVGKRCGQRSTAQHFINKQIVDAAREHAVVVRLKGGDPMLFGRADEEMRALEAAGIDYEVVPGITAALASAAALKRSLTLRGVARSVAFATKSRAPGSDEIREQVNADSLVYYMGRDSAPGIAQQLINAGRAGATPVAIVEACSTPRERMLTLTLAEMAAGAAQAWLDPAQPSLLMIGDAFAERAPQLADEASRDEPNRRGMRNAA

SEQ ID NO: 17719 - protein, 352 aa, Solanum rostratum
  misc_feature (299)..(299): Xaa can be any naturally occurring amino acid
AWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGHEKPVKGRKLNWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLNXQIVVLGTGKKKFEQEIEQLEVLYPNKAKGVAKFNVPLAHMITAGADFMLVPSR

SEQ ID NO: 17720 - protein, 656 aa, Unknown
  Polaromonas sp. JS666
MCGLAGYFSGQWPADGEQASARLKAMTDAIAHRGPDSDGYWLDAATCMALGHRRLAILELSAAGAQPMHAASGRYVIAYNGEIYNHLDLRADLQKSGQSPAWRGHSDTETLLAGFDAWGIQGAVERTVGMFAFAVWDRQERMLTLGRDRLGEKPLYYGWQGSGSSAVFLFGSELKALRAHPAFGAQINRDALCLYMRHNNVGGSHSIYQGIHKLPPGTLLTVSRQTPEPVIRPYWSGAEVARCGVAQPFGGTSGEAVDALEALLKDAVRQQMMADVPLGAFLSGGVDSSAVVALMQTQSLRPVKTFSIGFHEAAYNEAEHAKAVAQHLGTEHTELYVTPEQAMAVIPRLPTLYDEPFADSSQIPTFLVSQLARQHVTVSLSGDAGDELFGGYNRYQLTASLWRKLSAAPLPLRRAAAWGLTRFSPQSLNSLAALMPASARWAHMGDKLHKGAGVMAGRTVEDLYLGMVSDWHDPAAVVIGGREPATLLRGRRPDLPGLTDVERMMALDMLSYLPDDILTKVDRAAMGVSLETRVPFLDHRVVEFAWRLPLHYKLRQEGGRYTTKWALRQVLYRHVPQALIDRPKMGFGVPIDRWLRGPLRDWAEDLLSETRLKREGYFKPAPIRQKWAEHLGGQRNWAPHLWTALMFQAWLQANHA

SEQ ID NO: 17721 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPKIANLLLAPYFKKIADDYQQALRDVVAYAVQNGIPVPTFSAAVAYYDSYRAAVLPANLIQAQRDYFGAHTYKRI

SEQ ID NO: 17722 - protein, 353 aa, Solanum sandwicense
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDEFRGSFDFIDGLEKPVKGRKINWMKAGILESDRVVTVSPYYAQELVSAVDKGVELDNVLRKTSITGIVNGMDTQEWNPATDKYTDVKYDITIVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 17723 - protein, 317 aa, Bartonella quintana
MVQPHIRLLIVGSGPAGYTAAIYAARGMLEPVLVTGLQQGGQLTITTDVENYPGFADPIQGPWLMEQMAKQAENMGTKVVYDSIIKADLLKRPFILYGDSGTQYCCDALIIATGAQVRWLGLESEQTFMGGGVSACATCDGFFYRDKDVIVVGGGNTAVEEALYLSHLAKRVSIVHRRNHFRAEKILQDRLFACDNVRVIWDHVVEEIVGLPAHASMGAVVTGVRLKNIKTGQKIKVDTDGIFIAIGHDPAVSLFEGQLKQKPGGYLWTAPDSTATSIAGVFAAGDVVDNIFRQAITAAGMGCMAALEAERFLDLQI

SEQ ID NO: 17724 - protein, 276 aa, Zea mays
MATTTAAAASGIFGIRIQDPSSGAGRVQAKFNFSFGKKKPAPPPKKTKQIQNDGDRLVWFPGANPPEWLDGSMIGDRGFDPFGLGKPAEYLQYDFDGLDQNLAKNVAGGLLGVRQESKEINPTPFQPYTEVFGIERFRECELIHGRWAMLGTLGALAVEGLTGIAWQDAGKVELVEGSSYLGQPLPFSLTTLIWIEVLVVGYIEFQRNAELDPEKRIYPGGYFDPLGLGSDPEKLDTLKLAEIKHSRLAMIAFLIFSLQAAFTGKGPISFLATFSS

SEQ ID NO: 17725 - protein, 353 aa, Solanum schimperianum
DAWDTSVAIEVKVGDSIEIVRFFHCYKRGVDRVFVDHPMFLEKVWGKTGSKIYGPKAGQDYLDNELRFSLLCQAALEAPRVLNLNCSKYFSGPYGEDVLFIANDWHTALIPCYLKSMYQSRGIYLNAKVAFCIHNIAYQGRFAFSDFPLLNLPDGFRGSFDFIDGHEKPVKGRKINWMKAGILESDRVVTVSPYYAQELVSAVDKGVELDNVLRKTSITGIVNGMDTQEWNPATDKYTDVKYDITTVMDAKPLLKEALQAAVGLPVDRKIPLIGFIGRLEEQKGSDILVAAIHKFIGLDVQIVVLGTGKKKFEQEIEQLEVLYPNKAKGVAKFNVPLAHMITAGADFMLVPSR

SEQ ID NO: 17726 - protein, 121 aa, Unknown
  Helicosporidium sp. ex Simulium jonesii
FTPQYAELEQLQQEFGAQGFDVLGFPCNQFMNQEPGDSCSIRDAARAKHGATFPMFAKIKVNGSEADPLYKWLKEQKGGILTSAIKWNFAKFLVDRQGKVVGRYAPTTSPKDIANDIKKFL

SEQ ID NO: 17727 - protein, 319 aa, Zea mays
MSSSSSSSSAATVFPPSPQLPPPLLVENLPPLHQLTPPVAAAAPASEQLCYVHCHFCDTVLVVSVLTSSLFKTVTVRCGHCSSLLTVNMRGLLFPGTPANTAAAAAAAPPPPPAAAVTSTTATMTTAPPPPPATSVNNNGQFHFIPHSLDLALPIPPHQSLLLDEISSAANPSLQLLEQHGLGGMITSGRNAAAPHPHPPQPQAPAAGKGAKEPSPRANSAINRPPEKRQRVPSAYNRFIKDEIQRIKAGNPDISHREAFSAAAKNWAHFPHIHFGLMPDHQGPKKTSLLPQDHQRSDGGGLLKEGLYAAAANMGVAPY

SEQ ID NO: 17728 - protein, 389 aa, Brassica napus
MMFNEMGMCGNMDFFSPASLGEVDFCPAPTHPEPDSVVDDDYTDDEIDVDELERRMWRDKMRLKRLKEQDKSGSKEGVDAAKQRLSQEQARRKKMSRAQDGFLKYMLKMMEVCKAQGFVYGIIPENGKPVTGASDNLREWWKDKVRFDRNGPAAISKYQAENSVQGVCEGGSSLIGPTPHSLQELQDTTLGSLLSALMQHCDPPQRRFPLEKGVPPPWWPNGEEEWWCQLGLPKGQGPAPYKKPHDLKKAWKVGVLTAVIKHMFPDVAKIRKLVRQSKCLQDKMTAKESATWLSIVNQEESLARELYPESCPPSLSGGSCSLLMNDCSQYDVEGVEKESLYKVEELKPVKEEVPTEFIRKRKPSRDLNTIMVDRAAFTCENPGCVHSDI

SEQ ID NO: 17729 - protein, 674 aa, Unknown
  Synechocystis sp. PCC 6803
MVSIIKSVRRSLLLKFVLSYFCLSSVVVASIFLVANYRAVKGIESQTFNRLNISNNLKEYQLEQWMEGQKDTLFLLSDINSIQANTELLKNTSVSDPQYKIIQKRLIEELREIDLFLPHIEAINILNTGGIVVASNNLDEIGVYKGIGNQTTYFANINSNFKTVPNFYFSKVYNRPSMTFATNIKHDITRERLGYLSIDINLNAVDDLIRKRTGLGDTGETFLVGEINNQVSFIASDENKKLTANGSKPNFNSLGINSVMAGNSGQGSYVNYAGTPVLGVYQWIEKYNLALITEISEVEALELARRFTRMLVLVGLVSTALLLIAVYLLSIKITKPILLITKAAIDISSGDREARAPVLGEDELGILAKSFNLMTNELRESNSSLEKKNQELELAQKQLAVANSCLEEKVQQRTEELENTVKALELASSEAEAANATKSIFLANMSHELRTPLNAIIGYSEMLIEEAEDLDSEELVPDLDKILRSGKSLLALINDLLDISKIEAGKMELYLETFNLKELIAGILDTISPLLKNNNNKLEVEISLESEEVYGDLIKLRQGILNLLSNASKFTKDGIISFIVEEFKVDEKDWLSFQVKDTGIGLTEEQMSKLFQPFTQADSSTTRKYGGTGLGLAITRKFCQMMGGDIYLTSEIGVGSSFTIKLPKYAQLNSAKND

SEQ ID NO: 17730 - protein, 290 aa, Campylobacter upsaliensis
MKIALIQQKFHDTKEKTIQKTCELIIKAKKEGAKLVCLGELHQSEYFCQSEDVANFDLAKNYEKDVEFWAGVAKENEVVLITSLFEKRSAGLYHNTAIVFEKDGSIAGKYRKMHIPDDPCFYEKFYFTPGDLGFEPINTSVGRLGVLICWDQWYPEAARIMALKGAEILIYPTAIGWFDKDTNEEKERQLHAWLGIQKAHAIANGLYVVAINRVGFEKDKSGVQDGIRFWGNSFVYGPQGEEIFKADSQSELCACVELDLKRSENVRRWWPFLRDRRIEFFGDLQKRYID

SEQ ID NO: 17731 - protein, 340 aa, Glycine max
MIFSRGNTAMSAILLLLGILSSTGVEFTGAQSVGVCYGGNGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVGAPNVKVVVSESGWPSEGGVGATVQNAGTYYRNLINHAKGGTPKRPSGPIETYLFAMFDGNQKDGPEIERHFGLFRPDKSPKYQLSFN

SEQ ID NO: 17732 - protein, 437 aa, Mesorhizobium loti
MAEPGTYGRSSLVQVDCRVHELLLRQRRQERTMLKLIASENFASSAVLEATGSIFANKYAEGYPGARYYAGNEIVDELETLAIERLKALFGSEHANVQPYSGSPANQAVYRALLSPRDKVMGLPLPEGGHLTHGWSVNFSGTDYQRVPYGLHDKTQQIDYDRLRETARRERPKLIWVGGTSYPRVFDYAAMAEIALEANSYLVADIAHISGLIVAGAHPNPVVHCDVVTSTSHKSIRGPRGGFILSKNEDRYQALYHSTSKHNLAKRIDRAVFPQLQGGPHMNTIAALAVALQEAATPSFRTYGHQIVKNAKALAEALLGRGYYLVTGGTDNHMLILDLRDRPLSGKAYAERLARAGIITNFDMVPGDPRDPTVTSGIRLGSPAVTSMGMREAEMVQIAAFIDSVCRQPDDQEVHASVRRDVADFCTAFDVPGISDR

SEQ ID NO: 17733 - protein, 214 aa, Unknown
  Magnetococcus sp. MC-1
MAKQRPSSKRWLREHHNDPYVQQARREGYRSRAAYKLMELQEVVKEDGKSLLLIPVGANVVELGAAPGGWTQVAVKLAGVEGSVVGIDLLAMDPVPGAEILVGDFLDDAMLAQLQGLLHEGRVDVVLSDMAPNMCGVKSADQLRGEALAEAAFQFVEENLKTGGNFAVKLFNGPGFHDMVKQARAMFTVVKVVKPDSSRSRSPEHYLVGMGFKG

SEQ ID NO: 17734 - protein, 701 aa, Ashbya gossypii
MATVGASAEQLLQDINCEGYLGAFRKYEISSVDQLQHLDHEILEQVGIRSIGDRIRILNKSRTLQAGRDKGLLEELQQVIGKINALSAGPMAISEELVTDRHSVIFILNDGSAKKVNVNGCFNADSIKKKLIKRLPPEFVAVAQNGEETSSQDYDVFVVDYAKNVLHLLYDVELVTICHSSDRVEKNRLIFVSKDQTPSDKAILTSKKLYLKTMSAIHQLGSLPTMLQTQGATTVGNYATPGAEAPAGDEDSLRIDNSKESLRRIFNQRPPSELISTNLPEYFPHTDFKRLQKTLRSSFRQSVRMSMLRPGAPLPEGNNVGNILVNQNQAVDRALLQSLDGTKTSSRSSGRSSVDGDASSMGSERRTNASKSTTLDGRDSDAGGRIELLNSESESECDDDNIVSLPTKVVTPKSWLKGARIGSGSFGSVYLGMNAHTGELMAVKQVELEPTTVMASSDDKKSHPSSNAVVKKLTDPPQDGGRASSTKMNLLKELHHENIVTYYGSSQEGGNLNIFLEYVPGGSVSSMLNSYGPFEEPLVKNFTRQTLVGLTYLHRKNIIHRDIKGANLLIDIKGSVKITDFGISKKLSPLNKKQNKRASLQGSVYWMAPEVVKQVVTTEKADIWSVGCVVVEMFTGKHPFPDFSQMQAIFKIGTNTIPELPSWASDGAKAFLYQTFELDYKKRPSSVELLQHKWLDTTTML

SEQ ID NO: 17735 - protein, 357 aa, Unknown
  Synechocystis sp. PCC 6803
MSALSSHSQVLSMLRTTPINFNHWYVVAQAGELGQGPLGIVLWEKAIAIYRDQDGQVRAVEDRCPHRQVKLSEGKVLGNNLECAYHGWQFDAQGHCAKIPYFSEDQKLPPCRLRTYPVQEKDGFIWLYPGDLDHLASHGPEPLAIPEWHHLNHIGSFAAFDCPGHFSYLIENLMDMYHGHLHDNYQAWASASLREIETNGDQVVVDYNAQSYYKIDKIWSISQLFFPTLRRLHPENLRVSYIYPHWSSTLGADFKIYCLFCPISANKTKAYLVHFTSLEAFPKLHKLPVAFRSFLKNWLSGTARPLLEGLIDQDIRMISQEQAAFEQNPDRQNVEVNPALAKVQQLIRQQALASENA

SEQ ID NO: 17736 - protein, 445 aa, Porphyromonas gingivalis
MKTQEIMTMLEAKHPGESEFLQAVKEVLLSVEEVYNQHPEFEKNGIIERIVEPDRVFTFRVPWVDDQGKVQVNIGYRVQFNNAIGPYKGGIRFHPSVNLSILKFLGFEQMFKNALTTLPMGGGKGGADFSPKGKSEAEIMRFCQSFMTELWRNIGPDTDIPAGDIGVGGREVGYMFGMYKKLAREHTGTLTGKGFEFGGSRLRPESTGFGAVYFVQNMCKQNGVDYKGKTLAISGFGNVAWGVAQKATELGIKVVTIYGPDGYVYDPDGINTPEKFRCMLDLRDSGNDVVSDYVKRFPNAQFFPGKKPWEQKVDFAMPCATQNEMNLEDAKTLHKNGVTLVAETSNMGCTAEASEYYVANKMLFAPGKAVNAGGVSCSGLEMTQNAMHLVWTNEEVDKWLHQIMQDIHEQCVTYGKDGNYIDYVKGANIAGFMKVAKAMVAQGVC
